United States Patent 11,098,302 (IDENTIFICATION OF POLYNUCLEOTIDES ASSOCIATED WITH A SAMPLE) - sequence listing, part 114

SEQ ID NO: 393570 - DNA, 696 bp, Homo sapiens
  misc_feature: GZ8MTXP01BSBFT.38.28.C06.1.454.CMB.2.raw
  modified_base (216)..(216): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggccaccctgtctttgtctccgaggggaaanacgccaccctctcctgcgacggccagtcagtagttgtttacaacggtctacgttagcctggtaccagacaaaacgtgccagcctccgagctcctcatctagtcgtactactccgtcgacgggcctacgtggtactccgagactacggttcaggtcggacgtagggttcgggtcgtggggactacgtaccgttacaccgttctacctaccgtactccgaaacggtcgaacggtaccgttagggaacgtacgttaaggtaaagttacgtttagaacgttaggttacgtttaacggttacgttaggtaacacggtactaaggttaacctaaaccgttaaacgaaccggttaaccttaaccgttacggtttccgggaaccggtaaacggggttaacccgtaaacggttcgtaacgggaaaccttaaaccggaaaccgttacggtggtacggtcttacggaccttaccgtcgttaacgtttcccg

SEQ ID NO: 393571 - DNA, 667 bp, Homo sapiens
  misc_feature: GZ8MTXP01D4LPM.38.28.C06.1.454.CMB.2.raw
  modified_base (216)..(216): a, c, t, g, unknown or other
  modified_base (272)..(272): a, c, t, g, unknown or other
  modified_base (296)..(296): a, c, t, g, unknown or other
  modified_base (413)..(413): a, c, t, g, unknown or other
  modified_base (451)..(451): a, c, t, g, unknown or other
tcagtcgatcacgtcacgaccggtgctcgatttagagctcacgtattgggtttgggctgagctggctttttcttgtggctatttttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgagggaagggctgggagtgggtctcagctaaattatgggtaggggtnattcaccatatacgcagactcggngggggccgttcaccatcaccagacgacaactccaaggacgtcaacacttatatcgtaacaaatgaccacagccctagagaaagtcgaagggacacggggcccttgtaattagttgcncgtaagagactccgaaacgttgaccctaacgtttgggntactttgatttcgtgtgggggacccaaaggggtcctaaagttcggtaccaccggttcttacgttcaacgtcccctaccgaaccgtaaacggggtcccccttaagttccccggggttacccgtttcccccccgggtcgggacccccgttcccgttaccggtaacccgtacccggaaccgggtaccgaccccgttaaccccgtccgggaacgtaaccg

SEQ ID NO: 393572 - DNA, 611 bp, Homo sapiens
  misc_feature: GZ8MTXP01DTQOG.38.28.C06.1.454.CMB.2.raw
  modified_base (295)..(295): a, c, t, g, unknown or other
  modified_base (479)..(479): a, c, t, g, unknown or other
  modified_base (551)..(551): a, c, t, g, unknown or other
  modified_base (558)..(558): a, c, t, g, unknown or other
  modified_base (564)..(564): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggcttggttcgacggccccggggggtccctggagacttctccgtgtgcagtctcgtggtattaaccgtttagngactatcgccaatgatcgtgggtcccaccgaggcctccggagggggaaacggggctagggaggtcggggtctacgagactaaagttagtgggttaggggtgtacttcgaacctattaaacgttacgcgtaggaacccgttccggggtcgggggtcctcgaccatccgaccaggacgacctaacncgagacgcacaactatactactaacaaagtcgacaagacgctagagagtacgaggaccacgtcgtgtaattnttggtcngaaganaccgttccgaacgtcaaccctcgttgtccgttacttttgcttttcgg

SEQ ID NO: 393573 - DNA, 675 bp, Homo sapiens
  misc_feature: GZ8MTXP01A57AC.38.28.C06.1.454.CMB.2.raw
  modified_base (280)..(280): a, c, t, g, unknown or other
  modified_base (348)..(348): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatcgtcgggtccgccaggctccgaggggaagggctgggagtgggtctcagactaaagttaagtggggtaggggtanattcactatactacgcagaccgtccgggtgggggtccttcaccgatccaacagacaacactcaggacncaacactatactactaacaaatcgacccaacgagccctaggagtaaacggtcggaaggaccaaccgggtcttagtaacttagtgtgacgaagagtaccacccgaagggttcgaaacccttcgtttgggtcgttcgttttagtagttttcgtacgggttacggggaaccggaaaggggttacctaaaggttccggtccctaaccggttcttacgttcgaccgtccccgtaccgaaccgtaaccggcccttagttccccgttcccgtttcccccgcgggcccttcccgttacgccctaccgaacggccacccgaccgtccggaacgccg

SEQ ID NO: 393574 - DNA, 630 bp, Homo sapiens
  misc_feature: GZ8MTXP01A7Q7P.38.28.C06.1.454.CMB.2.raw
  modified_base (216)..(216): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggccaccctgtctttgtctccgaggggaaancgccacctctcctgcagggccagtcagtagttgtttcaacggtctacttacgcctggtaccagacaaaacgtgaccagcctccaggctcctcatctatggtacactccgtacgacgggccacgtcggtactccagacgtacggttcaggtggctagggtcgggtcgtgggaacacggtacttccgacctctacaaccatcacgcgagaccgttgggacgtcgtagtaaagttatttgacgtaagttcgttaagttactagtcaacgtctaagtaactacgtaaacgaacgtaccgttacttacgtttcgggaaccgtaacggggttaccaacggttacgtaagggaaaccgttaaccgaaacggttaccgttgggacggtccgtacggaccttaccgtaacttcgtttaacccg

SEQ ID NO: 393575 - DNA, 736 bp, Homo sapiens
  misc_feature: GZ8MTXP01C66NB.38.28.C06.1.454.CMB.2.raw
  modified_base (276)..(276): a, c, t, g, unknown or other
  modified_base (336)..(336): a, c, t, g, unknown or other
tcagtcgatcacgtcacgaccggtgctcgatttagagctcacgtattgggtttgggctgagctggctttttcttgtggctattttaaaaaggtgtccagtgtgaggtgcaggtgtcggagtctgggggaggcttggttcagcctggggggtccctgagactctcctgtgcagtctctggatttaacctttagtgactatgccatgatcgtcgggtccgccaggctccgaggggaagggactggagtgggtctcagctaattaagtgggtaggggtnattcactatatacgcagactcggtgggggccttcaccatcaccagacacactccgaggancaactaactatatactaaacaaatcgacccaacgacgcctaggaagaaacgggtacggaacgggaccaacccggggtccgttagttaactttagttggcgtacgaaggaacgtaacctaccccggtaaacgggtacgtaacccgttaccgtttgggttacggtttacgtttttacgtaacgtttttcgtacgggttacgggggaacccggtaaagggggtaaactaacgggttcggtacccgtaccggttccttaccgtttaccacggtcccctacccgaacccggaaccgggtccccaacgtttcccggttccccgtttcccccggtcggttccccgttccccgttcgcccgttacccgaacgggaccgcccgaccccgttaaccggaacggtaacccg

SEQ ID NO: 393576 - DNA, 719 bp, Homo sapiens
  misc_feature: GZ8MTXP01A0YIZ.38.28.C06.1.454.CMB.2.raw
  modified_base (321)..(321): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtggggggaggtcgttgggttcgacggtccccggggggtccctggacgactctcctgtgcagtctcgtggtacttaaccttagtgactatgccatgatcgtggtccncaggctccgaggggaagggctgggagtgggtctcgagactaaagttaaggtggggtacggggtgtactttccaacctataaacgttaccgcgtaacgggaccgttcccggggtacgggggggtcccgttacgaacccgtagttaccaaccgaaggaacgaaccaaaccgttcccgaaaggacgacaaccaacttactactactaaacaatcgacacgacgccgtagacgacgacggacggaccggtaacggtcccggttagttaacgtttaagtttgggtacgttacggaaacggtaacggttaaccgttaccccggttaaaccgggttccgtaaccccgttaaccccggtttggggttacggttttcccgtttttaaggttaaccgtttttccgggg

SEQ ID NO: 393577 - DNA, 734 bp, Homo sapiens
  misc_feature: GZ8MTXP01EJL4I.38.28.C06.1.454.CMB.2.raw
  modified_base (282)..(282): a, c, t, g, unknown or other
  modified_base (709)..(709): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagccgtggggggtccctgagactctcctgtgcagtctctggattaacctttagtgactatgccatgatcgtcgggtccgccaggctccgaggggaaggggctggagtgggtctcagactaaattaagtggggtaagggggttntacttacactatactacgacgacggtacggtccggggtcgggggtcccgtacacctactaccgaaccgaaggaacgaaccaaccgtaccgaaggacaccaactaactaatactaacctaaacaaactcgaacccaacgacgcgtaggacggtaacggacggaacggtaccgtacgggtaccgttagttattagtgtacgacgagaacgtaccgtacccgaacggtacgtaacccgttcggtttgtcgtttctttagtactttcgtggtaccggggaacgtaaagggtaacctacggtcggtacccgtccgttccttacgtccgtacccgtaccccgtaacccgaaccggtaaccggtccccgttacggttccccggttccccgttccccggcggccccgttaccgcgtaaccgtaccgaacggaccncccgttaccgtaacggaacgaaccg

SEQ ID NO: 393578 - DNA, 640 bp, Homo sapiens
  misc_feature: GZ8MTXP01APLH6.38.28.C06.1.454.CMB.2.raw
  modified_base (215)..(215): a, c, t, g, unknown or other
  modified_base (271)..(271): a, c, t, g, unknown or other
  modified_base (280)..(280): a, c, t, g, unknown or other
  modified_base (304)..(305): a, c, t, g, unknown or other
  modified_base (312)..(312): a, c, t, g, unknown or other
  modified_base (324)..(324): a, c, t, g, unknown or other
  modified_base (402)..(402): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatcgtggtccncaggctcgaggggagggctggaggtggtctcgagactaagttagtgggtaggggtnattcacatntacgcagctcggtggggcctcacnncacaganacactcgaggcncacatatatacaacaaatcgaccacacgcgtagagaacgtacggaaggacctacggggccgttagttagttattgggngacgagacgtacgtaccgtaacggtcgtaccgtacgttggtcgtttacgtttagtacgtttcgtaggtacggggacgtaaagggtactacggtcggtaccctccgtcttccgtacgtccgtcccacccgaacccggaacggtccccgttacgttccccggttccccgtccccggtcggccccgttcccgttacgcccgtaccggaacggtcccgacccgttaccgtccggaacggccg

SEQ ID NO: 393579 - DNA, 632 bp, Homo sapiens
  misc_feature: GZ8MTXP01EJSFH.38.28.C06.1.454.CMB.2.raw
  modified_base (216)..(216): a, c, t, g, unknown or other
  modified_base (276)..(276): a, c, t, g, unknown or other
  modified_base (336)..(336): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccattgatctgggtccncaggctccgaggggaagggctggaggtgggtctcgagactaaattaagtgggtaggggtnattcactatatacgcaagccgtcggtgggggcctcaccatcaacagacacactcgaggancaacactatactactaacaaagtgaccccacgtacgcgtgaacgaaggtaccgaagacgaccgggtcgtagttatttagtgacgacgagagaactcccgaaacggtgaaccccttcgtttggtcgttcttttaggatttcggtgtacgggggtacccaaaggggtaactaacgtcggtaccctaaccggtttcgtcttcaaccggtcccaccaccggaaacggcccttaggttcccggttcctccccgtgggcccgttcccttgaacccgtcgaacggcgccacccgtcgaagccg

SEQ ID NO: 393580 - DNA, 672 bp, Homo sapiens
  misc_feature: GZ8MTXP01ET23I.38.28.C06.1.454.CMB.2.raw
  modified_base (270)..(270): a, c, t, g, unknown or other
  modified_base (307)..(307): a, c, t, g, unknown or other
  modified_base (319)..(319): a, c, t, g, unknown or other
  modified_base (324)..(324): a, c, t, g, unknown or other
  modified_base (332)..(332): a, c, t, g, unknown or other
  modified_base (344)..(344): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtagggggtnatcacatatacgcagacgtcggtgggggccgtcacancacagacacacncagancacactanatacaacaaatnaccacagcctagagaacgtcggaaggaccgaccgggtccgttagttaattagttgtcgacgaagacgacctacccggaaaggtcgtaacccgtacgtttgggtcgttctttgtattttcgtaggttacgggggaacgtaaaggggtaactaaggttcggtaccctacccgttcttccgttaccgaccgtcccctacccgaaaccggtaacgggtccccttaacggttcccggtttccccgttccccccggtcgggccccgttccccgttcgtccccgttacccggaacgggtaccgaccccgttaccccggtaaccggaacggaaccg

SEQ ID NO: 393581 - DNA, 724 bp, Homo sapiens
  misc_feature: GZ8MTXP01D6M7Y.38.28.C06.1.454.CMB.2.raw
  modified_base (218)..(218): a, c, t, g, unknown or other
  modified_base (301)..(301): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgccactctggctcccagattccaccggagagattgtgttgacgcagtctccaggccaccctgtctttgtcctaccgaggggaaancgcccacctctcctgcgagggccagtcagtagttcgtttacaacggtctacttcgctggtaccagacaaaactgcaggctccngctcctcatctatggtacacgtccgtcgacgggtaccacgttggtactaccccgaagtaccgtacgggttcctaggtcgggtcgtaacgggttcggggttacgttcgggggactaacggtacctttccaaccgttccttaccgaacctacgtcgaacgcaaggtacggttacggggaacggttacgtagggtaaagttacgtttttacggacgttaaagtttacggtttaagttttaacggtttaactaaccgtaaggttaacccgtaaggtttaactttaaacctaaaccgtaaacgtaacccggtttaacttaccggttttacgggaacccgttaacgggggaacctaacggacgtaacgggaacgaaaccgttaaacggaacgtggttacgcgttacgaccttacctaattcggtttaac

SEQ ID NO: 393582 - DNA, 647 bp, Homo sapiens
  misc_feature: GZ8MTXP01D0QQ4.38.28.C06.1.454.CMB.2.raw
  modified_base (318)..(318): a, c, t, g, unknown or other
  modified_base (378)..(378): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggtcttgggttcgacggtcccgggggtccctggagactctcctgtgcagtctcgtggtatttaaccgttagtgactatcgcatgatcgtgggtccncgaggctacgaggggacgggcgtggagtgggtctcgagactaaagttagtgggtagggtntagtcacctataacgttacgcgagtaccgtccggggtcgggggccgtacacgtatccaacgagacgaacaacgtaccgaagggacacaacaactatactacgtaaacaagtcgaccaacgacgacccgtgaacggtacgtacggacggaccggtaacggtccgttaagttaatttagttggtacgacggtaagtacggaccgttaccggaaacgggtccgtaacccgtaacggtttggtctttaccgtttttaagttcgttttcccggg

SEQ ID NO: 393583 - DNA, 754 bp, Homo sapiens
  misc_feature: GZ8MTXP01DHGES.38.28.C06.1.454.CMB.2.raw
  modified_base (277)..(277): a, c, t, g, unknown or other
  modified_base (355)..(355): a, c, t, g, unknown or other
  modified_base (688)..(688): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggatttaacctttagtgactatgccatgatcgtgggtccgccaggctccgaggggaagggctgggagtgggtctcagactaagttaagtgggtaggggtnattcactatatacgcagacgtccgggtcgggggccgttacaccgtatccaaccgagaacgaccaacctaccgaagganaccaacctaactataacttacctaaacaaatcgacccaacgacggtcctaggaacggtaaacggtaccggaagggtaaccgaacccgggtccgttagttaatttagtgggtcgacggaagacgtaacgtaccccgaacggggttacaaccccgttacgtttgggttacgttccgtttttagaacgtttcgttacgggtacggggaacccggtaaaggggtacttaaaggtcgggttacccctaacccggtctttaccgtccgaccgtacccctccgaaacccggtaaccgggtccccttaacgttccccgggtttcccctttaccccccgggngggttcccccgttcccgttcggaaccctacggaacgacccgacccgttacccgtcggaacgtaacg

SEQ ID NO: 393584 - DNA, 747 bp, Homo sapiens
  misc_feature: GZ8MTXP01EQ9OE.38.28.C06.1.454.CMB.2.raw
  modified_base (280)..(280): a, c, t, g, unknown or other
  modified_base (324)..(324): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtggggggaggcttggttcagcctggggggtccctgagactctcctgtgcagtctctggtattaacctttagtgactatgccatgatcgtcggtccgccaggctccgaggggaaggggctgggaggtgggtctcagactaaattaagtgggtaggggtnattcacctatatacgcaagcgtccgggtgggggccgttcacctntacaccgagacgacaacctccgaagacgcaacactatatactaacaaatcaccacgacgtcctaggaggaaacgtacggaagggaccctacgggtccttagttactttacggtggtagcgaaggacgtaactaccccgaaggtcgtaaacccgtcggtttggtacgttcgttttagtactttcgtagggtaccgggggtaacgaaacgggggtaactaaacggttccggtacccgtaacccggtttcccttacccgttaccgtaacccgtaccccgttaaccccggaaacccggtaaccggggtcccccttaacgggttccccggggtttcccccttccccccgggttcgggcccccgttcccccgttggtcccccgtccggaaacggggcccctccgttaccccgtcgggaacggaacccgg

SEQ ID NO: 393585 - DNA, 554 bp, Homo sapiens
  misc_feature: GZ8MTXP01AQ5VO.38.28.C06.1.454.CMB.2.raw
  modified_base (212)..(212): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtcttgctccgaggggaangccacctctcctgcagggccagtcagtagttgtttcaacgggtctacttagcctggtaccagacaaaacctggccaggctccaggcctctcatctatgtacatccgtcagggccatggtactccagacaggttcagtggcaggtgggtctgggacaggacttcacgtctcaccatcagcagaccgtgggacgcgtagtaagtatttgctagtgtattactggtacagtcagtatactacaagtaccgttactacgtttggaacccgaaggggttacccgaaagcgtacgggaacgaacccgttaagaaccgtggtacggctaggcacctaagttcttaaccg

SEQ ID NO: 393586 - DNA, 687 bp, Homo sapiens
  misc_feature: GZ8MTXP01A0P4E.38.28.C06.1.454.CMB.2.raw
  modified_base (314)..(314): a, c, t, g, unknown or other
  modified_base (375)..(375): a, c, t, g, unknown or other
  modified_base (475)..(475): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcgaggtgtcggagtcgtgggggaggcttggttcgacggtcccgggggtcctgagactctcctgtgcagtctctggtacttaaccttgtgactatcgcatgatcgtcggtccncaggctcggaggggacgggcgtgggaggtgggtctcgagtactaagttagtgggtagggtntactcactataacttacgcgacgtaccgtccggggtcggggggtcccgttacaccgactaccgaaccgaaggaacgaacctaaccgaccgaacgggaacnccaaactaactaataactaacttaaacaaacgtcgaaccgacacgacccgtaggacggaccggttaacgggacggaaccgtacccggggtaccgtttagttaacgtttaggtttcggaggaccggaaacggtaacgttaacccgttacccggttaacgggtcctaacccgtaaccggtttgggtccgtttcgtttaagttcgttttaacggg

SEQ ID NO: 393587 - DNA, 662 bp, Homo sapiens
  misc_feature: GZ8MTXP01ARY1F.38.28.C06.1.454.CMB.2.raw
  modified_base (282)..(282): a, c, t, g, unknown or other
  modified_base (325)..(325): a, c, t, g, unknown or other
  modified_base (366)..(366): a, c, t, g, unknown or other
  modified_base (485)..(485): a, c, t, g, unknown or other
  modified_base (493)..(493): a, c, t, g, unknown or other
tcagtcgatcacgtcacgaccggtgctcgatttagagctcacgtattgggtttgggggaggcttggttcagcctgggggggtccctgagactctcctgtgcagtctctggattaacctttagtgactatgccatgatctgggtccgccaggctccagggaaggggctggagtgggtctcagcaattaatggtaggggtgattcaccatattacgcagacgtccggtgggggccgttcaccatcaccagagacaactccaggagcacactatatctaacaaangacacagcctaggagagtcgaggaccacggccgtgtattatgngcgagaagactaccgaaggtcaccgtaccgtttcggtcgtnttttgatttcgtaggttcggcccaaagggtaaccaagttcgggtcctacccggttcttccttaccgaacgtccctaccgaccgaaccggggccctacgttcccggttcccttcccccgngggtcccncccgttcgccctccggaacggacgccacccgtccgagaccgccgacgtaccggccgggccccgtgggcccgtaacggcccgttacggtcgaaacggtacccttaccttacccggcgttacggtaacgttcccggaacgttcgggaccggccggggcgttcggggaacgg

SEQ ID NO: 393588 - DNA, 777 bp, Homo sapiens
  misc_feature: GZ8MTXP01B2IRS.38.28.C06.1.454.CMB.2.raw
  modified_base (280)..(280): a, c, t, g, unknown or other
  modified_base (332)..(332): a, c, t, g, unknown or other
  modified_base (345)..(345): a, c, t, g, unknown or other
  modified_base (375)..(375): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagccgtggggggtccctgagactctcctgtgcagtctctggattaacctttagtgactatgccatgatcgtgggtccgccaggctccgaggggaaggggctgggagtgggtctcagactaagttaagtggggtagggggtnattcactatattacgcagacgtcggtgggggcctagttcaccatacacaganacactccgaggancacactatactactaacaaatcgaccaacnggaccctaggaaagtacggtccgggaaacgggaaacccgtaccggggtaccgtttaggttaagttttacgtttggtacgggcgaaaggacgtacgtacccccgtaaacggggtcgtaaaccccgttaccggttttggggtacgtttccgttttttaggtaacgtttttcggtacgggggtttacgggaaccccggtaaaggggtaacctaaagtttccgggtacccgtacccggtttacttccgttaaccgcggtacccccttaccgaaacccggaaccggggttcccctaacggtttcccggttcccctttccccccgggttgggttccccgccccggttcggccccttaacccgggaaacgggccgttaccccgttaaccccggttaaccggtaaccggg

SEQ ID NO: 393589 - DNA, 512 bp, Homo sapiens
  misc_feature: GZ8MTXP01ESYAO.38.28.C06.1.454.CMB.2.raw
  modified_base (351)..(351): a, c, t, g, unknown or other
  modified_base (361)..(361): a, c, t, g, unknown or other
  modified_base (399)..(399): a, c, t, g, unknown or other
  modified_base (406)..(406): a, c, t, g, unknown or other
  modified_base (418)..(418): a, c, t, g, unknown or other
  modified_base (432)..(432): a, c, t, g, unknown or other
  modified_base (442)..(442): a, c, t, g, unknown or other
  modified_base (445)..(445): a, c, t, g, unknown or other
  modified_base (447)..(447): a, c, t, g, unknown or other
  modified_base (465)..(465): a, c, t, g, unknown or other
  modified_base (477)..(477): a, c, t, g, unknown or other
  modified_base (481)..(481): a, c, t, g, unknown or other
  modified_base (504)..(504): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttggttcagccccggggggtccctgagactctcctgtgcagtctctggattaaaccttagtgactatgccatgatctgggtccgccaggctccgagggaggggctggagtgggtctcagcaaattaanggtaggggtnatcacataatacgcagacgtcgggtggggccgtcacancacaganacaactcaggancacatatatacaanaaagtgacanacncngagagcgagacgacgcgngtaatattgtgngagnacgccacgcgacaacgtgtgttnttgttgtg

SEQ ID NO: 393590 - DNA, 919 bp, Homo sapiens
  misc_feature: GZ8MTXP01BQZNM.38.28.C06.1.454.CMB.2.raw
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggtattaacctttagtgactatgccatgatcgtggtccgcaggctcgaggggagggctggaggtggtctcgagtactaagttaagtggggtaggggtagactttaccaacctaagttaacttacggacgtaacgggtacccggttcccgggggtcggggggggtaccccgtttaccaacccgtattaccccgaaaccgaaaggaaccgtaaaccaaaccgtccgaagggactaccaactaacttattatacctaaacaaacgtcggacccccaactacgccgtaggaacggtaaacggtacggaacgggaccgtaccgggttccgttagttaagtttacgttggtacggacgtaacggaacgtacgtacccccggtaaagggtacccgtacccgttaaccgtttggtttacgtttccgtttagttacttttcggcggggtttaccggggtaacggtaaaggggtacctaaacgggttcggtcccgtaaccccggtttcccttaacgttacccgacccgggttaaccccctaaacccggtaaacccccgggtaacccgggggttacccccctttaaacggggtttcccccccggtttaaccccccggttttccccccccggggaacgggttacccccccggttccccggttaccggaacccccggtttacccggggaaacccgggttccccggaacccccggttaccccggttaaccccgggaaaaccggggtaaccccggg

SEQ ID NO: 393591 - DNA, 778 bp, Homo sapiens
  misc_feature: GZ8MTXP01CE0F3.38.28.C06.1.454.CMB.2.raw
  modified_base (296)..(296): a, c, t, g, unknown or other
  modified_base (692)..(692): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgtgctcaactgtcttgtccaccttgctgagctggtctttttcttgtggcttattttaaaaggtgtccagtgtgaggtgcaggtgtcggagtcgtgggggaggtcttggttcaggtccgtcgggggtccctgagtactctcctgtcgcagtctcgtggtaatttaaccttagngactagtcgccatgatcgtcggtcccgccgaggtccgtccggaagggggacggggcgtagggtaggttgggtctcgaagtacgtaaagttaaggtacggggtaggggttagtacttccaaccgtaattaacgttaaccggcgtaacgggtacccgggttcccgggggtccggggggtaccccggttaccgaacccgtacgtcccaaacccggaaggaacgaacccgtaaacccgtaccccgggaaggaacccgtaccaaacccctaagtttaaacctaacttaaccctaaacggtaaacgttaccgaccaaaccgtacgtacccgttaggaaggtaccggtaacgggaaccggaacccgtcccgggtcgtttaaggtttaagtttaggtttacggngtaaacggtcggttaacggccccttacccggtaaccggtcgtaacccgttacggttttcggttcgtttccgttttaacgttaacgg

SEQ ID NO: 393592 - DNA, 675 bp, Homo sapiens
  misc_feature: GZ8MTXP01B1986.38.28.C06.1.454.CMB.2.raw
  modified_base (457)..(457): a, c, t, g, unknown or other
  modified_base (477)..(477): a, c, t, g, unknown or other
  modified_base (506)..(506): a, c, t, g, unknown or other
  modified_base (521)..(521): a, c, t, g, unknown or other
  modified_base (594)..(594): a, c, t, g, unknown or other
  modified_base (603)..(603): a, c, t, g, unknown or other
  modified_base (659)..(659): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttctgtggtcttaattttaaaaggtgtccagtgtgaggtgcgaggtgtcggagtcggtgggggagtcgttgggttcgacgggtcccgggggtccctggacgtactcctcgtgtcgctagttctcgtaggttaactttaaacccgtttaggtacgtaacttagtcgtaccctagttacgtacttccggttcggggtccccgaccggtaacggggtccgtacccgggaagggggtaacggggtcgtaggggtaggtcgggtcttacgaagtacgtaaagttaggtggggtacgggtntactcgactataacttacgngagaccggtcgggcggggtccgtcactanaccagagacactacnccgaaggctcaacatagtactacaacgaaatcgacagacgtccaggacgtagtacggacgtaccgacggtctntaagtttanggtcgagtaacgaattacccgacccggttaggtcaccccgtttgggttcgcgtttntttcgaacgtttcggg

SEQ ID NO: 393593 - DNA, 670 bp, Homo sapiens
  misc_feature: GZ8MTXP01AOBDD.38.28.C06.1.454.CMB.2.raw
  modified_base (378)..(378): a, c, t, g, unknown or other
  modified_base (433)..(433): a, c, t, g, unknown or other
  modified_base (443)..(443): a, c, t, g, unknown or other
  modified_base (621)..(621): a, c, t, g, unknown or other
  modified_base (665)..(665): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtggtccgccaggctccgagggaaggggctgggagtgggtctcgagactaatttaagtggggtaggggtgattcgaaccattattaccgcgaagaccgttccgggtgggggggtcccgttcaaccgtatcaacccgaggacgtaccaactcccgaaggacgcaactacttanatactaaacgaaatgacccacagccctagagaagtccgaagaccacgggccgttntaattgttgngacggagagactacccgaaggttcgaaccctacgttcggtgtacctttttaggacttttccgtagggtcggggtacccggaaaggggtacgtacgttagggtccccaaccggtttctcctttacgaccgtcccctaccgcccggtaacgggtcccttagtcccggttcccttccccgngggcccttccccttggcctccgaacggcgcccaccgtaaccggngaacg

SEQ ID NO: 393594 - DNA, 647 bp, Homo sapiens
  misc_feature: GZ8MTXP01BSVZM.38.28.C06.1.454.CMB.2.raw
  modified_base (276)..(276): a, c, t, g, unknown or other
  modified_base (289)..(289): a, c, t, g, unknown or other
  modified_base (298)..(298): a, c, t, g, unknown or other
  modified_base (597)..(597): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatcgtcgggtccgccgaggctccgaggggagggctgggagtgggtctcagactaattaagtgggtaggggtnattcacatatcgnagcgtcggnggggcctcacatcacagacgacactccgaggacacacactatactactaacaaatcgaccaacgcgcctaggaggtaagtacgaacggaccgaccgggtcgttagtattagttgtcgacgaagcgaaccgtacccgaacgggtcgaaaccccttccggtttgggttcgttcgttttgtaacgttttcgtcgggtacggggacggaaacggggtaacctaaggttcgggtaccctaccgttcttcttccgacctccctacccgaaccgaacggtcccttagtcccgttcccgttccccgnggcccgttcccttcgtcccgtcgaaccggtcaccccgacgtccgaagccg

SEQ ID NO: 393595 - DNA, 738 bp, Homo sapiens
  misc_feature: GZ8MTXP01DFQL8.38.28.C06.1.454.CMB.2.raw
  modified_base (184)..(184): a, c, t, g, unknown or other
  modified_base (299)..(299): a, c, t, g, unknown or other
  modified_base (320)..(320): a, c, t, g, unknown or other
  modified_base (327)..(327): a, c, t, g, unknown or other
  modified_base (389)..(389): a, c, t, g, unknown or other
tcagtcgatcacgtcacgaccggtgctcgatttagagctcacgtattgggtttgggggggaagaggaagactgacggtcctgccacaggtggtgctgggcaaggtgggcactcgacacaacatttgtgctcaactgtcttgtccaccttgctgagctggtcttttctgtggctatttaaaaggngtcagtgtgaggtgcaggtgtcggagtcggtgggggagtcttggttcgagtccggtgggggtaccctgagctctccgtgtcgctagtctgtggtaattaaccttgtgaactagtntaccatagactcgtcggtccncgagccncggaaggggacgggcttgggagtcgggcttacgagactaaagttagtacgggtaggggtatntaccgaccgtaaattaactcgacgaacggttacggtttcccgggggcgggggtacccgttacaaaccctacgtaccggaaccaaaagggcttaaaaccacgtacccggaaagggtaacaccaaacttaactaactaactaacctaaaaggggaacgtccgaaaccgtacgtaccggtacgaaggtaacggtaaacgggaccggtaaacggttaccggaccggttaacgtttaagtttaacgttagggttcgaacggtaaccggaagttaaccggaccccgttaaaccggggaaaccgttaccgaacccgttttacgggttcggtttacgttttccgttttaacgtaacg

SEQ ID NO: 393596 - DNA, 690 bp, Homo sapiens
  misc_feature: GZ8MTXP01BWV3M.38.28.C06.1.454.CMB.2.raw
  modified_base (286)..(286): a, c, t, g, unknown or other
  modified_base (299)..(299): a, c, t, g, unknown or other
  modified_base (320)..(321): a, c, t, g, unknown or other
  modified_base (334)..(334): a, c, t, g, unknown or other
  modified_base (339)..(339): a, c, t, g, unknown or other
  modified_base (353)..(353): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggtatttaacctttagtgactatgccatgatcgtcgggtccgccaggctaccggaggggaaggggctgggaggtgggtctcgagactaaagttaagtggggtagggtnatcacatatacgnagcgtcggcggggcctacacnnccacagacacacncaagncacatatatacaanaaactgaccacgacgtcgagacgtacgacggaacggcgacgggtccgttagttactttaggttgtacgggacgaaggtaacgtaccccgtaacccggtaaacgggttccgtaaacccccgtttacggtttaggttccgttttacggttttacgtaacgttttccgtggtacgggggtaaccgtaaaggggtaactaacggttcgggtcctaccgttcttaccttcgacctccctaccgaaccggtaaccggccttaccggtcccgttccccgttcccggtacgccccgttccttccgccgtaccgaacggcccgtccgacccgtcggaacgaacccg

SEQ ID NO: 393597 - DNA, 686 bp, Homo sapiens
  misc_feature: GZ8MTXP01AUTPH.38.28.C06.1.454.CMB.2.raw
  modified_base (215)..(215): a, c, t, g, unknown or other
  modified_base (280)..(280): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgcatgatcgtgggtccnccgaggctcgaggggaagggtctgggagtgggtctcgagtactaaagttaagtggggtaggggtntacttcaaccaatatacgctacgacgtccgggtgggggtccgtcaccatccaacaggacgaacaaccgtcgaagggactcaactaacttaatacttacgaaactaaagtcgaccaaccgagccctaggacgaacgggtacggaacggacccgacgggtccgttagttaattcgttgcgacgtaggacactacccggaaggtcaaccctcgttgggttacttcgttttagtatttccggttaggacggggtaaccgtaaaggggacctaaggtcggtaccaccggttcttctcctcgaccctaccgaacggaaccggtcccttgttccccgggccctttccccggcggccccgttcccgacggttcccaacggcgggaccctacccgacccgtcggaacgaacccgg

SEQ ID NO: 393598 - DNA, 669 bp, Homo sapiens
  misc_feature: GZ8MTXP01B3OZ4.38.28.C06.1.454.CMB.2.raw
  modified_base (314)..(314): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcgttggttcgacggcccgggggtcctgagactctcctgtgcagtctcgtggtattaaccgttgtgactatcgccatgactcgtgggtcccnccgaggcctaccggaaggggaacgggcgtgggaggttcggggtctacgagactaaagttaagtggggtaacggggtgtaactttacgaaccctagttaaacttacgcgtaaagtacccgtcccggggtacggggggtcccttacaaccagtaccgaaccgaacggaacgaaccgaaacctacccgaaacgggacgaacaaccaactaataactacttaaaccgaaatcgaccaacgaacgacccgagaacgacggtacggaacggtaccgaccggtccgtgttaattgttggtcgacgtagagacgttcccgaacggtcgaccctaaccgttggtcgttcgttttgaagtttcgg

SEQ ID NO: 393599 - DNA, 680 bp, Homo sapiens
  misc_feature: GZ8MTXP01EV8I8.38.28.C06.1.454.CMB.2.raw
  modified_base (289)..(289): a, c, t, g, unknown or other
  modified_base (312)..(312): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggtctttttcttgtggcttaattttaaaaggtgtccagtgtgaggtgcaggtgtcggagtcgtgggggagcttggttcaggccgtgggggtccctgagactctccgtgtgcagtctctggatttaaccttagngactatgccatgatcgtggtccnccaggctcgaggggaagggctgggagtggtctcgagactaaagttaagtcggggtaggggtgtattaccaacctaaattagttaacgcaagggtacccggttccggggtcggggggggtacccgttacaacccgtagtacccgaaccgaacggaacgaacctaaacgtaccccgaaaggggacaccaactaacctaattaacgttacctaaacaaaagtccggaaccaacgaacggtccctaggaacgtacggtcggtaagggaccgaccgggtaccgttgttaattagtttcggagaccgtagacggttaccttaccccgaaaggggtccaacccgttaccggttggttctttccgttttgttaacg

SEQ ID NO: 393600 - DNA, 696 bp, Homo sapiens
  misc_feature: GZ8MTXP01BQUMD.38.28.C06.1.454.CMB.2.raw
  modified_base (281)..(281): a, c, t, g, unknown or other
  modified_base (351)..(351): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggatttaacctttagtgactatgccatgatcgtcgggtccgccaggcctaccgaggggaaggggctgggagtgggtctcagactaattaagtgggtaggggtnacttcactatactacgcagcgtcgggcggggggccttacaccatcaaccgagacgacacgtcgaaggacncacatatatactaacaaatcgaccccacgacgtccgtaggacgtaaacgggtacggaacgggaaccacccggggtccgttagttaactttagttgacgtacggagacgtaacacccggtaacggtcgaaaccccgttcgtttggtcgttccgtttagtctttcggttacgggtcggggtaacgaaaggggtactaacggtcggtaccctaccgtttctaccttcgacccgtcccttacccgaccggtaaaccgggtcccttacgggttccccgtttccccgttccccggtaggccccgtttcccgcgtaacccgtcggaacgacccgcttacccgtcgaacgccg

SEQ ID NO: 393601 - DNA, 761 bp, Homo sapiens
  misc_feature: GZ8MTXP01EWXX1.38.28.C06.1.454.CMB.2.raw
  modified_base (214)..(214): a, c, t, g, unknown or other
  modified_base (274)..(274): a, c, t, g, unknown or other
  modified_base (300)..(300): a, c, t, g, unknown or other
  modified_base (312)..(312): a, c, t, g, unknown or other
  modified_base (339)..(339): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtgggggtccctgagactctcctgtgcagtctctggattaacctttagtgactatgccatgatcgtggtccnccaggctccgagggaagggcgtggagtgggtctacagtactaattaagtgggtaggggtnattcactatatacgcagcgttcgggngggggcccgtanaccatccacagagacactccgaggacncacatatatactaacaaagtcgaccaactagccgtaggagtaacggtacggaacgggtacaccggggtaccgtttagttaacgtttagttgggtacgaccgggtaagtaaacgggtaacccgttacccccggaaacgggttaccgtaaacccccgttcggtttttagggccgttttacgtttttcgtaacgtttttccgtagggttaccggggtaaaccggtaaaaggggtaacctaaaggttccgggtacccttaacccggtttcttacccgtttacacccgggttaccccacccggtaacccgaaacgggtcccccttaggttccccggtttcccccgtccccggttccgggcccgttccccgttggtcccccgttaccgaacgggtcccacccggttaccccgtaacggaaggaacccg

SEQ ID NO: 393602 - DNA, 711 bp, Homo sapiens
  misc_feature: GZ8MTXP01C5HI2.38.28.C06.1.454.CMB.2.raw
  modified_base (186)..(186): a, c, t, g, unknown or other
  modified_base (376)..(376): a, c, t, g, unknown or other
  modified_base (418)..(418): a, c, t, g, unknown or other
  modified_base (438)..(438): a, c, t, g, unknown or other
tcagtcgatcacgtcacgaccggtgctcgatttagagctcacgtattgggtttgggggagctctgagagaggagcccagccctgggattttcaggcgtttttcatttggtgatcaggactgaacagagagaactcaccatggagtttgggctgagctggtcttttctgtgcttaagttttaaaggngtccagtgtgaggtgcgaggtgtacggagtcggtgggggagtcgttggttcgacgggcccgggggtcctagagtactctccgtgtgctacgttctcgtaggtaactttaaccgttagtcgtactagtcgtacctaagtgtatccggttcgggcccgacgtacgggcctacgggagggggaacggggtcgngggtaggtcgggtctagacgtataagttagtagggttagggntatcaacgattaaactacgngagtaccgtcggggtcgggggaccttacacccgataccacgaagaacggacaaccgacgaaggacactacctaatactaataaccgtaaacaagggttacacaacgacgacgttcggaaatacggtacggaaccgtaccgggtacgtccgtttagggttaaactttcggttaaaggtacggacggtaacgtaacgaaccgttacccgaaccgggttccgtaaaccccgtttcggtttcggggttacttttacggttttaacgttccgttttgg

SEQ ID NO: 393603 - DNA, 662 bp, Homo sapiens
  misc_feature: GZ8MTXP01CW7TK.38.28.C06.1.454.CMB.2.raw
  modified_base (274)..(274): a, c, t, g, unknown or other
  modified_base (338)..(338): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaaccttagtgactatgccatgatcgtgggtccgccaggctccgaggggaagggctgggagtggggtctcagactaattaagtgggtaggggtnattcacatatacgcagacgtccggtggggggccttcaccatccaccagacaacactccaaggcncaacactatatctaaacaaatcgacccacgtagcccgttagaacggtaacggtcccggaagggtaacccaccggggtacccgttaggttaatttacgttggaggacgagaacggactacccgaaacggtacgaacctaccggtttaggtcggttctttcgtatttacgtggtacggggtacccggaaggggtaccaaggtcgtccgaccgttactcttacacgccctccaaccgaacgggcccacgttcccggttcccgttccccgtcgcccgttcccgttcgtaacctcccgaacgaccggccttacccgtaaccgcgaaccg

SEQ ID NO: 393604 - DNA, 749 bp, Homo sapiens
  misc_feature: GZ8MTXP01AQ9GU.38.28.C06.1.454.CMB.2.raw
  modified_base (263)..(263): a, c, t, g, unknown or other
  modified_base (270)..(270): a, c, t, g, unknown or other
  modified_base (277)..(277): a, c, t, g, unknown or other
  modified_base (281)..(281): a, c, t, g, unknown or other
tcagtcgatcacgtcacgaccggtgctcgatttagagctcacgtattgggtttgggggaggcttggttcagcctgggggggtccctgagactctcctgtgcagtctctggattaacctttagtgactatgccatgatcgtgggtccgccaggctccgaggggaagggctggagtgggtctcgagcaattagtgggtagggtgattcacatatacgcagacgtcggtgggggccgttcaccatcaccgagagacaactcaggancacatanatctaanaaancgacacgacgtccgtaggaagacggtacggaaggaaccgtacgggtccgtttaggttaactttagttggtcggacggaggtaacgaccttacccggaaagggtcaacccttacggttttcggtcgtttacgtttttagtacttttcggtagggttacggaaccggaaacgggtaactaaacggttcgggaaccttacccggtcttacccttacgaccgtacccgtacccgaaccggtaaccgggcccgttaaccgttcccggttaccccgttcccccgcggggtcccctcccggtacgcccgttacccgggagggtacccgacccgtacccgaccgacgacgccgaaccgcggacccgggtcccggtcgggcctcggtccgttacggtaccgaaacggttaccctacgttaccgttcggttacttaacgcgtaacgtcggggaccgggttcgggtcgcgggaaccggg

SEQ ID NO: 393605 - DNA, 687 bp, Homo sapiens
  misc_feature: GZ8MTXP01ELW4B.38.28.C06.1.454.CMB.2.raw
  modified_base (276)..(276): a, c, t, g, unknown or other
  modified_base (660)..(660): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggatttaaccttagtgactatgccatgatcgtgggtccgcaggctccgaggggaaggggctgggagtgggtctcgagataaattagtgggtaggggtnattcacatatcgcagacgtcgggtgggggcctcaccataccacgagacgaactaacctcgaaggagacctaactaataataacttacctaaacaaagtcgacccaacacgcctaggagaacgtacggaacggaccgacggtcgttagttaactttagtggtggacgtagaacgtactacccgaaacggtcgtaaacccttcgtttggtcgttactttgttactttcgtggtacggggaaacccgtaagggaactagttcgcccgtaccgttctaccttccgacgtacccctaccgaaacccggtaacggtccccttacggttccccgttaccccgttccccgtacgggcccttccccgttcgaaccccttcggaacgggtaccnccccgttaacccgtcgaacggaacccg

SEQ ID NO: 393606 - DNA, 568 bp, Homo sapiens
  misc_feature: GZ8MTXP02J03WS.38.28.C06.1.454.CMB.2.raw
  modified_base (182)..(182): a, c, t, g, unknown or other
  modified_base (284)..(284): a, c, t, g, unknown or other
  modified_base (289)..(289): a, c, t, g, unknown or other
  modified_base (313)..(313): a, c, t, g, unknown or other
  modified_base (315)..(315): a, c, t, g, unknown or other
  modified_base (318)..(318): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgcgtttctaggtggctatttaaaggngtcagtgtgaggtgcaggtgtcggagtctgggggaggcttgggttcagcccggggggtccctgagactctcctgtgcagtctctggataccttagtgatatncatgntcgtggtcgcgcgcgcgaggaggngnggnggtggtcgtcgagactaagtaagtaggtaggggtaggtagtacactactattacgtcgacgacgtccggtcgggggtccgggtcgtaccacacaccgacgacgacaacacgacgacgacacactatatactaacaatagacacacgacagagagacggacggacgacgacgtacgtagttagttgtcgacgacgacgacgtaccgaccggtaacgaccgtaccgttcgtcgttcgtttcgttacgtttcg

SEQ ID NO: 393607 - DNA, 536 bp, Homo sapiens
  misc_feature: GZ8MTXP02JDIAE.38.28.C06.1.454.CMB.2.raw
  modified_base (298)..(298): a, c, t, g, unknown or other
  modified_base (305)..(305): a, c, t, g, unknown or other
  modified_base (332)..(332): a, c, t, g, unknown or other
  modified_base (473)..(473): a, c, t, g, unknown or other
tcagtcgatcacgtcacgaccggtgctcgatttagagctcacgtattgggtttgggctgagcgtggcttttctgtggctattttaaaaggtgtccagtgtgaggtgcaggtgtcggagtctgggggaggcttggttcagcctgggggtccctgagactctcctgtgcagtctctggattaacctttagtgactatgccatgatctgggtccgccaggctccaggggaaggggctggagtgggtctcagcaattaatgggtaggggtgattcaccatattacgcagactccgtgggganccggttnaccatcaccagagacaactccagggancacactatatctacaaatgcacagcctgagagtcgaggacacggccgtgtattatgtgcgagagatccaacgagaccaaccttgtgttcgttgttattgtgtggtacgacggacgaagtacgtcgtacgtctctctacgcnccaccgacggaccacgtcgtccgtcccgtccgccgccgtcgcgccgacgacgcaccgacgacg

SEQ ID NO: 393608 - DNA, 523 bp, Homo sapiens
  misc_feature: GZ8MTXP02IT24J.38.28.C06.1.454.CMB.2.raw
  modified_base (326)..(326): a, c, t, g, unknown or other
  modified_base (350)..(350): a, c, t, g, unknown or other
  modified_base (352)..(352): a, c, t, g, unknown or other
  modified_base (359)..(359): a, c, t, g, unknown or other
  modified_base (361)..(361): a, c, t, g, unknown or other
  modified_base (393)..(393): a, c, t, g, unknown or other
  modified_base (420)..(420): a, c, t, g, unknown or other
  modified_base (423)..(423): a, c, t, g, unknown or other
  modified_base (425)..(425): a, c, t, g, unknown or other
  modified_base (428)..(428): a, c, t, g, unknown or other
  modified_base (455)..(455): a, c, t, g, unknown or other
  modified_base (457)..(457): a, c, t, g, unknown or other
  modified_base (460)..(460): a, c, t, g, unknown or other
tcagtcgatcacgtcacgaccggtgctcgatttagagctcacgtattgggtttgggctgagcgtggcgttttctagtggctattttaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatggtaggggtggattcaccatattacgcagactccgtgggggccgggttcaccaatcaccagagacaacnccagagcacacatatctacaaaananacacacncngagagacgagacgacggcgtgtattattgtgngagagacaccacgtacgacactgtgtnttntnttntgtgcgagagagagtcgacgtctctcncnccnccaccgacgaccgactcgtcctccctccgccgcctcgccgccgacgacgcaccaccgacgacg

SEQ ID NO: 393609 - DNA, 509 bp, Homo sapiens
  misc_feature: GZ8MTXP02F1YSW.38.28.C06.1.454.CMB.2.raw
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtcttgtctccaggggaaagagccaccctctcctgcagggccagtcagagtgttttcaacggctacttagcctggtaccagcaaaacctggccagactcccaggctcctcatctatggtacatccgtcagggccactggtatcccagacaggttcagtgcagtggtctggggacagacttcactctcacatcagcagactggagctgaagtatttgctagtgtattactgtcagcagtatactacaagaccgtacactttggcctaggggaccaagctaggacgaaccaaacgaactgtaggctgacaccatctcg

SEQ ID NO: 393610 - DNA, 635 bp, Homo sapiens
  misc_feature: GZ8MTXP02JPNHM.38.28.C06.1.454.CMB.2.raw
  modified_base (213)..(213): a, c, t, g, unknown or other
  modified_base (267)..(267): a, c, t, g, unknown or other
  modified_base (335)..(335): a, c, t, g, unknown or other
  modified_base (616)..(616): a, c, t, g, unknown or other
tcagtcgatcacgtcacgaccggtgctcgatttagagctcacgtattgggtttgggctgagcgtggcttttctgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccagggaaggggctggagtgggtctcagcaattaatgggtaggggtnatcacatatacgcagacgtccgggtcgggggtccgttcaccatccaccagacgacaactccgaggacncacactatactactaacaaatgacccacacgcctaggagacggtacggagggaccgacgggtccgttagttaatttagttggtcgacgagacgacgtacccgaacgggtacgacccgtaccgttggtcgttcttttagtacttttcgtggttacgggaccgtaaagggtactaacggttcggtacctaccgttcttcgttcgaccgtccctaccgaaccgaacgggccctacgtcccggttcccttccccgtcggcccgtccctcgccgtaccgacggacnccgaccgtaccggacgacg

SEQ ID NO: 393611 - DNA, 522 bp, Homo sapiens
  misc_feature: GZ8MTXP02HWT7X.38.28.C06.1.454.CMB.2.raw
  modified_base (383)..(383): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccagggaaagagccaccctctcctgcagggccagtcagagtgtttcaacggctacttagcctggtaccagcaaaaacctggccaggctcccaggctcctcatctatggtacatccgtcagggccactggtactcccagacaggttcagtggcagtgggtctggggacagacttcgactcncaccatcagcagactggagctgaagtatttgctagtgtattactgtcagcagtatactacaaagaccgtactactttacggccaagggggacccaaaggcgtaggacgaaccaaacgaactgtaggctgacaccatctg

SEQ ID NO: 393612 - DNA, 612 bp, Homo sapiens
  misc_feature: GZ8MTXP02F64N7.38.28.C06.1.454.CMB.2.raw
  modified_base (267)..(267): a, c, t, g, unknown or other
  modified_base (313)..(313): a, c, t, g, unknown or other
  modified_base (318)..(318): a, c, t, g, unknown or other
  modified_base (324)..(324): a, c, t, g, unknown or other
  modified_base (363)..(363): a, c, t, g, unknown or other
  modified_base (386)..(386): a, c, t, g, unknown or other
tcagtcgatcacgtcacgaccggtgctcgatttagagctcacgtattgggtttgggctgagcgtggcttttcttagtggctattttaaaaggtgtccagtgtgaggtgcaggtgtcggagtctgggggaggcttggttcagcctgggggtccctgagactctcctgtgcagtctctggattaacctttagtgactatgccatgatctgggtccgccaggctccagggaaggggctggagtgggtctcagcaattaatggtaggggtnattcacatatacgcagacgtccggtggggccgtcaccatcacaganacacncgagancacactatatactaacaaatgccacacgcagagagacgngacgacgcgtgtattagttgtgngagagacgtaccgaacggtacgaccgtaccgttcggttcgttcgtttgttatttcgttggttcggtacggaacgggaacgtaacgtacggtaccgtaccgttaccgttcttcgtaccgtaccctacccgaacccgaaccggacccgtaccgttccggttcccgttcccccgtcccggtcccgtcccgtccgtccgtccgacggacgaccgacccgtaccgacgacg

SEQ ID NO: 393613 - DNA, 407 bp, Homo sapiens
  misc_feature: GZ8MTXP02F1OXF.38.28.C06.1.454.CMB.2.raw
  modified_base (403)..(407): a, c, t, g, unknown or other
tcagtcgatcacgtcacgaccggtgctcgatttagagctcacgtattgggtttgggctgagctggcttttcttgtggctattttaaagactccgtgggggccggttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaagggcccatcggtcttccccctggccgccctgctccaggagcacctccgagagcacagcggccctgggctgcccctggtcaaggctactccacgtgatcgactgagcgggctggcaaggcgcatagnnnnn

SEQ ID NO: 393614 - DNA, 652 bp, Homo sapiens
  misc_feature: GZ8MTXP02IR7C1.38.28.C06.1.454.CMB.2.raw
  modified_base (268)..(268): a, c, t, g, unknown or other
  modified_base (330)..(330): a, c, t, g, unknown or other
tcagtcgatcacgtcacgaccggtgctcgatttagagctcacgtattgggtttgggctgagcgtggcgtttctagtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatgggtaggggtnatcacatatacgcagacgtcggtcgggggtccgtcaccatcacagacgacaactcgaggacncacactatactactaaacaaagtcgaccacacgacgtagagacggtacggacgggaacgaccggtaccggtagttagtttagtttgtgacgagagacgtaccgaaccggtacgtaccgtaccgttcggttcgttcgtttacgttagtttcgttcggtcggtacggtaacgggtaacgtaacgtacggtaccgtaccgttcgttcttcgtaccgtacccgtacccgaaccgtaaccggtacccgtaccgtccggttcccgttccccgtccggtcccgtcccgtccgtccgtaccgacggacgaccgtacccgtaccgacgacg

SEQ ID NO: 393615 - DNA, 647 bp, Homo sapiens
  misc_feature: GZ8MTXP02HUE3T.38.28.C06.1.454.CMB.2.raw
  modified_base (268)..(268): a, c, t, g, unknown or other
  modified_base (407)..(407): a, c, t, g, unknown or other
tcagtcgatcacgtcacgaccggtgctcgatttagagctcacgtattgggtttgggctgagcgtggcgttttctagtggctattttaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatggtaggggtnatcacatatacgcagacgtcggtgggggccgtcacatcacagagacaactccgaggacgcacactaatatactaacaaatgacccacagcctaggagacggtacggaggacgaccgggtccgttagttaattagtttgnggacgagagacgtaccgtaaccggtacgtaccgtaccgttcggttcgttcgtttgttagtttcgttggttcggtacggtaacgggtaacgtaacgtacggtaccgtaccgttaccgttccttcgtacgtcccgtacccgaacccgtaaccggacccgtaccgtccggttcccgttcccccgtccggtcccgtcccgtccgtccgtcccgaccggaccggaccgacccgtaccgacggacg

SEQ ID NO: 393616 - DNA, 613 bp, Homo sapiens
  misc_feature: GZ8MTXP02F8X3J.38.28.C06.1.454.CMB.2.raw
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctgggagtgggtctcagcaattaatgggtaggggtgattcacatattacgcagactcggtgggggccgttcaccatcaccagagacaactccaggagcacactatatctaacaaaatgccacagcctagagagtcgagggacacggccgtgtattatgtgcgagagactcccgaaaggtcgaacccaccgtttgggttcgttcttttagtacttttcgtggtcggtaccgtaagggactaaggttcggtaccgtaccgttcttccttcgacgtcccctacccgaaccgaacgggcccctacgttcccggttccctttcccccgtcggtcccgtcccgtcgtaacccgtaccgacggacgaccgacccgtaccgacgacg

SEQ ID NO: 393617 - DNA, 533 bp, Homo sapiens
  misc_feature: GZ8MTXP02IP6T2.38.28.C06.1.454.CMB.2.raw
  modified_base (253)..(253): a, c, t, g, unknown or other
  modified_base (301)..(301): a, c, t, g, unknown or other
  modified_base (520)..(520): a, c, t, g, unknown or other
tcagtcgatcacgtcacgaccggtgctcgatttagagctcacgtattgggtttgggctgagctggcttttcttgtggctatttaaaaggtgtccagtgtgaggtgcaggtgtcggagtctggggaggcttggttcagcctgggggtccctgagactctcctgtgcagtctctggattaacctttagtgactatgccatgatctgggtccgccaggctccagggaaggggctggagtgggtctcagcaattaanggtaggggtgattcaccatattacgcagactccggtgggggcccgttnaccatcaccagagacaactccaggagcacactatatctacaaatgccacagcctgagagtcgaggacacggccgtgtattattgtgcgagagatcccaaaggtgacccaccgttggtgtcttttgattttctgttggccaaggggacaagtggtcaccgtctcttcagtcctcaccaagggccccatccggtctcccctggccgccctgcctccaggcncacctccgagacg

SEQ ID NO: 393618 - DNA, 574 bp, Homo sapiens
  misc_feature: GZ8MTXP02JBC8P.38.28.C06.1.454.CMB.2.raw
  modified_base (302)..(302): a, c, t, g, unknown or other
  modified_base (372)..(372): a, c, t, g, unknown or other
  modified_base (474)..(474): a, c, t, g, unknown or other
  modified_base (544)..(544): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttctgtggctatttaaaaggtgtccagtgtgaggtgcaggtgtcggagtctgggggaggcttggttcaggcccgggggtccctgagactctcctgtgcagtctctggattaaccttagtgactatgccatgatctgggtccnccaggctccgagggaaggggctggagtgggtctcagcaattaatggtaggggtgattcaccatattacgngacgacgtcccggtcgggggccggggttccgtaccacgtacaccgaacgaggaacaacctacccacggacggacacaacctataactactaacctaaatacncacacgactcgaggacgtcggaggacgaacggccgtgtattagttgtgcggacgagactccctaaacggngaccgacctgggtctacgtttcgtatttcg

SEQ ID NO: 393619 - DNA, 558 bp, Homo sapiens
  misc_feature: GZ8MTXP02ICVQX.38.28.C06.1.454.CMB.2.raw
  modified_base (213)..(213): a, c, t, g, unknown or other
  modified_base (265)..(265): a, c, t, g, unknown or other
  modified_base (326)..(326): a, c, t, g, unknown or other
  modified_base (331)..(331): a, c, t, g, unknown or other
  modified_base (361)..(361): a, c, t, g, unknown or other
  modified_base (400)..(400): a, c, t, g, unknown or other
  modified_base (412)..(412): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggtccnccaggctcagggaagggctggagtgggtctcagcaaattaatggtaggggtnattcacatatacgcagactccgtggggccgttcacatcaccagagacaactccaggagcanactanatctaacaaaatgccacagcctgagagcgnggacacggccgtgtattatgtgcagagatcccaaaggtnaccaccttggtntctttgattcgtgtcgacgaaaggacaagtgtacaccgtctctcgacgtcctaccaaccgaaccggacccgaccgtaccgttcccgttccccgtccgtcccgtcccgtccgtccgtccgacggacgaccgacccgtaccgacgacg

SEQ ID NO: 393620 - DNA, 561 bp, Homo sapiens
  misc_feature: GZ8MTXP02JRO5L.38.28.C06.1.454.CMB.2.raw
  modified_base (212)..(212): a, c, t, g, unknown or other
  modified_base (290)..(290): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccnccaggctccagggaaggggctggagtgggtctcagcaattaatggtaggggtgattcaccatatacgcagactccggngggggccgttcaccatcaccagagacaactccaggagcacactatatctaacaaatgccacagcctgagagtcgaggacacggtccgtgtattagtgtgcgagagactcccgaacggtgacctaccgttggtgtcttttgatttcgtggtcggaccgaagggacaagtcggtcaccgtcttctcgactcctccacccgaacggacccgactccgtccgttcccccgtccgccgcccgtcgcccgccgacgacgaccgacccgaccgacgcg

SEQ ID NO: 393621 - DNA, 698 bp, Homo sapiens
  misc_feature: GZ8MTXP02G0NUX.38.28.C06.1.454.CMB.2.raw
  modified_base (271)..(271): a, c, t, g, unknown or other
  modified_base (285)..(285): a, c, t, g, unknown or other
  modified_base (307)..(307): a, c, t, g, unknown or other
  modified_base (314)..(314): a, c, t, g, unknown or other
  modified_base (319)..(319): a, c, t, g, unknown or other
  modified_base (326)..(326): a, c, t, g, unknown or other
tcagtcgatcacgtcacgaccggtgctcgatttagagctcacgtattgggtttgggctgagcgtggcgttttctagtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtgggtctcagcaattaatgggtaggggtnattcacatatacgnagacgtcggtggggcctcacancacaganacacncgaggancactactatactactaaacaaagtcgaccacacgacgtacgaggacggtacggacgggaaccggaaccgggtaccggtacgttagtttagtttaggttcggtacggaaggtaaggaacgtacccgtaaaccggtaccgtacccgtaccgttcgggttcgtttcgttttagtttacgtttcgttcggttacggtaccggtaacgggtaacggtaacgttacggtaccgtacccgttaccgttccttaccgtaccgtacccgtacccgtaacccgtaaccggtacccgtaccgttcccggttcccgttcccccgtcccggtcccgtcccgtccgtccgtcccgaccggaccgacccgtacccgtaccgacgacg

SEQ ID NO: 393622 - DNA, 523 bp, Homo sapiens
  misc_feature: GZ8MTXP02IDDG7.38.28.C06.1.454.CMB.2.raw
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccaccctctcctgcagggccagtcagagtgttttcaacggctacttagcctggtaccagacaaaacctggccaggctcccaggctcctcatctatggtacatccgtcagggccactggtactcccagacaggttcagtggcagtgggtctggggacagacttcactctcaccatcagcagactggagctgaagatttgcagtgttatactgtcagttcagtatactacaacgtaccgtactaacttttcggacctagggggaccaaagccgtaggacgaaccaaacgactgtggactgcaccatctg

SEQ ID NO: 393623 - DNA, 523 bp, Homo sapiens
  misc_feature: GZ8MTXP02ILY53.38.28.C06.1.454.CMB.2.raw
  modified_base (214)..(214): a, c, t, g, unknown or other
  modified_base (442)..(442): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctgcagggccagtcagagtgtttcaacggctacttagcctggtaccagcaaaacctggccaggctccaggctcctcatctatggtacatccgtcagggccactggtatccccagacaggttcagtggcagtggtctggggacaggacttcactctcaccatcagcagactggagctagaagtatttgctagtgtattactgtcagcagtatactanaaagaccgtactactttggcctaggggaccaagcgtacggacgaaccgaaacgaacgtgtacggctggacaccgatctacg

SEQ ID NO: 393624 - DNA, 505 bp, Homo sapiens
  misc_feature: GZ8MTXP02IU33M.38.28.C06.1.454.CMB.2.raw
  modified_base (436)..(436): a, c, t, g, unknown or other
tcagtcgatcacgtcacgaccggtgctcgatttagagctcacgtattgggtttgggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccagggaagagccaccctctcctgcagggccagtcagagtgtttcaacggctacttagcctggtaccagcaaaacctggccaggctcccaggctcctcatctatggtacatccgtcagggccactggtatccccagacaggttcagtgcagtggtctggggacaggacttcactctcaccatcagcagactggagctgaagatttgcagtgtattactgtcagcagtatactanaaagtaccgtacactttggccaggggaccaagctggagaaccaaacgaactgtaggctgacaccatctg

SEQ ID NO: 393625 - DNA, 562 bp, Homo sapiens
  misc_feature: GZ8MTXP02GDESE.38.28.C06.1.454.CMB.2.raw
  modified_base (158)..(158): a, c, t, g, unknown or other
  modified_base (317)..(317): a, c, t, g, unknown or other
  modified_base (319)..(319): a, c, t, g, unknown or other
  modified_base (321)..(321): a, c, t, g, unknown or other
  modified_base (323)..(323): a, c, t, g, unknown or other
  modified_base (327)..(327): a, c, t, g, unknown or other
  modified_base (330)..(330): a, c, t, g, unknown or other
  modified_base (332)..(332): a, c, t, g, unknown or other
  modified_base (443)..(443): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgngtttctaggtggctatttaaaaggtgtccagtgtgaggtgcaggtgtcggagtctgggggaggcttggttcagcccggggggtcctgagactctcctgtgcagtctctggattaaccttagttgatatgccatgatctggtcgcagctccaggaggggngngngnggtncananatagtggtagggtgtatcacatattacgcgagacgtcgggtcgggggtccggtcgaccacacaccgacgacgaacaactaccgacgacgacacactatactactaacaaanacgacacacgacgtagagaggtacggacggacgacggacgtagtacgttagttgtcgacgacgacgacgtaccgacggtaacgtaccgtacgttcggttgttcgtttcgttacgtttcg

SEQ ID NO: 393626 - DNA, 569 bp, Homo sapiens
  misc_feature: GZ8MTXP02H4ACA.38.28.C06.1.454.CMB.2.raw
  modified_base (211)..(211): a, c, t, g, unknown or other
  modified_base (262)..(262): a, c, t, g, unknown or other
  modified_base (285)..(285): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (337)..(337): a, c, t, g, unknown or other
tcagtcgatcacgtcacgaccggtgctcgatttagagctcacgtattgggtttggctgagcgtggcttttctgtggctattttaaaaggtgtccagtgtgaggtgcaggtgtcggagtctgggggaggcttggttcagcctggggggtccctgagactctcctgtgcagtctctggattaacctttagtgactatgccatgatctggtccnccaggctcagggaagggctggagtgggtctcagcaattaatggtaggggtnactcacatatacgcagcgtcggnggggcctcacatcacagacacacncgagancanactatatactaacaagtanaccacacgcgtagagagacgacgacgacgcgtagtattagttgtgacgagagacgtaccgacgacgacgtacgttcggttcgttcgtttgttagttcgttgtcggtacgtaacggacgtacgtacgtcgtaccgtcttctctacgcctaccaccgacgaccgacgtccgtcccgttcccgtccgtccgtcccgtccgtccgtccgacggacgaccgacccgtaccgacgacg

SEQ ID NO: 393627 - DNA, 592 bp, Homo sapiens
  misc_feature: GZ8MTXP02GJL0L.38.28.C06.1.454.CMB.2.raw
  modified_base (214)..(214): a, c, t, g, unknown or other
  modified_base (270)..(270): a, c, t, g, unknown or other
  modified_base (331)..(331): a, c, t, g, unknown or other
  modified_base (413)..(413): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaaggggctggagtgggtctcagcaattaatgggtaggggtnattcaccatattacgcagactcggtggggccgttcaccatcaccagagacaactccaggancacactatatctaacaaatgacccacagcctgagagtcgaggacacggccgtgtattattgtgcgagagatcccgaaaggtnacctaccgttggtcgtcttttgatttcgtggttgaccgaagggacaagtggtaccaccgtctcttcagtccctaccaccgaacgggcccaagttcccggtcccttcccccgcgggtccccgtccccgttgccccgttccgaacggggtaccacccgtaccccgtccggaacgaacccgg

SEQ ID NO: 393628 - DNA, 581 bp, Homo sapiens
  misc_feature: GZ8MTXP02GH85F.38.28.C06.1.454.CMB.2.raw
  modified_base (331)..(331): a, c, t, g, unknown or other
  modified_base (432)..(432): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccgccaggctccaggggaaggggctgggagtgggtctcagcaattaatggtaggggtgattcaccatattacgcagactccggtgggggccgttcaccatcaccagagacaactccaggancacactatatctacaaatgccacagcctagagagtcgaggacacgggccgtagtattattgtgcgagagactaccccgaaaggtgaacccaccgtttgggngtcctttttgacttttcgtggtcggacccgaaaggggacaaagttgggtacccaccgttcttcttcacgtccctccaaccgaacgggccccagttccggtcccttcccccggcgcctccctgcctccgacggacaccaccgcgacgacg

SEQ ID NO: 393629 - DNA, 612 bp, Homo sapiens
  misc_feature: GZ8MTXP02GD3UD.38.28.C06.1.454.CMB.2.raw
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaatggtaggggtgattcacatattacgcagactccggtgggggccgttcaccatcaccagagacaactccaggagcacactatatctacaaatgccacagcctgagagtcgagggacacgggccgtgtattattgtgcgagagactacccgaaggtgacccacctttgggtcgtcttttagattttccgtggtggacccaaaggggactaaagtcggtaccaccgtcttccttcacgtccctaccgaacccgaaacggggccccctaagttcccgggtaccttcccccccgtggggccccgtccccgttacggcccttacccgagggtaaccgccctaacccgtcccgacgaaccgg

SEQ ID NO: 393630 - DNA, 576 bp, Homo sapiens
  misc_feature: GZ8MTXP02H4TV6.38.28.C06.1.454.CMB.2.raw
  modified_base (215)..(215): a, c, t, g, unknown or other
  modified_base (328)..(328): a, c, t, g, unknown or other
  modified_base (337)..(337): a, c, t, g, unknown or other
tcagtcgatcacgtcacgaccggtgctcgatttagagctcacgtattgggtttggctgagcgtgtcgttttctagtggctattttaaaaggtgtccagtgtgaggtgcaggtgtcggagtctgggggaggcttggttcagcctggggggtccctgagactctcctgtgcagtctctggatttaacctttagtgactatgccatgatctgggtccncaggctcaggggaagggctggagtgggtctcagcaattaatgggtaggggtgattcaccatatacgcagactcggtgggggccgttcacatcaaccagagacaactccaggancactactanatactaacaaatgccacagcctgagagtcgaggacacggccgtgtattagtgtagcgagagtactcccgaaggcgacctaccgtttggtcgtctttttgatttctggtggaccgaaaggggacaagttcgggactaccgtcttctcacgtcctccaccgacggaccgacgtccggtccttccccgttccgtccggtccccgtccgtccgtccgacgacgaccgacccgtaccgacgacg

SEQ ID NO: 393631 - DNA, 530 bp, Homo sapiens
  misc_feature: GZ8MTXP02FPZ0M.38.28.C06.1.454.CMB.2.raw
  modified_base (477)..(477): a, c, t, g, unknown or other
  modified_base (480)..(480): a, c, t, g, unknown or other
  modified_base (489)..(489): a, c, t, g, unknown or other
  modified_base (509)..(509): a, c, t, g, unknown or other
  modified_base (511)..(511): a, c, t, g, unknown or other
  modified_base (519)..(519): a, c, t, g, unknown or other
  modified_base (523)..(523): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtgggtctcagcaaattaatgggtaggggtgattcaccatattacgcagactccggtgggggccgttcaccatcaccagagacaactccaggagcacactatatctacaaatgccacagcctgagagtcgagggacacgggccgtgtaattattgtgcgagagatcccgaaaggtgacccaccttggtgtcttttgatttctgtggccaaagggacaagtggtcacgtctcttcacnccncacgacgcnctcgtcctcccgtcgcgccncncgcacgcncacncgacgcg

SEQ ID NO: 393632 - DNA, 638 bp, Homo sapiens
  misc_feature: GZ8MTXP02GCJEZ.38.28.C06.1.454.CMB.2.raw
  modified_base (279)..(279): a, c, t, g, unknown or other
  modified_base (432)..(432): a, c, t, g, unknown or other
  modified_base (628)..(628): a, c, t, g, unknown or other
  modified_base (630)..(630): a, c, t, g, unknown or other
  modified_base (632)..(632): a, c, t, g, unknown or other
  modified_base (634)..(638): a, c, t, g, unknown or other
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggcttttctgtggctattttaaagactccgtgggggccgttcaccatcaccagagacaactccaggagcacactatatctacaaatgcacagcctgagagtcgaggacacggccgtgtattattggngacgagagactacccgaacggtcgaccctacgttggtcgtcttttagacttttcgtggtcggaccgaaaggggactaagtcggtacctaccgttccttccttacacgtcccctaccgaaccgaacgggcccctagtccggtcccttcccccgnggaccctccctgcctacccgacggacgaccacccgtaccgacgacgacacgacggcccggtcccgtcgggtccgtcggtcccgttacgggtaccgtaaacgggtaacccttaacccgttacccgaacggtacgaacgtaccggaacgtacggacgggtccggggtcgtacggacggaacggacggacgacgtagangncncnnnnn

SEQ ID NO: 393633 - DNA, 543 bp, Homo sapiens
  misc_feature: GZ8MTXP02I1RDZ.38.28.C06.1.454.CMB.2.raw
  modified_base (410)..(410): a, c, t, g, unknown or other
  modified_base (422)..(422): a, c, t, g, unknown or other
  modified_base (431)..(431): a, c, t, g, unknown or other
  modified_base (445)..(445): a, c, t, g, unknown or other
  modified_base (454)..(454): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgcgttttctaggtggctatttaaaggtgtccagtgtgaggtgcaggtgtcggagtctgggggaggcttggttcaggcccgggggtcctgagactctcctgtgcagtctctggattaaccttagtgactatgccatgatctgggtccgccaggctccgaggggaaggggctggagtgggtctcgagcaattaatggtaggggtgattcacatattacgcagactccggtgggggccgttcaccgatcaccagganacaactccgagngcacactanatactacaaagtanacacacacngagagagacgacgacgcgtagtacttagttgtgagacgacgacgtaccgacgtaacgaccgtacgttcgtgtcgtttcgttacgtttcg

SEQ ID NO: 393634 - DNA, 553 bp, Homo sapiens
  misc_feature: GZ8MTXP02HT39T.38.28.C06.1.454.CMB.2.raw
  modified_base (282)..(282): a, c, t, g, unknown or other
  modified_base (304)..(304): a, c, t, g, unknown or other
  modified_base (363)..(363): a, c, t, g, unknown or other
  modified_base (408)..(408): a, c, t, g, unknown or other
  modified_base (417)..(417): a, c, t, g, unknown or other
  modified_base (422)..(422): a, c, t, g, unknown or other
  modified_base (430)..(430): a, c, t, g, unknown or other
  modified_base (448)..(448): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctattttaaaaggtgtccagtgtgaggtgcaggtgtcggagtcgtgggggagcttggttcaggcccggggggtcctgagactctcctgtgcagtctctggattaaccttagngactatgccatgatctggtccnccaggctccgaggggaagggctgggagtgggtctacagcaaattaagtggtaaggggtntatcactatactacgcagacgtccggggtcgggggtccgtcacanccaacaganacacncgaggacncactactatactactaanaaatcgacacacgacacgagagacgacggacgacgacgtagtacttagttgtgagagacgacgaccgacgtaacgacgtacgtcgtcgttcgtttcgttagttcg

SEQ ID NO: 393635 - DNA, 561 bp, Homo sapiens
  misc_feature: GZ8MTXP02H8753.38.28.C06.1.454.CMB.2.raw
  modified_base (335)..(335): a, c, t, g, unknown or other
  modified_base (345)..(345): a, c, t, g, unknown or other
  modified_base (358)..(358): a, c, t, g, unknown or other
  modified_base (385)..(385): a, c, t, g, unknown or other
  modified_base (459)..(459): a, c, t, g, unknown or other
tcagtcgatcacgtcacgaccggtgctcgatttagagctcacgtattgggtttggggaggcttggttcagcctggggggtccctgagactctcctgtgcagtctctggatttaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatatcaacaaatgacacagcctgagagtcgagacacggctgattatgtgcgagagatcccaaacggtnaccacttggntcttttgatttcngtggccaaagggacaagtgtcaccgtntctcagcctccaccaacgggccctagtccggtccttcccccgtgggccgccctcggtccctccgaacgggaccnccaccgtccgagacgcaacgcggccggcccgtcgggctcgccgtggtacaacggtacctacgtccgtacgtagaacgtcgacgtggacggcggcgtcggacg

SEQ ID NO: 393636 - DNA, 519 bp, Homo sapiens
  misc_feature: GZ8MTXP02F6D7D.38.28.C06.1.454.CMB.2.raw
  modified_base (393)..(393): a, c, t, g, unknown or other
  modified_base (431)..(431): a, c, t, g, unknown or other
  modified_base (434)..(434): a, c, t, g, unknown or other
  modified_base (464)..(464): a, c, t, g, unknown or other
  modified_base (466)..(466): a, c, t, g, unknown or other
  modified_base (468)..(468): a, c, t, g, unknown or other
  modified_base (497)..(497): a, c, t, g, unknown or other
  modified_base (510)..(510): a, c, t, g, unknown or other
  modified_base (512)..(512): a, c, t, g, unknown or other
tcagtcgatcacgtcacgaccggtgctcgatttagagctcacgtattgggtttgggctgagcgtggcgttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtaggggtgattcaccatattacgcagactccgtgggggccgttcaccatcaccagagacaactccaggagcacactatatctacaaatgcacagctgagagtcgaggacgacggaccgtgtattattgtgngagagacaccgacgtacgactaccgtcgtgtcgttgtnttntgtgacgagacgagtagtcgacgtctctcncncncacgacgccgctcgtcctccgtcgcgccncgcgcgacgcgcncncgacgcg

SEQ ID NO: 393637 - DNA, 556 bp, Homo sapiens
  misc_feature: GZ8MTXP02JII7F.38.28.C06.1.454.CMB.2.raw
  modified_base (392)..(392): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtgattcaccatatacgcagactccggtgggggccgttcaccatcaccagagacaactccaggagcacactatatctaacaaatgcccacagcctagagagtcgaggacacggccgtgtattatgngcgagagactcccgaaggtgaccaccgttggtgtctttgatttcgtgtggacctaaaggggactaagtggccaccgtctcttcacgcctccgaaccgaacgggcccagtcccgtccttcccccgtggcccgccctgaacctccgaggcgccaccgtccgagacg

SEQ ID NO: 393638 - DNA, 550 bp, Homo sapiens
  misc_feature: GZ8MTXP02HAHJV.38.28.C06.1.454.CMB.2.raw
  modified_base (305)..(305): a, c, t, g, unknown or other
  modified_base (324)..(324): a, c, t, g, unknown or other
  modified_base (326)..(326): a, c, t, g, unknown or other
  modified_base (329)..(329): a, c, t, g, unknown or other
  modified_base (335)..(336): a, c, t, g, unknown or other
  modified_base (446)..(446): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcttttctgtggctattttaaaaggtgtccagtgtgaggtgcaggtgtcggagtctgggggaggcttggttcaggcccggggggtccctgagactctcctgtgcagtctctggattaaccttagtgactatgccatgatctgggtccncaggcctcgagggacgggngnggnggtgtnngatagtagtaggtaggtgtatacactatatacgcgacgacgtcgggtcggggtccggtacgacacacacgacgacgacacacgacgacgacacactatactactaacaanacacacacgacgagagagacgacgacgacgtacgtagtacgttagtgtcgagacgacgacgtaccgacgtaacgacgtacgtcgtcgttcgttcgttacgttcg

SEQ ID NO: 393639 - DNA, 537 bp, Homo sapiens
  misc_feature: GZ8MTXP02JQZPH.38.28.C06.1.454.CMB.2.raw
  modified_base (363)..(363): a, c, t, g, unknown or other
tcagtcgatcacgtcacgaccggtgctcgatttagagctcacgtattgggtttggggaggcttggttcagcctgggggtccctgagactctcctgtgcagtctctggattaacctttagtgactatgccatgatctgggtccgccaggctccagggaagggctggagtgggtctcagcaattaatggtagggtgattcaccatattacgcagactccggtgggggccgttcaccatcaccagagacaactccaggagcacactatatctacaaatgcacagcctgagagtcgaggacacggccgtgtattatgtgcgagagatccccaaacggtgaccacctttggtgtctttttgattttcnggtggccaaaggggcaagtggtcaccgtctcttcacgccctccaccgaacgggccccatccggtccttcccccgtggccgccctgcctccaggacgcacatccgagacgcacgagccggccctgggctgcctggcaacggactacctcacgtgactcgactgacgcgggctcgg

SEQ ID NO: 393640 - DNA, 555 bp, Homo sapiens
  misc_feature: GZ8MTXP02ISTBQ.38.28.C06.1.454.CMB.2.raw
  modified_base (435)..(435): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctatttaaaaggtgtccagtgtgaggtgcaggtgtcggagtctgggggaggcttggttcaggcccggggggtccctgagactctcctgtgcagtctctggattaaccttagtgactatgccatgatcgtgggtccgccaggctccgagggaaggggctgggagtgggtctcagctaattaagtggtaggggtgattcgaccatacttacgcagactccgggtcgggggcccgttcaccatccaccagagaacaactcccgaggacncaacactatatctaaacaatgcacagacctgagaggtcgaaggacacgggccgtgttattagtgtcgacgagacgactcccgaaggtcgaaccctcgttcggtgtacttttgacttttcg

SEQ ID NO: 393641 - DNA, 658 bp, Homo sapiens
  misc_feature: GZ8MTXP02FTZD2.38.28.C06.1.454.CMB.2.raw
  modified_base (271)..(271): a, c, t, g, unknown or other
  modified_base (329)..(329): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtaggggtnatcacatatacgcagcgtccggtgggggccgtcaccatcaccagacacactcaggacncacactatatactaacaaatcgacccacacgcctaggaagacggtacggacgggaaccgaccggggtccgtttagttaatttagttggtacgacggaagacgacgtaccccgaaagggtccgaccctaccgtttgggttcgttcgttttagtacttttcgtggtacgggaccgtaaaggggtactaacggtcggtaccctaccgttctccttcgacgtccctaccgaacccgaacgggtccctacggttcccggttccccttcccccggtcggccccgtcccgtcgaacccgtccggacgggtaccgaccctaccgtccggaacgaccg

SEQ ID NO: 393642 - DNA, 691 bp, Homo sapiens
  misc_feature: GZ8MTXP02JO1WU.38.28.C06.1.454.CMB.2.raw
  modified_base (269)..(269): a, c, t, g, unknown or other
tcagtcgatcacgtcacgaccggtgctcgatttagagctcacgtattgggtttgggctgagcgtggcgttttctagtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatgggtaggggtnattcacatatacgcagacgtcgggtgggggccgttcaccatccaccgagacgacaactccgaggacacactactatatactaacaaagtgaccacacgacctagaggacggtacggacggaaccgaccgggtaccggttacgttagtttagtttagttggtacggagaagacgtacccgtaaccggtacgtacccgtaccgttcggttcgttcgtttacgttacgtttcgttcggttacgggtacggtaaacgggtaacgtaacgtacggtaccgtacccgttaccgttccttccgtaccgtacccgtacccgtaacccgtaaccgggacccgtaccgttacccggttccccgttcccccgttcccggtcccgtccccgtccgtcccgtccgaccggacgaccgtacccgtacccgacgacg

SEQ ID NO: 393643 - DNA, 549 bp, Homo sapiens
  misc_feature: GZ8MTXP02GGK50.38.28.C06.1.454.CMB.2.raw
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctgggagtgggtctcagcaattaatggtaggggtgattcaccatattacgcagactccgtgggggccgttcacatcaccagagacaactccaggagcacactatatctacaaatgcacagcctgagagtcgaggacacggccgtgtattatgtgcgagagatcccaacggtgaccaccttggtgtcctttttgattttcgtgttgggccaaggggacaagtgggtccacgtctcttcagccctccaccaagggcccatccggtccttcccccgtggccgccctcgcctcccgaggacgccaccctccgagacgcacgacgccggcccgtggggctcgcctggtcaaggactacttccacgtgaatcgactcgaggcggctggacg

SEQ ID NO: 393644 - DNA, 542 bp, Homo sapiens
  misc_feature: GZ8MTXP02FWPRF.38.28.C06.1.454.CMB.2.raw
  modified_base (341)..(341): a, c, t, g, unknown or other
  modified_base (419)..(419): a, c, t, g, unknown or other
  modified_base (445)..(445): a, c, t, g, unknown or other
  modified_base (447)..(447): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgcgttttctaggtggctaattttaaaaggtgtccagtgtgaggtgcaggtgtcggagtctgggggaggcttgggttcagcccgggggtcctgagactctcctgtgcagtctctggattaaccttagtgactatgccatgatctgggtccgccaggctccgaggggaaggggctggagtgggtctnagcaataaatggtagggtgatcaccatattaacgcagactccgtgggggccgggttcgaccacacaccagagacaacnccagagcacactatatactacaaaananacacacgacagagagacgacgacgacgcgtagtattagtgtgacgagacgacgtaccgacgtaacgacgtacgtcgtgtcgtttcgttagtttcg

SEQ ID NO: 393645 - DNA, 534 bp, Homo sapiens
  misc_feature: GZ8MTXP02G2611.38.28.C06.1.454.CMB.2.raw
  modified_base (404)..(404): a, c, t, g, unknown or other
  modified_base (420)..(420): a, c, t, g, unknown or other
  modified_base (426)..(426): a, c, t, g, unknown or other
  modified_base (490)..(490): a, c, t, g, unknown or other
  modified_base (509)..(509): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttctgtggctattttaaaaggtgtccagtgtgaggtgcaggtgtcggagtctgggggaggcttggttcaggcccggggggtccctgagactctcctgtgcagtctctggattaaccttagtgactatgccatgatctgggtccgccaggcctccgaggggaaggggctgggagtgggtctcagcaattaagtgggtaggggtgattcgacatattacgcagactccggtgggggccgttcaccngtccacagagacaacnccgagngcacactatatactacaaatgcacagacctagagagtcgaggacacggcgtagtattagtgtgngagacgactcccaacggtnaccacgttggtctctttgactttcg

SEQ ID NO: 393646 - DNA, 630 bp, Homo sapiens
  misc_feature: GZ8MTXP02HBBR9.38.28.C06.1.454.CMB.2.raw
  modified_base (381)..(381): a, c, t, g, unknown or other
  modified_base (448)..(448): a, c, t, g, unknown or other
  modified_base (456)..(456): a, c, t, g, unknown or other
  modified_base (474)..(474): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctattttaaaaggtgtccagtgtgaggtgcaggtgtcggagtcgtgggggaggcttggttcgacggcccggggggtccctggagactctcctgtgcagtctctggattaaccttagtgactatgccatgatcgtcgggtccgccagggcctccggaggggaacggggctgggaggtgggtctcgagactaaagttaagtggggtaggggtntattcaacctattacttacgcacgaccgtccggggtgggggcccgttcaccgatccacagacacacnccgagacncaacactatactaccaanaaatcgacacagcctaggagacgtacgaggaccacgggtccgttaggttaaatttgttggacggacgaaacggtagaacccttacccggaaaacggggttcaaaaccccgttaccgttttcggggttacgttttaccgttttacgttacttttcgg

SEQ ID NO: 393647 - DNA, 560 bp, Homo sapiens
  misc_feature: GZ8MTXP02G7FBW.38.28.C06.1.454.CMB.2.raw
  modified_base (266)..(266): a, c, t, g, unknown or other
  modified_base (477)..(477): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatggtaggggtnattcacatattacgcagactccgtgggggccgttcaccatcaccagagacaactccaggagcacactatatctacaaatgaccacagcctgagagtcgaggacacggccgtgtattatgtgcgagagatccccgaaaggtgaccctaccgttggtgtcttttgattttcgtgtcggccaaaggggacaaagtggtccaccgtctcttaccncgcctccaaccgaacggccctagtccggtccttccccgtcggcccgccctacgcctaccggacggacgaccaccgtccgagcg

SEQ ID NO: 393648 - DNA, 586 bp, Homo sapiens
  misc_feature: GZ8MTXP02I9WQ3.38.28.C06.1.454.CMB.2.raw
  modified_base (282)..(282): a, c, t, g, unknown or other
  modified_base (441)..(441): a, c, t, g, unknown or other
  modified_base (463)..(463): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcttttctgtggctattttaaaaggtgtccagtgtgaggtgcaggtgtcggagtctgggggaggcttggttcaggcccggggggtcctgagactctcctgtgcagtctctggattaacctttagngactatgccatgatcgtgggtcccgcaggctccgaggggaaggggctggaggtgggtctcagctaattaagtgggtacggggtgtattcaacctattattacgcgagacgtccggggtgggggccgttcaccgactcaccagacgacaactccgaggcncaacactatattacaactaaancacacacgcgtagagacgacggacggacgacggtcgttagttacttagtgtcggacgaagacgtaccgaacccgtacggaacgtaacccgtcggtttcggtcgtttcgttttagtacgtttcg

SEQ ID NO: 393649 - DNA, 620 bp, Homo sapiens
  misc_feature: GZ8MTXP02HNNUV.38.28.C06.1.454.CMB.2.raw
  modified_base (183)..(183): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgtttctaggtggctatttaaaggngtccagtgtgaggtgcaggtgtcggagtcgtgggggagcttggttcaggcccgggggtcctgagctctcctgtgcagtctcgtgtattacttagtgactatcgcatgtagtcgtcggtccgcgacgcgacggagggagggcggtggaggtggtcgtcgagacgtaagttaaggtagggtacgggtagtacgtactactatacgttacgtcgacgtacggtccggggtccgggggtccgggtaccgaccgtactaccaccgacgaacgaacgaacgtaccgacgacgacacactactactactaactaaatacgacacgacgacgagagacggacggacggacggacggtacgtagttacgttagttgtacgtacgacgacgacgtaccgacgtaacgtaccgtaccgttcggttcgttcgtttacgtttacgtttcg

SEQ ID NO: 393650 - DNA, 532 bp, Homo sapiens
  misc_feature: GZ8MTXP02JUIMD.38.28.C06.1.454.CMB.2.raw
  modified_base (154)..(154): a, c, t, g, unknown or other
  modified_base (209)..(209): a, c, t, g, unknown or other
  modified_base (252)..(252): a, c, t, g, unknown or other
  modified_base (261)..(261): a, c, t, g, unknown or other
  modified_base (264)..(264): a, c, t, g, unknown or other
  modified_base (276)..(276): a, c, t, g, unknown or other
  modified_base (280)..(281): a, c, t, g, unknown or other
  modified_base (298)..(298): a, c, t, g, unknown or other
  modified_base (301)..(301): a, c, t, g, unknown or other
  modified_base (304)..(304): a, c, t, g, unknown or other
  modified_base (317)..(317): a, c, t, g, unknown or other
  modified_base (443)..(443): a, c, t, g, unknown or other
  modified_base (452)..(452): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttggctgagcngcttttctgtggctattttaaaaggtgtccagtgtgaggtgcaggtgtcgagtcngggggaggcttggttcagcccgggggtccctgagactctcctntgcagctcnggnttaaccttagtnactnncatgatcgtggtccgcngcncgngggagggcgtggnggtgggtcgtcagactattaagtgggtaggggtgtatcacatattacgcacgacgtccgggtcgggggtccggtcaccactacaccagacgacacaccgagagacacacatactactaacaaatanacacacgcngagagtcgacgacgacggcgtgtattattgtgcgagacgacaccgacgtaacgacctacgttcgtgtctttcgttattcg

SEQ ID NO: 393651 - DNA, 589 bp, Homo sapiens
  misc_feature: GZ8MTXP02F6T5S.38.28.C06.1.454.CMB.2.raw
  modified_base (270)..(270): a, c, t, g, unknown or other
  modified_base (306)..(306): a, c, t, g, unknown or other
  modified_base (313)..(313): a, c, t, g, unknown or other
  modified_base (318)..(318): a, c, t, g, unknown or other
  modified_base (324)..(324): a, c, t, g, unknown or other
  modified_base (397)..(397): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtnatcacatatacgcagcgtccggtggggccgtcacancacaganacacncgagancacactatatactaacaaatcgaccacacgcctaggagacggtcgaggaccacgggtccgttagtattagtgngacgagagactacccgaacggtcgacctacgttggtcttctttagtatttcgtggtacggacgaaggactaagtcgtacctaccgttctctcacgtccctaccgaaccgaacggccctacggttcccgttcccttccccgtcggcccgtcccgtcgcccgtaccggacggaccgaccacccgtcgaacgacg

SEQ ID NO: 393652 - DNA, 571 bp, Homo sapiens
  misc_feature: GZ8MTXP02IYJ8R.38.28.C06.1.454.CMB.2.raw
  modified_base (266)..(266): a, c, t, g, unknown or other
  modified_base (315)..(315): a, c, t, g, unknown or other
  modified_base (326)..(326): a, c, t, g, unknown or other
  modified_base (535)..(535): a, c, t, g, unknown or other
  modified_base (541)..(541): a, c, t, g, unknown or other
  modified_base (559)..(559): a, c, t, g, unknown or other
  modified_base (569)..(569): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctggagtgggtctcagcaattagtggtaggggtnattcaccatatacgcagactccggtgggggccgttcaccatcaccaganacactcaggancaacactatatactaacaaatcgaccacacgctagagagtcgaggacacgggtccgtagttattatggtgacgagagacacccgaaggtcgaacctaccgttgtagttcgtttgatttcgtggtacggaccgaaagggtacaagtcggtaccacgttcctcttcacgccctaccaccgaacggccctacgttccggccctttcccccgnggcccnccctagcctccaggaccnccaccgcgancg

SEQ ID NO: 393653 - DNA, 623 bp, Homo sapiens
  misc_feature: GZ8MTXP02I9QPL.38.28.C06.1.454.CMB.2.raw
  modified_base (302)..(302): a, c, t, g, unknown or other
  modified_base (329)..(329): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatgggtaggggtgattcacatatacgcagactccgtgggggccgttnaccatcaccagagacaactccaggacncacactatatactaacaaatcgaccacacgtcctagagagtacgacgggaccgacgggtccgtagtattagttgtgacgagacgactacccgaaggtcgaccctcgttggtcgttcgttttagtactttcgttgtcggtacggtaacggtaacgtaacgtacggtacgtaccgtacgttcttcgtacgtaccgtacccgtacccgaaccggtacccgtaccgtccggttcccgttccccgtccggtcccgtcccgtccgtccgtccgacggacgaccgacccgtaccgacgacg

SEQ ID NO: 393654 - DNA, 557 bp, Homo sapiens
  misc_feature: GZ8MTXP02GTJEF.38.28.C06.1.454.CMB.2.raw
  modified_base (268)..(268): a, c, t, g, unknown or other
  modified_base (324)..(324): a, c, t, g, unknown or other
  modified_base (359)..(359): a, c, t, g, unknown or other
  modified_base (381)..(381): a, c, t, g, unknown or other
  modified_base (401)..(401): a, c, t, g, unknown or other
  modified_base (415)..(415): a, c, t, g, unknown or other
  modified_base (512)..(512): a, c, t, g, unknown or other
  modified_base (539)..(539): a, c, t, g, unknown or other
tcagtcgatcacgtcacgaccggtgctcgatttagagctcacgtattgggtttgggttgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaagggctgggagtgggtctcagcaattaatggtaggggtnattcacatatacgcagactcggtgggggccgtcacatcacagagacaactcaggancacactatatactaacaaatgacacagcctagagngtcgagcacggctgtattatgngcgagagactcccgaaggtnaccctacgttggtntcttttgattttcgtgtcggaccgaaaggggacaagtgggtaccaccgttctcttcacgtccctaccacgaacggcccagtccggtcccttccccgnggcccgtccctgacctccgacggaccnccacccgtcgacgacgcc

SEQ ID NO: 393655 - DNA, 616 bp, Homo sapiens
  misc_feature: GZ8MTXP02GNWB2.38.28.C06.1.454.CMB.2.raw
  modified_base (380)..(380): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgttttctaggtggctattttaaaggtgtccagtgtgaggtgcaggtgtcggagtctgggggaggcttggttcgaggcccggggggtccctggagactctcctgtgcagtctctggattaaccttagtgactatgccatgatcgtgggtccgccagggcctccgaaggggaaggggctgggagtggggtctcgaggactaaagttaaagtgggtaaggggtntactcaacctattacttacgcgtacgaccggttccggggtcgggggtcccgttacacctatacccaaccgaagaacgaacctaaccgtaccgaaggacgactaactaacttactactacgtaaacaaatcgacacacgacgagagagtacggacggacgacggacgtagttacttagttgtcgagacgacgacgaccgacgtaacgacgtacgtcgtcgttcgtttcgttacttcg

SEQ ID NO: 393656 - DNA, 587 bp, Homo sapiens
  misc_feature: GZ8MTXP02JUWKB.38.28.C06.1.454.CMB.2.raw
  modified_base (213)..(213): a, c, t, g, unknown or other
  modified_base (395)..(395): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccnccaggctccagggaaggggctggagtgggtctcagcaattaatgggtaggggtgattcaccatattacgcagactccggtgggggccgttcaccatcaccagagacaactccaggagcaacactatatctaacaaatgccacagcctagagagtcgagggacacgggcctgtattatttggngacgagagacgtaccgacgtacgacgtaccgtcgtgtcgtttgttagttcgttgtcggtacgaacggaacgtaacgtacgtcgtaccgtactctctacgtacctaccgaccgaccggaccgaccgtccgttcccgttcccgtccgtcccgtcccgtccgtccgtccgacgacgaccgaccgtaccgacgacg

SEQ ID NO: 393657 - DNA, 550 bp, Homo sapiens
  misc_feature: GZ8MTXP02JFYO5.38.28.C06.1.454.CMB.2.raw
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccaccctctcctgcagggccagtcagagtgtttcaacggctacttagcctggtaccagcaaaacctggccaggctcccaggctcctcatctatggtacatccgtcagggccactggtactcccagacaggtcagtgcaggtggtctggggacaggacttcactctcaccatcagcagactggagctagaagtatttgctagtgttattactgtcagcagtatactacaagaccgtactacgtttggaccgaagggggtaccaaacggctacgggaacgaaacccgaaaacggtaacgtaaggtacggactacggaccaccgtactacgtttcgg

SEQ ID NO: 393658 - DNA, 610 bp, Homo sapiens
  misc_feature: GZ8MTXP02IFEJD.38.28.C06.1.454.CMB.2.raw
  modified_base (304)..(304): a, c, t, g, unknown or other
  modified_base (557)..(557): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttctgtggctattttaaaaggtgtccagtgtgaggtgcaggtgtcggagtctgggggagcttggttcaggccccggggggtcctgagactctcctgtgcagtctctggattaaccttagtgactatgccatgatcgtcggtccncaggctccgaggggaagggcgtgggaggtgggtctacgaggtactaaagtttaaaggtggggtacggggtagtactttaccaacctattaacgttacgcgtaagtaccggtccgggggtgggggtccccgttcaccgtatacccgaccgaggaacgaccaaactcccgagggacaccaacactaatactacctaaacgaaatcgacacgacgccagagtagcgaacggaccacggtcgtagttacttattggnacggaagtacgacctaccgaacggtcaccctacgttgtcgtcttttgactttg

SEQ ID NO: 393659 - DNA, 616 bp, Homo sapiens
  misc_feature: GZ8MTXP02IQB0X.38.28.C06.1.454.CMB.2.raw
  modified_base (364)..(364): a, c, t, g, unknown or other
  modified_base (419)..(419): a, c, t, g, unknown or other
  modified_base (434)..(434): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgcaggctccagggaagggctggagtgggtctcagcaattaatggtaggggtgattcaccatatacgcagactccggtgggggccgttcaccatcaccagagacaactccagagcacactatatactacaaatgccacagcctgagagtcgnggacacggccgtgtattatgtgcgagagatcccgaaggtgacctaccgttgggtntcttttgattttcgnggttcggaccgaaaggggtacaagttgggtccaacccggtttctccgttacaacggtccctaccgaacccgtaaacggggccccctaagttcccgggttacccctttcccccccgggcggtccccgtaccccgtcggtaacccgtaccggaacggaccgaccctacccgtaccggaacgacg

SEQ ID NO: 393660 - DNA, 539 bp, Homo sapiens
  misc_feature: GZ8MTXP02FMJZV.38.28.C06.1.454.CMB.2.raw
  modified_base (302)..(302): a, c, t, g, unknown or other
  modified_base (363)..(363): a, c, t, g, unknown or other
  modified_base (389)..(389): a, c, t, g, unknown or other
  modified_base (411)..(411): a, c, t, g, unknown or other
  modified_base (416)..(416): a, c, t, g, unknown or other
  modified_base (421)..(421): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcttttctgtggctaatttaaaaggtgtccagtgtgaggtgcaggtgtcggagtcgtgggggagcttggttcaggcccgggggtcctgagactctcctgtgcagtctctggattaaccttagtgactatgccatgatctggtccnccaggctccgaggggaaggggctgggagtgggtctcgagcaaattaagtgggtacggggtnatcacatacttacgcagacgtcgggngggggccgtcaccatcacaganacacncaganacacactatatacaacaaatcgacacacgcacgagagacgacggacgacggacgtcgacgtattagttagtgacgacgacgacgaccgaacgacgacgtacgtcgtcgtcgtttgtag

SEQ ID NO: 393661 - DNA, 583 bp, Homo sapiens
  misc_feature: GZ8MTXP02HOXWS.38.28.C06.1.454.CMB.2.raw
  modified_base (265)..(265): a, c, t, g, unknown or other
  modified_base (290)..(290): a, c, t, g, unknown or other
  modified_base (293)..(293): a, c, t, g, unknown or other
  modified_base (318)..(318): a, c, t, g, unknown or other
  modified_base (320)..(320): a, c, t, g, unknown or other
  modified_base (322)..(322): a, c, t, g, unknown or other
  modified_base (353)..(353): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagcgtgtcgtttctaggtggctatttaaaaggtgtccagtgtgaggtgcaggtgtcggagtctgggggaggcttggttcagcctgggggtccctgagctctcctgtgcagtctntggattaaccttagtgactatgccntgntcgtggtccgcgcgcgcgaggaggngngngtggtgtcgagatagtagtaggtaggtagtntactactatatcgtacgacgtacgtccgggtcggggtcggtcgacacacacgacgacgacaacacgacgacgacacactactactactaactaacgtacgacacacgacgtacgacgacggacgacggacgacggtacggtacgttagttagttacgtacggtacgacgacgtacgtaccgtaaccggtaccgtaccgtacgttacggttcgtttacgtttacgtttacg

SEQ ID NO: 393662 - DNA, 556 bp, Homo sapiens
  misc_feature: GZ8MTXP02IBM2E.38.28.C06.1.454.CMB.2.raw
  modified_base (307)..(307): a, c, t, g, unknown or other
  modified_base (379)..(379): a, c, t, g, unknown or other
  modified_base (413)..(413): a, c, t, g, unknown or other
  modified_base (419)..(419): a, c, t, g, unknown or other
  modified_base (427)..(427): a, c, t, g, unknown or other
  modified_base (450)..(450): a, c, t, g, unknown or other
  modified_base (457)..(457): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcgttttctagtggctaattttaaaaggtgtccagtgtgaggtgcaggtgtcggagtctgggggaggcttggttcaggcccggggggtcctgagactctcctgtgcagtctctggattaaccttagtgactatgccatgatctgggtccnccaggctccgaggggaaggggctggagtgggtctcagcaattaagtgggtaggggtgattcacatattacgnagactccgggtgggggccgttcaccatcacaganactacnccaggacncacactatactactaacaaatanacacacncgagagagacgacgacgacgcgtagtacgttagtgtcgacgacgacgacgtaccgtacgtaacgaccgtacgttcgttcgttcgtttcgttacgtttcg

SEQ ID NO: 393663 - DNA, 533 bp, Homo sapiens
  misc_feature: GZ8MTXP02FZ3CN.38.28.C06.1.454.CMB.2.raw
  modified_base (270)..(270): a, c, t, g, unknown or other
  modified_base (347)..(347): a, c, t, g, unknown or other
  modified_base (356)..(356): a, c, t, g, unknown or other
  modified_base (422)..(422): a, c, t, g, unknown or other
  modified_base (434)..(434): a, c, t, g, unknown or other
  modified_base (509)..(509): a, c, t, g, unknown or other
  modified_base (523)..(523): a, c, t, g, unknown or other
  modified_base (527)..(527): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtaggggtnattcaccatattacgcagactccggtgggggccgttcaccatcaccagagacaactccaggagcacactatatctanaaatgccanagcctgagagtcgaggacacggccgtgtattatgtgcgagagatcccaaggtgacccaccttggtntctttgatttcngttggacctaaggggcaaagtggtcaccgttctcttcagccctcaccaagggcccatcggtcttcccccgcgccncctgcctcgacgcncacncgagag

SEQ ID NO: 393664 - DNA, 587 bp, Homo sapiens
  misc_feature: GZ8MTXP02JI953.38.28.C06.1.454.CMB.2.raw
  modified_base (214)..(214): a, c, t, g, unknown or other
  modified_base (268)..(268): a, c, t, g, unknown or other
  modified_base (330)..(330): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgagggaagggctggagtgggtctcagcaattaatgggtaggggtnattcaccatatacgcagactccggtgggggccgttcaccatcaccagagacaactccaggancacactatatctaacaaatgccacagcctgagagtcgagggacacggccgtagtattatgtgcgagagactcccgaaggtcgaccaccgttggtgtcttttgatttcgtgttggaccaaagggacaagtcggtacacccggtctcttcacgtccctaccgaaccgaaacggggccccaaagttcccggtccctttcccccccggcggtccccgtccctcgcccgtaccgacggaccacccacccgtaccgaacgacg

SEQ ID NO: 393665 - DNA, 506 bp, Homo sapiens
  misc_feature: GZ8MTXP02I4E8D.38.28.C06.1.454.CMB.2.raw
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccaccctctcctgcagggccagtcagagtgtttcaacggctacttagcctggtaccagcaaaacctggccaggctcccaggctcctcatctatggtacatccgtcagggccactggtatcccagacaggttcagtgcagtggtctggggacagacttcactctcacatcagcagctgagctagaagtatttgcagtgtattactgtcagcagtatactacaaagaccgtatacgtttggaccgtaggggaccaagctggacgaccaaagaactgagctagccacatctcg

SEQ ID NO: 393666 - DNA, 597 bp, Homo sapiens
  misc_feature: GZ8MTXP02GXPIQ.38.28.C06.1.454.CMB.2.raw
  modified_base (306)..(306): a, c, t, g, unknown or other
  modified_base (365)..(365): a, c, t, g, unknown or other
  modified_base (434)..(434): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcttttctggtggctattttaaaaggtgtccagtgtgaggtgcaggtgtcggagtcgtgggggaggcttggttcaggcccggggggtcctgagactctcctgtgcagtctctggattaaccttagtgactatgccatgatctgggtccncaggctccgaggggaagggctgggagtgggtctcgagctaaattaagtgggtaggggtnagttcacatacttacgcagactccgggtgggggccgttcgaccagtccaccagagacaactccaggacncaacactatatactaaacaaaatcgacagacgaccagaagaggcgaacggaccgaaacgggtcccgtagttaacttagttggtcgacggacgaaggaaccttaccccggaaaggtaaccggaccctaacccgtttgggtccgttacttttggtactttttcgg

SEQ ID NO: 393667 - DNA, 534 bp, Homo sapiens
  misc_feature: GZ8MTXP02JUY4V.38.28.C06.1.454.CMB.2.raw
  modified_base (256)..(256): a, c, t, g, unknown or other
  modified_base (326)..(326): a, c, t, g, unknown or other
  modified_base (520)..(520): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctggggaggcttggttcagcctgggggtccctgagactctcctgtgcagtctctggattaacctttagtgactatgccatgatctgggtccgccaggctccaggggaaggggctggagtgggtctcagcaattaangggtaggggtgattcaccatatacgcagactcgtgggggccgtcaccatcaccagagacaactccaggancacactatatctacaaatgccacagcctgagagtcgaggcacggccgtgtattatgtgcgagagactcccaaggtgaccaccttggtgtctttgatttctgtggccaagggacagtggtcaccggttctcttcgatcctccaccaagggcccccatccggtccttcccccgtgcccgccctgcctccgaggacnccaccgtcgagacg

SEQ ID NO: 393668 - DNA, 554 bp, Homo sapiens
  misc_feature: GZ8MTXP02GDI1I.38.28.C06.1.454.CMB.2.raw
  modified_base (306)..(306): a, c, t, g, unknown or other
  modified_base (404)..(404): a, c, t, g, unknown or other
  modified_base (409)..(409): a, c, t, g, unknown or other
  modified_base (435)..(435): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttctgtggctattttaaaaggtgtccagtgtgaggtgcaggtgtcggagtcgtgggggaggcttggttcaggcccggggggtccctgagactctcctgtgcagtctctggattaaccttagtgactatgccatgatcgtgggtccnccaggctccgaggggaagggctgggagtgggtctcagcaattaagtgggtacggggtgattcactatattacgcagacgtccgggtgggggcccgttnaccgntaccaccagagaacaactccgaggcncaacactatatactacaaatgacacagcctgaagagcgaaggcacggcgtagtattagtgtcgacgtagacgacgtaccgaacggtcaacccgtcgttgggcttcgtttcgtatttcgg

SEQ ID NO: 393669 - DNA, 602 bp, Homo sapiens
  misc_feature: GZ8MTXP02HSV7R.38.28.C06.1.454.CMB.2.raw
  modified_base (198)..(198): a, c, t, g, unknown or other
  modified_base (393)..(393): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtnattcaccatattacgcagactccggtgggggccgttcaccatcaccagagacaactccaggagcacactatatctaacaaatgcacagcctgagagtcgaggacacgggccgtgtattattgtgcgagagatcccaaaggtgacctaccttggtgtcttttgatttctgtgccaaagggacaagtcggtcacgtntcttcagccctcacgaacggcccagtccggtccttcccccgtggccgccctgcctccacggtacgccaccgtcccgagacgccaacgacggccggcccgtggggccttcggcccgttagggtaccgtaaacgggtaccttaccgttacccgaaccggttagaacgttccggaacgttcgggacggtccggggcgttacggggaacccgg

SEQ ID NO: 393670 - DNA, 537 bp, Homo sapiens
  misc_feature: GZ8MTXP02HYNRL.38.28.C06.1.454.CMB.2.raw
  modified_base (259)..(259): a, c, t, g, unknown or other
  modified_base (267)..(267): a, c, t, g, unknown or other
  modified_base (359)..(359): a, c, t, g, unknown or other
  modified_base (434)..(434): a, c, t, g, unknown or other
  modified_base (515)..(515): a, c, t, g, unknown or other
tcagtcgatcacgtcacgaccggtgctcgatttagagctcacgtattgggtttggggaggcttggttcagcctgggggtccccgagactctcctgtgcagtctctggattaacctttagtgactatgccatgatctgggtccgccaggctccagggaaggggctggagtgggtctcagccaattaatggtaggggtgattcaccatattacgcagactccgtgggggccgttcaccatcaccagagacaactccaggancacactanatctacaaatgcacagcctgagagtcgaggacacggccgtgtattatgtgcgagagatcccaaaggtgaccacttggtcgcttttgatttcngtggccaggggacaaatggtcaccgtctcttcacgccctccaccaacgggcccagtcggtccttccccctggccnccctgacctccaggacgccacctccgagagccacgacgccggcccctggggctcgccctggtcaaaggctacttccacgtnatcgactgacgcggctgcgagg

SEQ ID NO: 393671 - DNA, 542 bp, Homo sapiens
  misc_feature: GZ8MTXP02GZXJ1.38.28.C06.1.454.CMB.2.raw
  modified_base (214)..(214): a, c, t, g, unknown or other
  modified_base (296)..(296): a, c, t, g, unknown or other
  modified_base (425)..(425): a, c, t, g, unknown or other
  modified_base (429)..(429): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctgcagggccagtcagagtgttttcaacggctacttagcctggtaccagcaaaaactgccagctccagcncctcatctatggtacatccgtcagggccactggtatcccagacaggttcagtggcagtggtctggggacagacttcactctcaccatcagcagactggaggctgaaagattttgcagtgtattaatgtnaganagtataactaacaacgaacgtaactacgttacggtacgacgggaacgaaacgacgtacggaacgaaaccgaaaacgaaacgtaacgtacggacgtacgacgacctactactcg

SEQ ID NO: 393672 - DNA, 651 bp, Homo sapiens
  misc_feature: GZ8MTXP02HISN8.38.28.C06.1.454.CMB.2.raw
  modified_base (216)..(216): a, c, t, g, unknown or other
  modified_base (460)..(460): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccgaaggggaaanagcccaccctctcctgcagggccagtcagtagttgttttcaacggtctacttagcctggtaccagacaaaacctggccaggcctcccaggcctcctcatctatggtacactccgtcgacgggcccacgtggtactcccaagacacggttcaggtggacgtaggtgggtcgtggggactaggtaccttcacctctaccaccatacagacagaacgtgggacgctagaagttagtttgagtaggtnttattacgttgtacaggtataataactactaacgaaacgtaaccgttaaccgtaacgttttacggggacccgtaaacgggggtaacccctaaagggtcggtaacgggaaaacgtaaaacccgtaaaaccggaaaccgttaagggttacggggaccttacggaacccgtaacccgagtttaaccccgtttcg

SEQ ID NO: 393673 - DNA, 525 bp, Homo sapiens
  misc_feature: GZ8MTXP02GBKMX.38.28.C06.1.454.CMB.2.raw
  modified_base (423)..(423): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtctgggggaggcttggttcagcccggggggtccctgagactctcctgtgcagtctctggattaaccttagtgactatgccatgatcgtggtccgccaggctccgagggaaggggctgggagtgggtctcgagcaattaaagtggtacggggtgattcaccatattacgcagactccggtgggggccgttcacgatcaccagagacaactcagngcacacatatactaacaaatgacacagcctagagagtcgagacacggctgtattatgtgcgagacgactcccgaaggtcaccacttggagtctttgatttcg

SEQ ID NO: 393674 - DNA, 600 bp, Homo sapiens
  misc_feature: GZ8MTXP02JVIVI.38.28.C06.1.454.CMB.2.raw
  modified_base (213)..(213): a, c, t, g, unknown or other
  modified_base (412)..(412): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtcttgtctccaggggaaanagccaccctctcctgcagggccagtcagagtgtttcaacggctacttagcctggtaccagacaaaacctggaccaggcctcccgaggcctcctcatctatggtacatccgtcacgggccacgtggtactccccagacacggttcagtggcaggtgggtctggggacaggtaccttcgactctcaccatcagcagtacgnggagctaggaagtatttgctaggtgttattacgtgtacaggtactaagttaactaacttaacgaacgtacccgttaacttacggttttacgggaccgtaacgggggaacctaaacggcgtaacgggaaaccgtaaaccgaaaaccgtaaaccgtggtacggacgtacgacctacctaacgtccttacg

SEQ ID NO: 393675 - DNA, 509 bp, Homo sapiens
  misc_feature: GZ8MTXP02GMWOI.38.28.C06.1.454.CMB.2.raw
  modified_base (197)..(197): a, c, t, g, unknown or other
  modified_base (352)..(352): a, c, t, g, unknown or other
  modified_base (366)..(366): a, c, t, g, unknown or other
  modified_base (392)..(392): a, c, t, g, unknown or other
  modified_base (423)..(423): a, c, t, g, unknown or other
  modified_base (426)..(426): a, c, t, g, unknown or other
  modified_base (437)..(437): a, c, t, g, unknown or other
  modified_base (452)..(452): a, c, t, g, unknown or other
tcagtcgatcacgtcacgaccggtgctcgatttagagctcacgtattgggtttggggaggcttggttcagcctgggggtccctgagactctcctgtgcagtctctggattaacctttagtgactatgccatgatctgggtccgccaggctccagggaaggggctgggagtgggtctcagcaattaatggtaggggtnattcaccatattacgcagactccggtgggggccgttcaccatcaccagagacaactccaggagcacactatatctaacaaatgcacagcctgagagtcgaggacacgggcctgtattatgtgcgagagatccccaaaggtgaccctaccttggtntctttttgatttcngtggccaaagggcaatggacaccgtntcttcagcctcacaggcccatcgtctccccngcncctgctcagancacctcgagagcacngcgcctgggctgcctggcaacggactactccacgtgaatcgactgagcggctggacg

SEQ ID NO: 393676 - DNA, 533 bp, Homo sapiens
  misc_feature: GZ8MTXP02IOZ3Q.38.28.C06.1.454.CMB.2.raw
  modified_base (217)..(217): a, c, t, g, unknown or other
  modified_base (270)..(270): a, c, t, g, unknown or other
  modified_base (318)..(318): a, c, t, g, unknown or other
  modified_base (323)..(323): a, c, t, g, unknown or other
  modified_base (345)..(345): a, c, t, g, unknown or other
  modified_base (391)..(391): a, c, t, g, unknown or other
  modified_base (424)..(424): a, c, t, g, unknown or other
  modified_base (430)..(430): a, c, t, g, unknown or other
  modified_base (462)..(462): a, c, t, g, unknown or other
  modified_base (465)..(465): a, c, t, g, unknown or other
  modified_base (503)..(503): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgcctttatgatctgggtccnccaggctccagggaagggctggagtgggtctcagcaattaagtggtaggggtnatcacatatacgcagcgtcggtggggccgtcacatcacagagacaacncaganacacactatatactaacaaatnacacacacacgagagacgacgacgacgacgtacgtattagttgtgngagagacgacgacgtacgacacgtcgtgtgttnttattnttgtgacgagagagtagtcgacgtctctctcnccnccaccgacgaccgacgtcgtccgttccctccgccgccncgcgcgacgacgaccgaccgaccgacgacg

SEQ ID NO: 393677 - DNA, 730 bp, Homo sapiens
  misc_feature: GZ8MTXP02I9DBL.38.28.C06.1.454.CMB.2.raw
  modified_base (284)..(284): a, c, t, g, unknown or other
  modified_base (306)..(306): a, c, t, g, unknown or other
  modified_base (352)..(352): a, c, t, g, unknown or other
  modified_base (362)..(362): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcgttttctagtggctattttaaaaggtgtccagtgtgaggtgcaggtgtcggagtctgggggaggcttggttcaggcccggggggtccctgagactctcctgtgcagtctctggattaaccttagngactatgccatgatctggtccnccaggctccgaggggaagggctgggagtgggtctcagcaattaagnggtaggggtnagttcacctatacgttacgcgaagtacctccggggtcggggggtcccgttacaacccgtattacccaaacccgaaggaacgaaacccaaaccgttaccccgaaaggggaccaccaaaccctaacttaatacttaaccttaaaccgaaaattcggaaccaaccgaacgtaccccgtaggaaggtaacggtacccgggaaagggaacccggaaacccggggtcccgttaagggtttaaaacttttaaacgttttacgggggtacgggtaaccggtaaacggtaaccgtaaacccgtaaccccggtaaaacgggtccgtaaaccccgttacggtttacgggttcgtttacgtttttacggttacgtttacg

SEQ ID NO: 393678 - DNA, 586 bp, Homo sapiens
  misc_feature: GZ8MTXP02G8R6X.38.28.C06.1.454.CMB.2.raw
  modified_base (369)..(369): a, c, t, g, unknown or other
  modified_base (431)..(431): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcttttctagtggctattttaaaaggtgtccagtgtgaggtgcaggtgtcggagtctgggggaggcttggttcaggcccggggggtccctgagactctcctgtgcagtctctggattaaccttagtgactatgccatgatcgtgggtccgccaggctccgagggaaggggctggggagtggggtctcgagctaaagttaagtggtaggggtntagttcactatattacgcagactccgggtggggggccgttcacctatcaccagacgacaacnccgaggacgcacactatatactaacaaatcgacacgacgaccgtagacgaggacgaacggaccaacgggtccgtaggttacttagttggtacgacgagtacgactaccccgaacggtcgacccgtaccgttgggtcttcgttttagtactttcgg

SEQ ID NO: 393679 - DNA, 569 bp, Homo sapiens
  misc_feature: GZ8MTXP02J3VGL.38.28.C06.1.454.CMB.2.raw
  modified_base (268)..(268): a, c, t, g, unknown or other
  modified_base (330)..(330): a, c, t, g, unknown or other
  modified_base (391)..(391): a, c, t, g, unknown or other
  modified_base (527)..(527): a, c, t, g, unknown or other
  modified_base (555)..(555): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaatggtaggggtnattcaccatatacgcagactccggtgggggccgttcaccatcaccagagacaactccaggancacactatatctaacaaatgccacagcctagagagtcgaggacacggccgtgtattattgngcgagagactacccgaaacggtgacccgtaccttggtgtacctttttgatttccgtgtggccctaaaggggaccaagtcggtcaccggttctcttcacgccctccgaccaacgggccccatccggtccttccccgngcccgcccctggcctccgacgggacccnccaccgcgacgacg

SEQ ID NO: 393680 - DNA, 722 bp, Homo sapiens
  misc_feature: GZ8MTXP02JCWU6.38.28.C06.1.454.CMB.2.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccgccaggctccgaggggaaggggctgggagtgggtctcagcaattaagtgggtaggggtgattcaccatatacgcagactccggtgggggcccgttcaccatcaccagagaccaactccgaggacgcacactatactctaacaaatgaccacagcctagagagtcgaggacacgggccgtgtattattggtgacgtagacgactcccgaaaggtcgaccctaccgtttgggtcgttccttttaggtacttttccgtggttcggacccgtaaaaggggactaaaggttcggtacccgtaaccggttccttaccgtttccgaaccgtccccgtacccgaaaccccggtaaaacgggggtccccctaaacggttccccgggtttcccccgtttacccccccggtcggggtaccccccggttcccccgtttacgggcccccgtttacccccggaaaacgggggttccccggaccccctaaccccccggttacccgggaaacggtaacccccgg

SEQ ID NO: 393681 - DNA, 697 bp, Homo sapiens
  misc_feature: GZ8MTXP02F6OVH.38.28.C06.1.454.CMB.2.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaatggtaggggtgattcaccatattacgcagactccggtgggggccgttcaccatcaccagagacaactccaggagcacactatatctaacaaatgccacagcctgagagtcgagggacacgggccgttgtattattggtgcgagagactaccccgaaagggtcgaacccaccgtttggtacgttccgttttagtacttttcgttggttacgggacccgtaaaacggggtaccgtaaagttgggttacccgtaacccggtttaccgtttccctttaccgacggtacccccgttaccccgaaacccccgaaaccgggggtaccccctaacgttaccccgggtttcccgtttaccccccccgttcggggccccgtcccccgttcggtccccgttacccgaccggggtacggacccctaaccccgttacccggaacggaacccgg

SEQ ID NO: 393682 - DNA, 593 bp, Homo sapiens
  misc_feature: GZ8MTXP02JNGAP.38.28.C06.1.454.CMB.2.raw
  modified_base (272)..(272): a, c, t, g, unknown or other
  modified_base (310)..(310): a, c, t, g, unknown or other
  modified_base (406)..(406): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatctgggtccgccaggctccgaggggaagggctggagtgggtctcagctaattaagtgggtaggggtnattcaccatatacgcagacgtccggtgggggcccgttnaccatccaccgagacgacaactccgaggacgcacactatactactaacaaatgacccacagcctagagagtcgaggacacggtcgtatattattgngcgtagagactacccgaacggtcgacctaccgttggttcgttcttttagtacttttcgtaggtacggtaccgtaagggactaacgtcgtaccgtacccgttctcttcgacgccctacgaccgacggccctacgtccggtcccttccccgtcgcccgccctagcctcgagcgaccaccgtcgacgacg

SEQ ID NO: 393683 - DNA, 555 bp, Homo sapiens
  misc_feature: GZ8MTXP02G345Q.38.28.C06.1.454.CMB.2.raw
  modified_base (215)..(215): a, c, t, g, unknown or other
  modified_base (302)..(302): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagngccaccctctcctgcagggccagtcagagtgtttcaacggctacttagcctggtaccagcaaaacctggccaggcctccaggcctcncatctatggtacatccgtcgacgggccacgtcggtactccccagacaggttcagtgcgagtgggtctggggacaggacttcactctacaccatcagcagactggagctagaagtatttgcagttgtattactgtctaggctaagtatactaacgaagtaccgtactacgtttacggaccgtaacggggacctaaggcgtacgggaacgtaaacccgaaacgaacgtgtacggactcgaccaccgtatcgtacg

SEQ ID NO: 393684 - DNA, 655 bp, Homo sapiens
  misc_feature: GZ8MTXP02H096O.38.28.C06.1.454.CMB.2.raw
  modified_base (214)..(214): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgagggaagggctggagtgggtctcagcaattaagtgggtaggggtgattcaccatatacgcagactccggtggggggccgttcaccatcaccagagacaactccaggagcacactatatctaacaaatgccacagcctgagagtcgaggacacgggccgtgtattatgtgacgagagactcccgaaacggtcgaaccctccgtttgggtcgttctttttgactttttcgtgggttacggacccgtaaagggggaacctaaagttgggtaccctaacccggtcttcctttaccacggccccttacccaaacccgaaaacccgggccccctaaacgttcccggggttccccttttccccccggtcggggccccttcccccgttggccccttaccccgaaggggtaccccgacccgtacccggtccgaacggacg

SEQ ID NO: 393685 - DNA, 549 bp, Homo sapiens
  misc_feature: GZ8MTXP02IADX8.38.28.C06.1.454.CMB.2.raw
  modified_base (303)..(303): a, c, t, g, unknown or other
  modified_base (361)..(361): a, c, t, g, unknown or other
  modified_base (425)..(425): a, c, t, g, unknown or other
  modified_base (491)..(491): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggatgagctggcttttcttgtggctattttaaaaggtgtccagtgtgaggtgcaggtgtcggagtctgggggaggcttggttcagcccgggggtccctgagactctcctgtgcagtctctggattaaccttagtgactatgccatgatctgggtccnccaggctccgaggggaaggggctgggagtggggtctcagcaattaagtggtaggggtnattcaccatattacgcagactccggtgggggcccgttcaccatcaccagagacaactccagganacacactatatacacaaaatgacacagcctgaacgagtcgaggacacggccgtgtattattgtcgnggaagcgacgttccccgaaaggttcgacctaaccgttggtactcgttttgtatttcgg

SEQ ID NO: 393686 - DNA, 552 bp, Homo sapiens
  misc_feature: GZ8MTXP02HSXMQ.38.28.C06.1.454.CMB.2.raw
  modified_base (362)..(362): a, c, t, g, unknown or other
  modified_base (402)..(402): a, c, t, g, unknown or other
  modified_base (410)..(410): a, c, t, g, unknown or other
  modified_base (416)..(416): a, c, t, g, unknown or other
  modified_base (422)..(422): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgcgtttctagtggctatttaaaaggtgtccagtgtgaggtgcaggtgtcggagtcgtgggggaggcttgggttcaggcccgggggtccctgagactctcctgtgcagtctctggattaaccttagtgactatgccatgatctggtccgccaggctccgaggggaagggctgggagtgggtctgagctaaattaagtggtaggggtnattcacatattacgcagactccgtggggggccgttcaccntcacaganacaacncgaggncacatatactactaaacgaatcgacacacgacgagagagtacggacggacgacgtcgtagtagttagttgtcgacgacgacgacgtaccgacgtaacgaccgtacgtcgtcgttcgtttcgttacgttcg

SEQ ID NO: 393687 - DNA, 537 bp, Homo sapiens
  misc_feature: GZ8MTXP02I341Q.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctgcagggccagtcagagtgtttcaacggctacttagcctggtaccagacaaaacctggccaggcctcccaggctcctcatctatggtacatccgtcagggccactggtatcccagacaggttcagtggcagtgggtctgggacagacttcactctcaccatcagcagactggagctagaagtatttgctagtgttattacgtgtcagcagtatactacaaagtaccgtatacgtttcggaccgtaggggacctaaggcgtaggacgaaaccgaaacgaaaccgtggtcggactcggacacctatcttacg

SEQ ID NO: 393688 - DNA, 586 bp, Homo sapiens
  misc_feature: GZ8MTXP02HSN6A.38.28.C06.1.454.CMB.2.raw
  modified_base (305)..(305): a, c, t, g, unknown or other
  modified_base (366)..(366): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgtgctcaactgtcttgtccaccttgctgagcgtgcttttcttagtggctattttaaaaggtgtccagtgtgaggtgcaggtgtcggagtctgggggaggcttggttcagcctggggggtccctgagactctcctgtgcagtctctggattaaccttagtgactatgccatgatctgggtccnccaggctccaggggaaggggctggagtggggtctcaggcaaattaagtgggtagggggttntacttcactattagtcgcgaacgtccgtccggggtgggggtcccgttacacccgtactaccgaccgagaacgaccaaccgtaccgaggcacacactatactactaacgaaatcgacacacgccgacgagacgacggacggacgacggtacgtacgtagttagttcgtgacgacgacgacgtaccgtaacgtacgaccgtacgtcgtcgttcgtttcgtcg

SEQ ID NO: 393689 - DNA, 524 bp, Homo sapiens
  misc_feature: GZ8MTXP02H3NZ3.38.28.C06.1.454.CMB.2.raw
  modified_base (349)..(349): a, c, t, g, unknown or other
  modified_base (364)..(364): a, c, t, g, unknown or other
  modified_base (432)..(432): a, c, t, g, unknown or other
  modified_base (436)..(436): a, c, t, g, unknown or other
  modified_base (452)..(452): a, c, t, g, unknown or other
  modified_base (476)..(476): a, c, t, g, unknown or other
  modified_base (480)..(480): a, c, t, g, unknown or other
  modified_base (500)..(500): a, c, t, g, unknown or other
  modified_base (508)..(508): a, c, t, g, unknown or other
  modified_base (518)..(518): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatactctaacaaatgcacagcctgagagtcgagacacggcgtgtattatgtgcgagagatccaacggtgacctacttgggtntctttttgattttcnggttcggcctaaagggacaagttggcaccgtctctcagcctccacgaggcccatcggtccttccccgnggcnccctgcctcgaggacncaccgcgagcgcacgcgccgccgnggcncgcgtgacagctactcagtncgcgacgngacggcggcncggacg

SEQ ID NO: 393690 - DNA, 712 bp, Homo sapiens
  misc_feature: GZ8MTXP02FXT4U.38.28.C06.1.454.CMB.2.raw
  modified_base (309)..(309): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctaattttaaaaggtgtccagtgtgaggtgcaggtgtcggagtcgtgggggagcttggtcaggcccgggggtcctgagactctcctgtgcagtctcgtggtattaaccttagtgactatcgccatgatcgtgggtcccnccgaggcctaccgaggggaaggggcccggtaggtcggggtcctcgaggacctaaagttaagtggggtaaggggttctactaccactattacgtaccgacgacggtaccggtccgggggtcggggggtacccgttaccaaccgtacgtacccgaaacgaggaacgaaaccaaaccgtccggaaggacgacctaaactaacttaactacgtaactaaaacgtaaactacgacgaacgacgtaccgtacgaacggacggtacggaacggaacggaccgggtaccggttacgttaagtttacgttaggtacggtacggtaacggtaacggtaaccgtaacccgtaaccggtaaccgtaacccgtaaccgttacggttacgttacgtttcgtttacgtttacgtttcg

SEQ ID NO: 393691 - DNA, 585 bp, Homo sapiens
  misc_feature: GZ8MTXP02HI5SC.38.28.C06.1.454.CMB.2.raw
  modified_base (338)..(338): a, c, t, g, unknown or other
  modified_base (350)..(350): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaagggctggagtgggtctcagcaattaatggtaggggtgattcaccatattacgcagactccggtgggggccgttcaccatcaccagagacaactccaggagcacactatatctaacaaatgcacagcctgagagtcgaggacacggccgtgtattattgtgcgagagatcccaaaggtnacctacttggtntcttttgatttctgtggccaagggacaagtggtctaccgtctcgttcacgcctcccaccgacggcccagtccggtccttcccccgtggccgccctcggcctccgacggcgccaccgtccgagacgcacgacgccggcccgtgggcctcggccgtcggtaccgaaacggaccttaaccgttcctaacggttcgaacgttcccggaacgttcggacggccggggcttcgggaaccgg

SEQ ID NO: 393692 - DNA, 551 bp, Homo sapiens
  misc_feature: GZ8MTXP02F84RD.38.28.C06.1.454.CMB.2.raw
  modified_base (359)..(359): a, c, t, g, unknown or other
  modified_base (374)..(374): a, c, t, g, unknown or other
  modified_base (399)..(399): a, c, t, g, unknown or other
  modified_base (412)..(412): a, c, t, g, unknown or other
  modified_base (418)..(418): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcgttttctaggtggctattttaaaaggtgtcagtgtgaggtgtaggtgtcggagtctgggggaggcttggttcaggcccggggggtccctgagctctcctgtgcagtctctggattaaccttagtgactatgccatgatctggtccgccaggctccaggggaagggctggagtgggtctcagcaaattaatggtaggggtntactcacatatacgnagcgtcgggtgggggtccgtcacancacagacacaacncgagancacactatactactaaacaaatcgacacacgacgagagagacgacggacgacggacgtagtagttagttagtagacgagacgacgtaccgacgacgaaccgtacgttcgttcgttcgtttcgttacttcgtcg

SEQ ID NO: 393693 - DNA, 560 bp, Homo sapiens
  misc_feature: GZ8MTXP02GAF26.38.28.C06.1.454.CMB.2.raw
  modified_base (332)..(332): a, c, t, g, unknown or other
  modified_base (412)..(412): a, c, t, g, unknown or other
  modified_base (528)..(528): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctgggagtgggtctcagcaattaatgggtaggggtgattcaccatattacgcagactccggtgggggccgttcaccatcaccagagacaactccaggancacactatatctaacaaatgccacagcctgagagtcgaggacacgggccgtgtattatgtgcgagagactacccaaggtnacccacctttggtgtcttttgatttctgtggaccgaaaggggacaaagtggtaccaccggtcttcgttcagccctccaccgaacgggcccagttccggtccttccccctgggcccncccctgcctccgaggacgccacctccgagacg

SEQ ID NO: 393694 - DNA, 666 bp, Homo sapiens
  misc_feature: GZ8MTXP02GSZC2.38.28.C06.1.454.CMB.2.raw
  modified_base (270)..(270): a, c, t, g, unknown or other
  modified_base (312)..(312): a, c, t, g, unknown or other
  modified_base (333)..(333): a, c, t, g, unknown or other
  modified_base (350)..(350): a, c, t, g, unknown or other
  modified_base (641)..(641): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccgccaggctccgagggaaggggctggagtgggtctcagcaattaatgggtaggggtnatcacatatacgcagaccgtccgggtcgggggccgtcaccancacagacacaactcgaggacncacactatactactaanaaatcgacccacacgcctaggaagacgtacggacgggaccgacgggtccgttagtaatttagttggtagacgaagtacgactacccggaaacggtcgaacccgtaccgtttgggttcgttcgttttagtactttcgtggtacggaccgtaaagggactaaggttcggtacctaccgttcttaccttacgaccgtccctacccgaacccggaaccgggtcccctacgttcccggttccccttacccccggtcgggcccctccccgtcgtaacccgtcccggaacgggtaccncccgtaacccgtaccggaacgaccg

SEQ ID NO: 393695 - DNA, 535 bp, Homo sapiens
  misc_feature: GZ8MTXP02JOKCI.38.28.C06.1.454.CMB.2.raw
  modified_base (352)..(352): a, c, t, g, unknown or other
  modified_base (421)..(421): a, c, t, g, unknown or other
  modified_base (427)..(427): a, c, t, g, unknown or other
  modified_base (437)..(437): a, c, t, g, unknown or other
  modified_base (449)..(449): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagctggctttttctgtggctattttaaaaggtgtccagtgtgaggtgcaggtgtcggagtctgggggaggcttggttcaggccgtggggggtccctggagactctcctgtgcagtctctggattaaccttagtgactatgccatgatctggtccgccaggctccgaggggagggctggagtgggtctcgagcaaagttagngggtaggggtgattcgacattatcgcagaccgtcggtgggggccgttcaccgatcaccagacgacaacncaggancacactatanactaacaaatanacacacgcgagagagacgagacgacgcgtacgtagtatgtgacgacgacgacgacgaacgacgacgtacgtcgtcgtcgttcgtcg

SEQ ID NO: 393696 - DNA, 598 bp, Homo sapiens
  misc_feature: GZ8MTXP02ICQFU.38.28.C06.1.454.CMB.2.raw
  modified_base (213)..(213): a, c, t, g, unknown or other
  modified_base (267)..(267): a, c, t, g, unknown or other
  modified_base (280)..(280): a, c, t, g, unknown or other
  modified_base (302)..(302): a, c, t, g, unknown or other
  modified_base (309)..(309): a, c, t, g, unknown or other
  modified_base (314)..(314): a, c, t, g, unknown or other
  modified_base (320)..(320): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccnccaggctccagggaaggggctggagtgggtctcagcaattaatgggtaggggtnatcacatatacgnagcgtcggtggggccgtcacancacaganacacncagacncacactatatactaacaaatgaccacagcctaggagacgtcgaggaccgacggtccgttagttattagtgtcgacgagagtacgtacccgaacggtcgacccgtacgttggtcttcgttttgtacttttcgtggtacggacgtaagggactagtcgtacctaccgttcttcgtcgaccgccctaccgaaccgtaaccggccctacgtcccgttcccctcccccgtcggcccctcccgtcgaacccgtccgacggaccgacccgtacccgtacgacgcg

SEQ ID NO: 393697 - DNA, 597 bp, Homo sapiens
  misc_feature: GZ8MTXP02IMXI4.38.28.C06.1.454.CMB.2.raw
  modified_base (306)..(306): a, c, t, g, unknown or other
  modified_base (357)..(357): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctagtggctattttaaaggtgtccagtgtgaggtgcaggtgtcggagtctgggggaggcttggttcaggcccggggggtcctgagactctcctgtgcagtctctggatttaaccttagtgactatgccatgatcgtggtccncaggctcgagggagggctggagtgggtctcagcaattaagtggtaggggtntatcactatacgtacgcacgacgtccggggtcggggccgtcacactcacgagacacacgtacgagacacacactatactactaacaaatcacacgacgaccgtaggacgacggtacggaacggaccgtacgggtcgttagtttaactttagttggacggaacggaacggtacgtaaccgtacccggtaaacggtaaccgtaccccgttacggtttggtactttcgttttagtacgtttcg

SEQ ID NO: 393698 - DNA, 546 bp, Homo sapiens
  misc_feature: GZ8MTXP02HZTDG.38.28.C06.1.454.CMB.2.raw
  modified_base (306)..(306): a, c, t, g, unknown or other
  modified_base (336)..(336): a, c, t, g, unknown or other
  modified_base (405)..(405): a, c, t, g, unknown or other
  modified_base (445)..(445): a, c, t, g, unknown or other
  modified_base (448)..(448): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagcgtgtcttttctaggtggctaattttaaaaggtgtccagtgtgaggtgcaggtgtcggagtcgtgggggaggcttggttcagccgtgggggtccctgagctctcctgtgcagtctctggattaccttagtgactatgccatgatctgggtccncaggctccgagggagggctggagtgggtcngagataagttagtgggtaggtatatcactatatcgacagtaccgtccggggtcggggtccgtacaccanaccacgagacactaacgcgagcactacatatacgtacaanaanagacacacgacgagagagacgacgacgacgacgtacgtagttagtgtgacgagacgacgaccgaacgtacgaccgtacgtacgtcgttcgtttacgtg

SEQ ID NO: 393699 - DNA, 603 bp, Homo sapiens
  misc_feature: GZ8MTXP02JGJK5.38.28.C06.1.454.CMB.2.raw
  modified_base (303)..(303): a, c, t, g, unknown or other
  modified_base (327)..(327): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttnaccatcacagagacaactcaggancacactatatctacaaatgccacagcctgacgagtcgaggacacggccgtgtattattgtgcgagagactcccgaaaggtgaccctaccgtttgggtgtcttttaggattttcgtgttagggccctaaagggggacctaaagtcggttaccaccggttctcttcacgccctccaacccgaacgggtcccccaagttcccgggtccctttccccccgtgggccccgtccccgtggtccctacccgaggggaccacctaacccgtcccggagtaaccg

SEQ ID NO: 393700 - DNA, 538 bp, Homo sapiens
  misc_feature: GZ8MTXP02HI3XI.38.28.C06.1.454.CMB.2.raw
  modified_base (334)..(334): a, c, t, g, unknown or other
  modified_base (444)..(444): a, c, t, g, unknown or other
  modified_base (499)..(499): a, c, t, g, unknown or other
  modified_base (517)..(517): a, c, t, g, unknown or other
  modified_base (520)..(521): a, c, t, g, unknown or other
  modified_base (523)..(523): a, c, t, g, unknown or other
  modified_base (525)..(525): a, c, t, g, unknown or other
  modified_base (529)..(529): a, c, t, g, unknown or other
  modified_base (531)..(531): a, c, t, g, unknown or other
  modified_base (533)..(533): a, c, t, g, unknown or other
  modified_base (535)..(535): a, c, t, g, unknown or other
  modified_base (537)..(537): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaagtgggtaggggtgattcaccatatacgcagactccggtgggggccgttcaccatcaccagagacaactccaggancacactatatctaacaaatgcccacagcctgagacgtcgaggactacggccgtgtattagtgtgacgagagactacccgaaggtgaccaccttggtgtcttttgatttcngtggccgaagggacaagtggtccacggttctcttcagccctcaccgaacggcccngtccgtctccccgcgccnccnncncncgcncncncncng

SEQ ID NO: 393701 - DNA, 585 bp, Homo sapiens
  misc_feature: GZ8MTXP02JPABX.38.28.C06.1.454.CMB.2.raw
  modified_base (419)..(419): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgcgttttctagtggctatttaaaggtgtccagtgtgaggtgcaggtgtcggagtctgggggaggcttggttcaggcccggggggtcctgagactctcctgtgcagtctctggattaacctttagtgactatgccatgatcgtgggtccgccaggctccgaaggggaagggctgggagtgggtctcgagactaattaaagtggtaaggggtcattccaactatacttacgcagacgtccgggtcgggggccgttacaccgtacnccacgaagactaccactaccgaggacactaacatataactagtaaacaaagtacacacacgacgagagacggacggacggacgacggtacgtagttacgttagttagtcgacgagacgacgtaccgacgtaacgtacgtacgttacgtcgtcgtttcgttacttcg

SEQ ID NO: 393702 - DNA, 508 bp, Homo sapiens
  misc_feature: GZ8MTXP02FIBCD.38.28.C06.1.454.CMB.2.raw
  modified_base (268)..(268): a, c, t, g, unknown or other
  modified_base (330)..(330): a, c, t, g, unknown or other
  modified_base (418)..(418): a, c, t, g, unknown or other
  modified_base (425)..(425): a, c, t, g, unknown or other
  modified_base (428)..(428): a, c, t, g, unknown or other
  modified_base (445)..(445): a, c, t, g, unknown or other
  modified_base (454)..(454): a, c, t, g, unknown or other
  modified_base (456)..(456): a, c, t, g, unknown or other
  modified_base (458)..(458): a, c, t, g, unknown or other
  modified_base (467)..(467): a, c, t, g, unknown or other
  modified_base (487)..(487): a, c, t, g, unknown or other
  modified_base (489)..(489): a, c, t, g, unknown or other
  modified_base (491)..(491): a, c, t, g, unknown or other
  modified_base (499)..(499): a, c, t, g, unknown or other
  modified_base (501)..(501): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggtccgccaggctccgagggaaggggctggagtgggtctcagcaattaatgggtaggggtnattcaccatatacgcagactccggtgggggccgttcaccatcaccagagacaactccaggancacactatatcacaaatgccacagcctgagagtcgaggacacggtctgtattatgtgcgagagatcccaaaggtgacccactttggtntctttgnttntgtgcgagacgatgtcncgtctctcncncnccacacgcnctcgtcctccctcgccgccncncncacgcgcncncgacgcg

SEQ ID NO: 393703 - DNA, 587 bp, Homo sapiens
  misc_feature: GZ8MTXP02IZMYT.38.28.C06.1.454.CMB.2.raw
  modified_base (214)..(214): a, c, t, g, unknown or other
  modified_base (336)..(336): a, c, t, g, unknown or other
  modified_base (400)..(400): a, c, t, g, unknown or other
  modified_base (422)..(422): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaaggggctgggagtgggtctcagcaaattaagtgggtaggggtgattcaccatattacgcagactccggtgggggccgttcaccatcaccagagacaactccaggancacactatatctaacaaatgaccacagcctgagagtcgagggacacgggccgtgtaattattgngcgagagactccccgaaaggtnaccctacttgggtcttcgttttgattttccgtgttcggaccgtaagggactaagttcggaccacgttctcttcacgtccctacccgaaccgaacgggcccctaagttcccggtcccttcccccgtggacccgcccctgaacctcgacgacgccaccgccgagacg

SEQ ID NO: 393704 - DNA, 685 bp, Homo sapiens
  misc_feature: GZ8MTXP02GNCL9.38.28.C06.1.454.CMB.2.raw
  modified_base (329)..(329): a, c, t, g, unknown or other
  modified_base (335)..(335): a, c, t, g, unknown or other
  modified_base (342)..(342): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggatttaacctttagtgactatgccatgatcgtgggtccgccaggctccgaggggaaggggctggaggtgggtctcagctaaattaagtggggtaggggtgattcaccatattacgcagacgtccggtgggggccgttcaccatcaccaganacaacnccaggancacactatatactaacaaatgccaacacgcctagaagacggtacgagggaccacgggtccgttagttaatttagtggtacgacgaagaacgtactaccccggaaacgggtccgtaaaccccgtccgtttgggttacggttcctttttaggatttttccggtaggttacgggacccgtaaaggggacctaaggttcgggtacctaccggttcttcttaccgaccggtaccctacccgaaaccggtaacgggccccctaaggttccccgggtcccttcccccggtcgggccctcccccgtagcccttacccggaacggcggaccctacccgtcccgggaagaccg

SEQ ID NO: 393705 - DNA, 642 bp, Homo sapiens
  misc_feature: GZ8MTXP02HZTU8.38.28.C06.1.454.CMB.2.raw
  modified_base (214)..(214): a, c, t, g, unknown or other
  modified_base (268)..(268): a, c, t, g, unknown or other
  modified_base (327)..(327): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccagggaaggggctggagtgggtctcagcaattaatgggtaggggtnattcacatatacgcagactcggtgggggccgttcacatcaccagagacaactccaggancacactatatctaacaaatgaccacagcctagagagtcgaggacacggccgtagtattatgtgcgagagactacccgaaggtcgaccctaccgttggtgtcctttttagacttttcgtggtacggacccgtaaaggggtacctaaaggttcgggtacctaacccggttctttaccttacgacggtcccctaccccgaaacccggtaacggggtccccctaagttcccgggttcccctttcccccccggttgggcccctcccccgttggaaccccttccgaacgggccgaccctaccccgtaccggaacgacccgg

SEQ ID NO: 393706 - DNA, 689 bp, Homo sapiens
  misc_feature: GZ8MTXP02GSXVT.38.28.C06.1.454.CMB.2.raw
  modified_base (269)..(269): a, c, t, g, unknown or other
  modified_base (332)..(332): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtnatcacatatacgcagacgtccgggtgggggccgtcaccatccacagacgacaactcgaggacncactactatactactaacaaatcgacccacacgcctaggagacggtacggacggaccgacgggtccgttagttaatttagttggtaggacgaaggaacgtaccgtaccccggaaacgggttaccgaacccgttacccggtttgggttcgttcgtttttagtacgttttcgtggtacgggtaccgaaaggggtactaacggttcggtaccctaccgttcttccttacgaccgtccctacccgaacccggaaccgggcccctacgttcccgggttccccttcccccggtcgggccccgtccccgtacggtcccgtacccggaacggggaccgacccgtacccggtaccggaacggaccg

SEQ ID NO: 393707 - DNA, 559 bp, Homo sapiens
  misc_feature: GZ8MTXP02G3F1L.38.28.C06.1.454.CMB.2.raw
  modified_base (339)..(339): a, c, t, g, unknown or other
  modified_base (403)..(403): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatatctacaaatgcacagcctgagagtcgaggacacggcgtgtattatgtgcgagagactcccgaaacggtnacctaccttggtgtctttttgattttctggtggcccgaaaggggacaaagttcggtcaccgttntcttcagccctaccaccgaagggcccagtccggtccttcccccgtggcccgccctgcctcccgaggacgccacctccgagacgcacgacgccggcccgtgggcctcgcctggtcaaggctacgtcacgtgaacgtcgactcgacgcgggctggacg

SEQ ID NO: 393708 - DNA, 569 bp, Homo sapiens
  misc_feature: GZ8MTXP02IUH13.38.28.C06.1.454.CMB.2.raw
  modified_base (212)..(212): a, c, t, g, unknown or other
  modified_base (417)..(417): a, c, t, g, unknown or other
  modified_base (422)..(422): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctcgagggaanagccaccctctcctgcagggccagtcagagtgtttcaacggctactagctggtacagacaaaactgccaggcctccaggcctcctcatctatggtacatccgtcgacgggccacgtggtactcccgagacgtacggttcagtggcgtaggtgggtctggggacaggtacttcactctcacatcagcagacgtggagctagaagtntttgntagttgttattacgtgtacagtacaagtaatactacgaaacgtaccgttaactcgtttacggaccgtaacggggaacctaaaggacgtacggaacgaaaaccgtaaacgtaaacgtggtcgacgtacgaccacctactccgtttacg

SEQ ID NO: 393709 - DNA, 634 bp, Homo sapiens
  misc_feature: GZ8MTXP02FLINC.38.28.C06.1.454.CMB.2.raw
  modified_base (304)..(304): a, c, t, g, unknown or other
  modified_base (361)..(361): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcttttctgtggctattttaaaaggtgtccagtgtgaggtgcaggtgtcggagtctgggggaggcttggttcagcccgggggtcctgagactctcctgtgcagtctctggattaaccttagtgactatgccatgatctggggtcccncagctcgaggggaggctggagtgggtctcgagactaaagttaagtggggtaggggtntactcactatacttacgcgagacgtccggggtcgggggccgttacaccatccaaccgagaacgaaccaaccgtaccgaggacgacctaacactaatactactaaacaaagtcgacacacgacgtacgagacggtacggacggaacgaaccggaccggtacgttacgttagtttaggttacggtacggaacggaacgtaaccgtaacccgtaaaccggtaaccggtaacccgtaaccgttacggttacggtttacgttttacgtttacgtttcg

SEQ ID NO: 393710 - DNA, 605 bp, Homo sapiens
  misc_feature: GZ8MTXP02G64F5.38.28.C06.1.454.CMB.2.raw
  modified_base (270)..(270): a, c, t, g, unknown or other
  modified_base (295)..(295): a, c, t, g, unknown or other
  modified_base (332)..(332): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgcaggctccgaggggaagggctggagtgggtctcagcaattaagtgggtaggggtnattcaccatatacgcagactccggngggggccgttcaccatcaccagagacaactccaggancacactatatactacaaatgccacagcctgagaggtcgagggacacgggtcctagttattagtggtgcgagagactacccgaaggtcgacctaccgttggtcgttcttttgtactttcgttgttcggtacgtaagggacgtaagtacggtacgtaccggtccttccttctacgtcctacccgacccgaaccggacccgtaccgtcccggtcccgttcccccgttccgtcccgcccgtccgccgtccgacggacgccgacccgtccgacgaccg

SEQ ID NO: 393711 - DNA, 628 bp, Homo sapiens
  misc_feature: GZ8MTXP02F7RN2.38.28.C06.1.454.CMB.2.raw
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatgggtaggggtgattcaccatattacgcagactccggtgggggccgttcaccatcaccagagacaactccaggagcacactatatctaacaaatgcacagcctgagagtcgaggacacggccgtgtattattgtgcgagagatccccgaaaggtgaaccaccttggtgtctttttgattttctgttggccaaaggggactaagtggtccaccgttctcttcagccctccaccgaacgggcccagtccggtccttcccccgtggcccgtccctcgcctcccgaggacgcctacccgtccgacgacgaccacgacggccggcccgtcggggcctcggcccgttcgggtaccaaaacgggacccttaaaccgttccccgaaccggttcggaacgtttcccggaacgttcgggaacggggtcccggggtcgtacgggggaaccgg

SEQ ID NO: 393712 - DNA, 571 bp, Homo sapiens
  misc_feature: GZ8MTXP02JMXBJ.38.28.C06.1.454.CMB.2.raw
  modified_base (312)..(312): a, c, t, g, unknown or other
  modified_base (370)..(370): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttctgtggctaattttaaaaggtgtccagtgtgaggtgcaggtgtcggagtcgtgggggaggcttggttcgacggccccggggggtccctggagactctcctgtgcagtctctggattaaccttagtgactatgccatgatctgggtccnccaggcctccgaggggaagggctgggagtgggtctcagacaattaagtggtaggggtnattcacatattacgcagactccgggtgggggccttcacatcaccagacgacaactccgagacgacacactatatactaacgaaatgacaacagacctgaagaggtacgaggacgaacggtccgtagtagtttagtggtgcgaagacgtactaccccgaaaggtcgaaccctaccgttggtcgttcgttttagacttttcgg

SEQ ID NO: 393713 - DNA, 560 bp, Homo sapiens
  misc_feature: GZ8MTXP02F88YA.38.28.C06.1.454.CMB.2.raw
  modified_base (327)..(327): a, c, t, g, unknown or other
  modified_base (546)..(546): a, c, t, g, unknown or other
  modified_base (558)..(558): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccgccaggctccagggaagggctggagtgggtctcagcaattaatggtaggggtgattcacatattacgcagactccggtaggggccgttcaccatcaccagagacaactccaggancacactatatctaacaaatgcccacagcctgagagtcgaggacacgggcgtgtattagttgtagcgagagatcccgaacggtcgaccaccgttggtgtcttttagatttcgtgttggccgtaaagggacaagtggtccaccggttctacttcacgccctccaccgaacgggcccagtcccggttccttcccccgtgccgccctagccgtccgacggacnccaccgtccgancg

SEQ ID NO: 393714 - DNA, 573 bp, Homo sapiens
  misc_feature: GZ8MTXP02FR6T2.38.28.C06.1.454.CMB.2.raw
  modified_base (214)..(214): a, c, t, g, unknown or other
  modified_base (331)..(331): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgagggaaggggctggagtgggtctcagcaattaagtgggtaggggtgattcacatattacgcagactcggtgggggccgttcaccatcaccagagacaactccaggancaacactaatatctaacaaaatgacacagcctagagagtcgaggacacggcgtagtattatgtgcgagagatacccgaaggtgacccactttggtgtctttagatttctgtcggaccgaaagggacaaagtggactaccgtctcttcacgccctaccgaaccgaacggggtccccaagttcccggtccttcccccgtgggccctcccgtagccttccgacggacgcctaacccgccgagacg

SEQ ID NO: 393715 - DNA, 527 bp, Homo sapiens
  misc_feature: GZ8MTXP02FLDSP.38.28.C06.1.454.CMB.2.raw
  modified_base (267)..(267): a, c, t, g, unknown or other
  modified_base (329)..(329): a, c, t, g, unknown or other
  modified_base (417)..(417): a, c, t, g, unknown or other
  modified_base (430)..(430): a, c, t, g, unknown or other
  modified_base (515)..(515): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatggtaggggtnattcacatattacgcagactccggtgggggccgttcaccatcaccagagacaactccaggancacactatatctacaaatgccacagcctgagagtcgaggacacggccgtgtattatgtgcgagagatcccgaaggtgaccacgttggngtctttgatttcngtgccaagggacaagtgtccacgtctcttcagcctcactacggcccatccggtcttacccccgcgccgccctgccgtcgacggcnccaccgcgagcg

SEQ ID NO: 393716 - DNA, 559 bp, Homo sapiens
  misc_feature: GZ8MTXP02JT1CF.38.28.C06.1.454.CMB.2.raw
  modified_base (440)..(440): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtggggtctcagcaattaatgggtaggggtgattcaccatattacgcagactccggtgggggccgttcaccatcaccagagacaactccaggagcacactatatctaacaaatgaccacagcctgagagtcgaggacacggccgtgtattatgtgcgagagatacccaaggtcgacctaccgttggtgtcttttgatttcnggttcggacctaaggggacaagtggtacaccgtctcttcacgccctaccaccgaacgggcccagtccggtccttcccccgtggcccgccctgcctccgaggacgccaccgtcgacgacg

SEQ ID NO: 393717 - DNA, 560 bp, Homo sapiens
  misc_feature: GZ8MTXP02JJZ80.38.28.C06.1.454.CMB.2.raw
  modified_base (217)..(217): a, c, t, g, unknown or other
tcagtcgatcacgtcacgaccggtgctcgatttagagctcacgtattgggtttggggagagctctggagaagagctgctcagttaggacccagaaggaaccatggaaaccccagcgcagcttctcttcctcctgctactctggctcccagattccaccggagagattgtgttgacgcagtctccaggcaccctgtctttgtctccgaaggggaaagngccaccctctcctgcagggccagtcagagttgtttcaacggtctacttagcctggtaccagacaaaacctggccaggcctccaggcctcctcatctatggtacatcccgtcgacgggccacgtggtactcccagactacggttcagtgcaggtggtctgggacagacttcactctcacatcagcagactggagctagaagtatttgactagtgtattacgtgtctagcgtaagtataaccgtaacaacggtacctactaacgtttcggaaccgacggggaacctacggacgtacggaacgaaccgaaacgaacgtggtacggctacgacacgtactcgttacg

SEQ ID NO: 393718 - DNA, 598 bp, Homo sapiens
  misc_feature: GZ8MTXP02JPNS1.38.28.C06.1.454.CMB.2.raw
  modified_base (367)..(367): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcttttctgtggctattttaaaaggtgtccagtgtgaggtgcaggtgtcggagtctgggggaggcttggttcaggcccgggggtcctgagactctcctgtgcagtctctggattaacctttagtgactatgccatgatcgtgggtccgccaggcctccgaggggaagggctgggagtggggtctcgagcaagttaagtgggtaaggggtntatcactattactacgcacgtacgtccggggtcgggggtccgtacaccactaccacgagacgacaactccgaagcacaacactactactactaactaaatcgaccacgacgacctagacggacggtacgacggaccgacggtcgttagttacgtttagttgacggacgacggacgaccgtacccgtaacggtaacgaccgtacgttggtacgtttcgtttacgtactttcg

SEQ ID NO: 393719 - DNA, 514 bp, Homo sapiens
  misc_feature: GZ8MTXP02FK05U.38.28.C06.1.454.CMB.2.raw
  modified_base (347)..(347): a, c, t, g, unknown or other
  modified_base (358)..(358): a, c, t, g, unknown or other
  modified_base (418)..(418): a, c, t, g, unknown or other
  modified_base (431)..(431): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtagggtgattcaccatattacgcagactccggtgggggccgttcaccatcaccagagacaactccaggagcacactatatctacaaatgcacagcctgagagtcgaggacacggccgtgtattatgtgcgagagatcccaaaggtgaccacttggtnctttgatttcngtgccaagggcaatggtcacgtctcttcagccctcacagggcccatcggtctcccctgcnccctgctccaggncacctcgagagcacgagccggccctggggctcggcctggtcaaggactacttccacgtcgaatcgactcgagcgggctggacg

SEQ ID NO: 393720 - DNA, 569 bp, Homo sapiens
  misc_feature: GZ8MTXP02GKVE2.38.28.C06.1.454.CMB.2.raw
  modified_base (330)..(330): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggancacactatactactaacaaatgaccacacgctagagagtcgaggacacggtccgtagttattagttgcgagagagacacccgaacgtacgacctaccgttgtgtcgtttgtatttcttgtggacgaaggacgaagtagtcgaccgtctcttctacgtcctccaccgaacggaccgacgtccgtccgttcccgtccgtccgcctcgtccgtccgacggacgaccgaccgtaccgacgacg

SEQ ID NO: 393721 - DNA, 643 bp, Homo sapiens
  misc_feature: GZ8MTXP02HUWF4.38.28.C06.1.454.CMB.2.raw
  modified_base (299)..(299): a, c, t, g, unknown or other
  modified_base (491)..(491): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcgttttcttagtggcttaattttaaaaggtgtccagtgtgaggtgcaggtgtcggagtcgtgggggaggtctttgggttcgacggccccggggggtccctggaggactctcctgtgcagtctcgtggattaacctttagngactatgccatgatctcgggtccgccaggctccgaaggggaaggggcgtgggagtggggtctcgaggactaaagttaagtgggtaggggtagtatccgaactattacttacgcaagtacgtcccgggtcggggggtcccgttacaccatccaacagacgacacaccgagacgacaacactatactactaaanaactacacacgacgacgtagaacgacggacgacggaaccgtaccggtacgttagttaacgtttagttggtacgacggtaacgacgtaccgtaaccggacggtaaccgtaccgttacggtttcggttacgtttacgttttacggttactttcg

SEQ ID NO: 393722 - DNA, 653 bp, Homo sapiens
  misc_feature: GZ8MTXP02I63NH.38.28.C06.1.454.CMB.2.raw
  modified_base (214)..(214): a, c, t, g, unknown or other
  modified_base (267)..(267): a, c, t, g, unknown or other
  modified_base (328)..(328): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccagggaaggggctggagtgggtctcagcaattaatggtaggggtnattcacatatacgcagactccggtgggggccgttcaccatcaccagagacaactccaggancacactatatctacaaatgccacagcctgagagtcgagggacacgggcctgtattagtgtgcgagagactcccgaaaggtcgaacccaccgtttgggtacgtctttttgactttttccgtggttcggacccgtaaagggggaccctaaaggttcgggtacctaacccggttcttacctttacgaccggtcccttaccccgaaccgtaaacgggggtccccctaagttcccgggttacccctttccccccgcgggtaccccgtcccccgttaggccccttacccggaacgggtaccgccctaaccccgttcccggaaggaacccgg

SEQ ID NO: 393723 - DNA, 599 bp, Homo sapiens
  misc_feature: GZ8MTXP02I2HYQ.38.28.C06.1.454.CMB.2.raw
  modified_base (304)..(304): a, c, t, g, unknown or other
  modified_base (358)..(358): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagcgtggcttttctgtggctattttaaaaggtgtccagtgtgaggtgcaggtgtcggagtctgggggaggcttggttcagcctggggggtccctgagactctcctgtgcagtctctggattaaccttagtgactatgccatgatctgggtccncaggctccgagggaagggctggagtgggtctcgagcaattaagtggtaggggtntatcactatactcgcacgtacgtccgggtcgggggtccgtacactactcacgagacgacaacacgagacacactactatactactaaacaatcgacacgacgaccgtagacgtacggtacggacggaaccgacgggtacgttagttagtttacgttggtacgacggacgtaacgtaaccgtaacccggtaaccggtaccgtaaccgtaccggttacggttacgtttacgtttacgtttacg

SEQ ID NO: 393724 - DNA, 554 bp, Homo sapiens
  misc_feature: GZ8MTXP02IYMW3.38.28.C06.1.454.CMB.2.raw
  modified_base (280)..(280): a, c, t, g, unknown or other
  modified_base (303)..(303): a, c, t, g, unknown or other
  modified_base (364)..(364): a, c, t, g, unknown or other
  modified_base (411)..(411): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttctgtggctatttaaaaggtgtccagtgtgaggtgcaggtgtcggagtcgtgggggagcttggttcaggcccggggggtcctgagactctcctgtgcagtctctggattaacctttagngaatatgccatgatctgggtccnccaggctccgaggggaaggggctgggagtggggtctcaggctaattaagtgggtaggggtnatttcaaccatacttacgcagacctccgggtgggggcccgttcaccntcacagagacactccagcgcacactatatctaaacaaatgacacagaccctgagagtcgaggacacgggctagtattatgtcgacgagacgactcccgaaacggtcgaccctaaccgtttggtcgtcttttacggtattttcg

SEQ ID NO: 393725 - DNA, 570 bp, Homo sapiens
  misc_feature: GZ8MTXP02IIYB8.38.28.C06.1.454.CMB.2.raw
  modified_base (256)..(256): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctggagtgggtctcagcaattaangggtaggggtgattcaccatatacgcagactccggtgggggccgttcaccatcaccagagacaactccaggagcacactatatctaacaaatgccacagcctgagagtcgaggacacggccgtagtattatgtgcgagagactcccgaaaggtcgaaccctaccgtttggtcgtcttttgaattttcgtggtcggaccgtaaaggggactaagtcggtacaccgttctcttcgagccctaccaaccgaacgggcccagtccggtccttcccccgtggcccgtccctgcctccgacggcgcctacctcgacgacg

SEQ ID NO: 393726 - DNA, 547 bp, Homo sapiens
  misc_feature: GZ8MTXP02JUF5I.38.28.C06.1.454.CMB.2.raw
  modified_base (338)..(338): a, c, t, g, unknown or other
  modified_base (442)..(442): a, c, t, g, unknown or other
  modified_base (478)..(478): a, c, t, g, unknown or other
  modified_base (483)..(483): a, c, t, g, unknown or other
  modified_base (495)..(495): a, c, t, g, unknown or other
  modified_base (533)..(533): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctggagtgggtctcagcaattaatgggtaggggtgattcaccatattacgcagactccggtgggggccgttcaccatcaccagagacaactccaggagcacactanatctaacaaatgccacagcctgagagtcgagggacacgggcctagtattatgtgcgagagactcccgaaaggtcgacctaccgttggtgtcttttgattttcgnggtcggacgaaggactagtcgtaccacgttctctcnctccncacgacggcccngtccgtccctcccgcgccctccgcgccgtccgacggcnccaccgtcgacgcg

SEQ ID NO: 393727 - DNA, 659 bp, Homo sapiens
  misc_feature: GZ8MTXP02HW30W.38.28.C06.1.454.CMB.2.raw
  modified_base (470)..(470): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatatctacaaatgcacagcctgagagtcgaggacacggccgtgtattatgtgcgagagatccccgaaacggtcgacctacctttgggtgtacctttttgatttttctggtcggcccgaaaggggtacaaagtcgggtaccaccgttctcttcacgccctaccaccgaacgggcccagttcccggtccttcccccgtgggcccncccgtcgtcctacccgacgggtacgccctaaccgtcccggaacgacgaccaaccgacggcccgggcccccgttggggcccgttcggaccccgttcggggtaccgaaacggggtaacccttaccgttacccgtaaccggttacgaaccgttacgaaccgttgggaacggtcccgggcgttcgggaaccgg

SEQ ID NO: 393728 - DNA, 709 bp, Homo sapiens
  misc_feature: GZ8MTXP02J27UX.38.28.C06.1.454.CMB.2.raw
  modified_base (280)..(280): a, c, t, g, unknown or other
  modified_base (305)..(305): a, c, t, g, unknown or other
  modified_base (322)..(322): a, c, t, g, unknown or other
  modified_base (327)..(327): a, c, t, g, unknown or other
  modified_base (363)..(363): a, c, t, g, unknown or other
tcagtcgatcacgtcacgaccggtgctcgatttagagctcacgtattgggtttggggagctctgagagaggagcccagccctgggatttcaggcgttttcatttggtgatcaggactgaacagagagaactcaccatggagtttgggctgagcgtggtcttttcttagtggctattttaaaaggtgtccagtgtgaggtgcaggtgtcggagtctgggggagcttggttcagcccgggggtcctgagactctcctgtgcagtctctggattaaccttagngactatgccatgatctggggtcccncgaggctcgagggaggngtggngtgggtctcgagactaaagttagtgggtacggggtntactccactatacgttacgcgaacggtaccggttccgggggtcgggggtcccgttaccaaccgtactacccgaaaccgaaggaacgtaaacccaaacccgtacccgaacgggggaaccacctaaaccgtaaaccgttaattaacttaacctaaactaaaacggtacgaccgaccgaccgtaccgtacggacggacggtacggaacgggaaccggaccgggtaccggttacggttaacgtttagtttaggtacggtacggacggaacgtaaccgtaccccgtaacccgggtaaccggtaacccgtaccgttacggttacggtttaccgttttacgtttacgtttacg

SEQ ID NO: 393729 - DNA, 580 bp, Homo sapiens
  misc_feature: GZ8MTXP02FYAI5.38.28.C06.1.454.CMB.2.raw
  modified_base (269)..(269): a, c, t, g, unknown or other
  modified_base (455)..(455): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtaggggtnattcacatatacgcagactcggtgggggccgttcaccatcaccagacgacaactccaggagcacactatatctaacaaatgccacagctgagagtcgagggaccacgggccgtgtatttagttggtgcgagagactaccccgaaacggtcgaccctaccgtttgggtcttcgttttgattttccgnggttcggacccgaaaggggtaccaagtggtccaccgttctcttcacgtccctccaaccgaacgggcccagtccggtccttcccccgcgcccgcccgtcgccgtccgacggcaccaccgcgacgcg

SEQ ID NO: 393730 - DNA, 556 bp, Homo sapiens
  misc_feature: GZ8MTXP02IIU5T.38.28.C06.1.454.CMB.2.raw
  modified_base (279)..(279): a, c, t, g, unknown or other
  modified_base (353)..(353): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaggtgtccagtgtgaggtgcaggtgtcggagtcgtgggggagcttggttcaggcccgggggtcctgagactctcctgtgcagtctctggattaaccttagngactatgccatgatctgggtccgccaggcctaccgaggggaaggggctgggagtgggtctcgagctaattaagnggtaggggtgattcgaccattattacgcagtacgtccgggtagggggcccgttcaccatcaccagacgacaactccgaggagcaacactatatactaacaaatcgacacagcctggaacagtcgaggacacggcgtagtattagttgtagacgaagcgactacccaaggtcgaaccgtaccttggtcgttctttgtactttcg

SEQ ID NO: 393731 - DNA, 563 bp, Homo sapiens
  misc_feature: GZ8MTXP02JNZTG.38.28.C06.1.454.CMB.2.raw
  modified_base (270)..(270): a, c, t, g, unknown or other
  modified_base (333)..(333): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtnattcaccatattacgcagactccggtgggggccgttcaccatcaccagagacaactccaggancacactatatctaacaaatgaccacagcctgagagtcgaggacacgggcctagtattatgtgcgagagactccgaaggtcgacctaccgttggtcgtctttgatttcgtggttggacccgaagggactaagtcggtcctaccgtctccttcacgtccctaccaaccaacggcccagtccggtccttccccgtggccctccctgcctcgaacggcgccaccgtcgaacgcg

SEQ ID NO: 393732 - DNA, 535 bp, Homo sapiens
  misc_feature: GZ8MTXP02FZY2D.38.28.C06.1.454.CMB.2.raw
  modified_base (271)..(271): a, c, t, g, unknown or other
  modified_base (367)..(367): a, c, t, g, unknown or other
  modified_base (393)..(393): a, c, t, g, unknown or other
  modified_base (436)..(436): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatanctaacaaatgcacagcctgagagtcgaggacacggccgtgtattatgtgcgagagatccccaaacggtgaaccaccttggtgctttttgattttcngtggccaaggggcaatggtcaccgtntcttcagccctcaccaagggcccatccggtctccccctggccnccctgctccaggcgccacctccgagacgcacgacgccggccccgtgggctcgcctggtcaaggactacttccacgtgaatcgactgacgcggctggacg

SEQ ID NO: 393733 - DNA, 687 bp, Homo sapiens
  misc_feature: GZ8MTXP02JOIYH.38.28.C06.1.454.CMB.2.raw
  modified_base (158)..(158): a, c, t, g, unknown or other
  modified_base (181)..(181): a, c, t, g, unknown or other
  modified_base (258)..(258): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgngtttctagtggctatttaaaggngtcagtgtgaggtgcaggtgtcggagtctgggggaggcttggttcagcccggggggtccctgagactctcctgtgcngtctctgtattaacttagtgtactatgcatgtagtcgtcggtccgccgacggccgtaccgacggggaaggggacggtagggtaggtgggtcgtcgacgtacgtaagttaagtagggtacggggtaggtacgttacctacctactaacgttaacgtcgtacgtaccggtaccggggttccgggggtccgggttaccgtaccgtacgtaccgaccgaacgaacgaacgaaccgtaccgacggacgacaacaactactactactaactaaactacgacacgacgaccgtacgacggacggtacggacggacgaccggtaccggtacgttaacgtttagttacggtacggtacggtaacggtacgtaacgtaccgtaaccggtaaccggtaacccgtaccgttacggttcggttacgtttacgttacgtttcg

SEQ ID NO: 393734 - DNA, 597 bp, Homo sapiens
  misc_feature: GZ8MTXP02H6BM5.38.28.C06.1.454.CMB.2.raw
  modified_base (184)..(184): a, c, t, g, unknown or other
  modified_base (263)..(263): a, c, t, g, unknown or other
  modified_base (296)..(296): a, c, t, g, unknown or other
  modified_base (299)..(299): a, c, t, g, unknown or other
  modified_base (474)..(474): a, c, t, g, unknown or other
tcagtcgatcacgtcacgaccggtgctcgatttagagctcacgtattgggtttgggagctctgagagaggagcccagccctgggattttcaggcgttttcatttggtgatcaggactgaacagagagaactcaccatggagtttgggctgagcgtggtcttttctagtggctaattttaaaggngtccagtgtgaggtgcgaggtgtcggagtgtggggaggcgttggttcgacggccggggtccgtcgagactctctgtgcngtctctgtattaccttagtagtactaatgccanagntcgtcggtcggccgacgcgccgacgggaagggcggtggaggtggtgtcagagtaataagtaggtagggtagtagtactacactattaacgcgacgtaacgtaccggttcgggggtccgggttaccgaccgacaccgacaacgacgacaacaccgacgacgacacaacctactaanacttaaccaaaacacacacacgacgagagacgacgacgacgacgtacgtagtacgtagtagtacgtacgacgacgacgtacgacgtaacgtacgtacgtacgtcgttcgtttacgttacgtcg

SEQ ID NO: 393735 - DNA, 529 bp, Homo sapiens
  misc_feature: GZ8MTXP02GC2TQ.38.28.C06.1.454.CMB.2.raw
  modified_base (214)..(214): a, c, t, g, unknown or other
  modified_base (446)..(446): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctgcagggccagtcagagtgttttcaacggctacttagctggtaccagacaaaacctggccaggcctcccaggctcctcatctatggtacatccgtcagggccactggtatccccagacaggttcagtgcagtgggtctggggacagacttcactctcaccatcagcagactggagctagaagtatttgactagtgtattactgtcagcagtatactaanaacgaccgtatacgtttcggaccgaaggggaccaggactacggacgaaccaaacgaactggtgacgtcgaccacactcttacg

SEQ ID NO: 393736 - DNA, 561 bp, Homo sapiens
  misc_feature: GZ8MTXP02JOWQ4.38.28.C06.1.454.CMB.2.raw
  modified_base (287)..(287): a, c, t, g, unknown or other
  modified_base (311)..(311): a, c, t, g, unknown or other
  modified_base (353)..(353): a, c, t, g, unknown or other
  modified_base (389)..(389): a, c, t, g, unknown or other
  modified_base (430)..(430): a, c, t, g, unknown or other
  modified_base (458)..(458): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcgttttctaggtggctaattttaaaaggtgtccagtgtgaggtgcaggtgtcggagtcgtgggggaggcttggttcaggcccggggggtcctgagactctcctgtgcagtctctggattaaccttagngactatgccatgatcgtgggtccnccagggctccgaggggaacgggctgggagtggggtctcgagntaattaagtgggtaggggtctattcactatattacnaagctccgggtgggggccttcacatacaccagacgactacnccaggacacaccatatatactaacaaanacacacacgacagagacgacgacgacgacgacgtagtacgttagtgtcgacgacgacgacgtaccgacgaacgacgtacgtcgtcgttcgtttcgttacttcg

SEQ ID NO: 393737 - DNA, 591 bp, Homo sapiens
  misc_feature: GZ8MTXP02HLMDH.38.28.C06.1.454.CMB.2.raw
  modified_base (331)..(331): a, c, t, g, unknown or other
  modified_base (341)..(341): a, c, t, g, unknown or other
  modified_base (414)..(414): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcgagcaattaagtgggtaggggtgattcaccatattacgcagactcggtggggccgttcacatcacagagacaactccaggancacactatanactaacaaatcgaccacagcctgagagtcgagggacacggcctgtattatgtgcgagagactcccgaacggtnacctaccttgggtatcttttgacttttcgtgtggaccgaaggggtacaagtggtccaccggttctcttcgacgtccctcccgaaccgaacggggcccctagtcccgggttcccttccccccgtgggccccgtccctcggcccgtcccgacgggaccgaccacccgtaccggagaccg

SEQ ID NO: 393738 - DNA, 535 bp, Homo sapiens
  misc_feature: GZ8MTXP02H65SH.38.28.C06.1.454.CMB.2.raw
  modified_base (302)..(302): a, c, t, g, unknown or other
  modified_base (455)..(455): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccaccctctcctgcagggccagtcagagtgtttcaacggctacttagcctggtaccagcaaaacctggccaggctcccaggctccncatctatggtacatccgtcagggccactggtatcccagacaggttcagtggcagtgggtctggggacaggacttcactctcaccatcagcagactggaggctagaagtatttgctagtgtattactgtcagacagtatactacaagaccgtanacgttttcggccgtaggggaccaaaggctacgggacgaacccgaaaacgaacctgtaggctacggacaccctatcgttcg

SEQ ID NO: 393739 - DNA, 631 bp, Homo sapiens
  misc_feature: GZ8MTXP02F1KQQ.38.28.C06.1.454.CMB.2.raw
  modified_base (214)..(214): a, c, t, g, unknown or other
  modified_base (272)..(272): a, c, t, g, unknown or other
  modified_base (402)..(402): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaaggggctgggagtgggtctcagcaattaagtgggtaggggtnattcaccatattacgcagacgtccggtgggggccgttcaccatccaaccagacgacaactccaggagcacactatatactaacaaatgaccacacgctagagacgtcgaggacacggtcgtgtattatgngcgagagactacccgaacggtcgaaccctaccgttggtcgttcgttttagacttttcgtggtacgggtaccgaaaggggtacctaaaggttcgtaccctaccgtcttcgttacacgtccctaccgaaccgaacgggtcccctacgttcccgggttcccttcccccggtcggcccgtccccgttcgcccgttacccgacggaccgtacccacccgtaccggacgaaccgg

SEQ ID NO: 393740 - DNA, 537 bp, Homo sapiens
  misc_feature: GZ8MTXP02FJK7Z.38.28.C06.1.454.CMB.2.raw
  modified_base (212)..(212): a, c, t, g, unknown or other
  modified_base (410)..(410): a, c, t, g, unknown or other
  modified_base (427)..(427): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtcttgtctccaggggaanagccacctctcctgcagggccagtcagagtgtttcaacggctacttagcctggtaccagacaaaactggccaggctcccaggctcctcatctatggtacatccgtcagggccacgtggtactccagacacggttcagtggacaggtgggtctggggaccagacttcactctcaccatcagcagactggagctgaagtntttgcagttgtattacngtacagcagtaatactaacaacgaccgtaactacgtttcggacgtacgggggaacctaaaggcctagggaacgaaaccgaaacgaactgtaggctacgcactactcttcg

SEQ ID NO: 393741 - DNA, 625 bp, Homo sapiens
  misc_feature: GZ8MTXP02GJ7V8.38.28.C06.1.454.CMB.2.raw
  modified_base (285)..(285): a, c, t, g, unknown or other
  modified_base (312)..(312): a, c, t, g, unknown or other
  modified_base (383)..(383): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttctgtggctattttaaaaggtgtccagtgtgaggtgcaggtgtcggagtcgtgggggaggcttggttcacggcccgggggtcctggacgactctcctgtgcagtctctggattaaccttagngactatcgcctatgatcgtcgggtccnccgaggccgtccggaaggggaaggggtctggggaggtcgggtctacgagactaaattagtgggtaggggtnattcactatacttacgcagacgtcgggtcgggggccgttcacgtataccacagacgaacaaccgtccgaaggacactaacgaacttactactacctaaacaaatcggaacacgtagccctagaagacggtacgacggacgacggtcgttagtaaacgttgttagcggacgtaaagacgtaaccgttacccgaaacggttcggaacccttacgttgggtactttcggttttagacttttcggg

SEQ ID NO: 393742 - DNA, 656 bp, Homo sapiens
  misc_feature: GZ8MTXP02H6RUL.38.28.C06.1.454.CMB.2.raw
tcagtcgatcacgtcacgaccggtgctcgatttagagctcacgtattgggtttggggaggcttggttcagcctggggggtccctgagactctcctgtgcagtctctggattaacctttagtgactatgccatgatctgggtccgccaggctccaggggaaggggctgggagtgggtctcagcaattaatgggtaggggtgattcaccatattacgcagactccggtgggggccgttcaccatcaccagagacaactccaggagcacactatatctaacaaatgcaacagcctgagagtcgaggacacggcctgtattattgtgcgagagactcccgaaacggtcgaacctaccgtttggtacgtcctttttaggatttttccgtggttcggcccgaaaagggggtacctaaagttcgggtaccaaccccggttcttcctttccacgccccttacccaacccgaaacggggcccctaacgttcccgggtccctttccccccgtcgggcccgtccccgttgcccttcccgacgggtacgcccaccgtcccgagacgcaccgacggccggcccgtcgggcctcggccgtgggtacaaacgggaccttaccgttcccgtacgtcgtaacgtccggactggacgccggggcgtacgggacg

SEQ ID NO: 393743 - DNA, 595 bp, Homo sapiens
  misc_feature: GZ8MTXP02HIE2G.38.28.C06.1.454.CMB.2.raw
  modified_base (284)..(284): a, c, t, g, unknown or other
  modified_base (301)..(301): a, c, t, g, unknown or other
  modified_base (308)..(308): a, c, t, g, unknown or other
  modified_base (488)..(488): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggttgagctggtctttttcttgtggctaattttaaaaggtgtccagtgtggaggtgcaggtgtcggagtcgtgggggagcttggttcaggcccgggggtcctgagactctcctgtgcagtctctggattaaccttagngactatgccatgatcgngggtccncaggctccgaggggaagggctggaggtgggtctcgagcaaaagttaagtggggtaggggtctattccgacctattacttacgcagaccgtccgggtcggggggtcccttacacccatccaaacccgagaacgaacaaacctccgaaagggacacctaacaactaatacttacaaacaaanacgacacacgacgagagacgacgacggacgacgacgtagtattatgtgacgagacgacgaccgaacgacgaaccgtacgtacgtcgttcgtttcgttacgttacgtg

SEQ ID NO: 393744 - DNA, 656 bp, Homo sapiens
  misc_feature: GZ8MTXP02JM797.38.28.C06.1.454.CMB.2.raw
  modified_base (305)..(305): a, c, t, g, unknown or other
  modified_base (360)..(360): a, c, t, g, unknown or other
tcagtcgatcacgtcacgaccggtgctcgatttagagctcacgtattgggtttgggctgagctggcttttcttgtggctatttttaaaaggtgtccagtgtgaggtgcaggtgtcggagtctgggggaggcttggtttcagcctgggggggtcccctgagactctcctgtgcagtctctggattaacctttagtgactatgccatgatctggtccgcaggctccagggaagggctggagtgggtctcagcaaattaatgggtaggggtgattcaccatattacgcagactccgtgggggccgttnaccatcaccagagacaactccaggagcacactatatctacaaatgaccaagcctnagagtcgaggcacggccgtgtattattgtgcgagagactcccgaacggtgaaccctaccttgggtgtccgtttttgaactttttccgtgtttacgggacccgtaaaggggacctaaagtcgggttccaaccccgtttcttaccctttcaacggtaccccttaccccgaaccaaaaccgggggccccctaagtttcccggggtttccctttccccccccgtcgggtccccggtccccctcggcccttaacccgacgggtacggacccaccccgttacccggaacggaacggaacccg

SEQ ID NO: 393745 - DNA, 568 bp, Homo sapiens
  misc_feature: GZ8MTXP02JVF1N.38.28.C06.1.454.CMB.2.raw
  modified_base (534)..(534): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtgattcaccatattacgcagactccggtgggggccgttcaccatcaccagacgacaactccaggagcacactatatctaacaaatgaccacagcctagagagtcgaggacacggcctgtattagttgtgcgagagactcccgaaacggtgaccaccgttggtgtctttgatttcgtgtaggaccaagggactaagtggtacaccgtcttcgttcagtccctaccgaaccgaacgggcccagtccggttcccttcccccgcgggcccncccgtgcctccgaggacgccaccgtccgagaccg

SEQ ID NO: 393746 - DNA, 579 bp, Homo sapiens
  misc_feature: GZ8MTXP02FXMNK.38.28.C06.1.454.CMB.2.raw
  modified_base (260)..(260): a, c, t, g, unknown or other
  modified_base (271)..(271): a, c, t, g, unknown or other
  modified_base (308)..(308): a, c, t, g, unknown or other
  modified_base (320)..(320): a, c, t, g, unknown or other
  modified_base (326)..(326): a, c, t, g, unknown or other
  modified_base (340)..(340): a, c, t, g, unknown or other
  modified_base (446)..(446): a, c, t, g, unknown or other
  modified_base (452)..(452): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaangggtaggggtnattcacatatacgcagcgtcgggtcggggcctcacancacagacacacncgagancacatatatacaanaatcgaccacacgctagagacgacggacggaccgacgggtcgttagttattagttggcgacgagacgtactaccgaacggtcgaccgtcgttggtcttctttagtntttcgnggtacggacgtaaggactaagtcgtcctaccgttctctcacgtcccaccgaacgaccggcctacgttcccgtcccttcccgcgccctcccgtcgcctaccggacggaccgacccaccgtcgacgacg

SEQ ID NO: 393747 - DNA, 546 bp, Homo sapiens
  misc_feature: GZ8MTXP02JCK7B.38.28.C06.1.454.CMB.2.raw
  modified_base (307)..(307): a, c, t, g, unknown or other
  modified_base (414)..(414): a, c, t, g, unknown or other
  modified_base (451)..(451): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagctggctttttctgtggctattttaaaaggtgtccagtgtgaggtgcaggtgtcggagtcgtgggggaggcttggttcaggccgtggggggtccctgagactctcctgtgcagtctctggattaaccttagtgactatgccatgatctgggtccnccaggctccgaggggaaggggctgggagtggggtctcagcaattagtggtaggggtgattcacgatattcgcagactccggtgggggtccgtcaccgatcaccaganacaactccaggtagcacactatatctaacaatgacanacgcctgacgagtacgaggacacggccgtagtattatgtgacgagacgactaccgaacggtcgaaccctacgttggtacgttccgtttagttacg

SEQ ID NO: 393748 - DNA, 592 bp, Homo sapiens
  misc_feature: GZ8MTXP02IKEBR.38.28.C06.1.454.CMB.2.raw
  modified_base (333)..(333): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctgggagtgggtctcagcaattaagtgggtaggggtgattcacatattacgcagactccggtgggggccgttcaccatcaccagagacaactccaggancacactatatctaacaaaatgacccaacagcctagagagtacgaggggacacggtccgtgtaattagtgtgacgagagactacccgaacggtcgaccctaccgttggtcgtcttttagattttcgtgtacggaccaaggggacaagtggtcctaccgtctcttcacgccctccgaccgaacgggccctacgtcccggttcctcccccgtcgggccctccgtcgtccgtccgaacggacgaccgacccgtaccgagaccg

SEQ ID NO: 393749 - DNA, 537 bp, Homo sapiens
  misc_feature: GZ8MTXP02IQD2D.38.28.C06.1.454.CMB.2.raw
  modified_base (212)..(212): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgctccaggggaanagccacctctcctgcagggccagtcagagtgtttcaacggctacttagcctggtaccagacaaaacctggccaggcctcccaggcctcctcatctatggtacatccgtcacgggccactggtatcccagacaggttcagtgcagtgggtctggggacagacttcactctcaccatcagcagactggagctgaagtatttgctaaggttgtatttacgtgtacagacagttataactagaacgaccgtatacgtttggaccgagggggacctaagcgtagggacaaaccgaacgaaacgtgtacggactgacctaccagtcttacg

SEQ ID NO: 393750 - DNA, 516 bp, Homo sapiens
  misc_feature: GZ8MTXP02GIOZJ.38.28.C06.1.454.CMB.2.raw
  modified_base (214)..(214): a, c, t, g, unknown or other
  modified_base (300)..(300): a, c, t, g, unknown or other
  modified_base (391)..(391): a, c, t, g, unknown or other
  modified_base (442)..(442): a, c, t, g, unknown or other
  modified_base (445)..(445): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctgcagggccagtcagagtgtttcaacggctacttagcctggtaccagcaaaacctggccaggctccagctccncatctatggtacatccgtcagggccacgtggtactcccagacaggtcagtggcaggtgggtctggggacagacttcactctcaccatcaancagactggagctagaagatttgcagtgtattactgtcagcaagtatactanaanaccgtatactttgccgtaggggaccaaagctaggacaacccaaagaaactggtagactgactaccatctcg

SEQ ID NO: 393751 - DNA, 564 bp, Homo sapiens
  misc_feature: GZ8MTXP02IEIGJ.38.28.C06.1.454.CMB.2.raw
  modified_base (280)..(280): a, c, t, g, unknown or other
  modified_base (303)..(303): a, c, t, g, unknown or other
  modified_base (349)..(349): a, c, t, g, unknown or other
  modified_base (359)..(359): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtctgggggaggcttggttcagcccggggggtccctgagactctcctgtgcagtctctggattaccttagngactatgccatgatctgggtccnccaggctccgaggggaagggctggagtggggtctcagcaattaagnggtaggggtnattcaccatattacgcagactccgggtgggggcccggttcaccgatccgaccagagacaaactcccgaggacgcaacactatatcctaaacgaaatcgacacagccctgagagtcgaggcacgggcctagtacttatgtagcgtagacgacttccccgaaagggtcgaacccctacgtttcggggtctttcgtttagtactttcg

SEQ ID NO: 393752 - DNA, 538 bp, Homo sapiens
  misc_feature: GZ8MTXP02HW3GR.38.28.C06.1.454.CMB.2.raw
  modified_base (411)..(411): a, c, t, g, unknown or other
  modified_base (421)..(421): a, c, t, g, unknown or other
  modified_base (504)..(504): a, c, t, g, unknown or other
  modified_base (509)..(509): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaagggctggagtgggtctcagcaattaatgggtaggggtgattcaccatattacgcagactccgtgggggccgttcaccatcaccagagacaactcaggagcacactatatctaacaaatgcccacagcctgagagtcgaggacacggccgttagtattatgtgcgagagatcccaaaggtnaccacttggngtctttgatttctgtggaccaagggacaagtggtcacgtctactcagccctacaccaacgggcccagtccggtcttcccccgnggccnccctgcctcaggactcaccctcgacgacg

SEQ ID NO: 393753 - DNA, 577 bp, Homo sapiens
  misc_feature: GZ8MTXP02FY543.38.28.C06.1.454.CMB.2.raw
  modified_base (258)..(258): a, c, t, g, unknown or other
  modified_base (268)..(268): a, c, t, g, unknown or other
  modified_base (331)..(331): a, c, t, g, unknown or other
  modified_base (394)..(394): a, c, t, g, unknown or other
  modified_base (535)..(535): a, c, t, g, unknown or other
  modified_base (541)..(541): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaanggtaggggtnattcaccatattacgcagactccggtgggggccgttcaccatcaccagagacaactccaggancacactatatctaacaaatgccacagcctgagagtcgaggacacggccgtgtattattgtcgngagagactacccaaacggtcgaacccaccgtttggtgtcttttagattttctggtggacccgaaaggggactaagtggtaccaccgttctctttacacgccctaccgaacgaaacgggcccagtccggtcctttcccccgnggcccnccccgttagcctccgaaggcgccacccgccgagacg

SEQ ID NO: 393754 - DNA, 609 bp, Homo sapiens
  misc_feature: GZ8MTXP02FTOGJ.38.28.C06.1.454.CMB.2.raw
  modified_base (273)..(273): a, c, t, g, unknown or other
  modified_base (335)..(335): a, c, t, g, unknown or other
  modified_base (350)..(350): a, c, t, g, unknown or other
  modified_base (599)..(599): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggggtccgccaggctccgaggggaaggggctggagtgggtctcagctaattaagtgggtaggggtnattcacatattacgcagacgtccggtgggggccgtcaccatcaccagagacaactccaggancacactatatctaanaaatgccacagcctagagagtcgaggacacggcgtgtattatgtgacgagagactacccaaacggtgaccctaccgtttggtcgttctttttagactttttcgtggtacgggaccgaaaggggtacctaaaggttcgggtacctaccggtcttccttcgacgtccctacccgaacccgaaacgggccccctagttcccggttccttcccccgtcggccctccccgtcgccgtccgaaggccgcctaccnccggagaccg

SEQ ID NO: 393755 - DNA, 645 bp, Homo sapiens
  misc_feature: GZ8MTXP02JXEA8.38.28.C06.1.454.CMB.2.raw
  modified_base (269)..(269): a, c, t, g, unknown or other
  modified_base (320)..(320): a, c, t, g, unknown or other
  modified_base (327)..(327): a, c, t, g, unknown or other
tcagtcgatcacgtcacgaccggtgctcgatttagagctcacgtattgggtttgggctgagcgtgcgtttctagtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtgggtctcagcaattaatgggtaggggtnatcacatatacgcagacgtccgggtgggggccgtcacatcacagagacacncgaggancacatatatactaacaaatcgaccacagcctaggagtaggtacggaggaccgacgggtcgttagttaatttagttggcggacgaaggaacgtacctaccccgaaacgggtccgaacccgtaccgtttgggtcgttcgtttttagtactttcgttcggttcggtacggaacgggaacgtaacgtacggtaccgtaccgtccgttcgttacgtacgtacctacccgaacccgaaccggacccgtaccgtccggttcccgttccccgtccggtcccgtcccgtccgtccgtccgacggacgaccgacccgtaccgacgacg

SEQ ID NO: 393756 - DNA, 547 bp, Homo sapiens
  misc_feature: GZ8MTXP02FLT0X.38.28.C06.1.454.CMB.2.raw
  modified_base (269)..(269): a, c, t, g, unknown or other
  modified_base (539)..(539): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtaggggtnattcaccatattacgcagactccggtgggggccgttcaccatcaccagagacaactccaggagcacactatatctacaaatgccacagcctgagagtcgaggacacggccgtgtattatgtgcgagagactcccaacggtgacccaccgttggtgtcttttgatttctggtggccaagggacaagtggtcaccgtctcttcacgcctccaccaacgggcccagtccggtccttcccccgtggcccgccctgcctcccgaggacgccaccnccgagacg

SEQ ID NO: 393757 - DNA, 598 bp, Homo sapiens
  misc_feature: GZ8MTXP02J2O2K.38.28.C06.1.454.CMB.2.raw
  modified_base (285)..(285): a, c, t, g, unknown or other
  modified_base (307)..(307): a, c, t, g, unknown or other
  modified_base (366)..(366): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggcttttctagtggctattttaaaaggtgtccagtgtgaggtgcaggtgtcggagtcgtgggggagcttggttcaggcccgggggtcctggagactctcctgtgcagtctcgtggacttaacctttagngactatgccatgatctggtccncaggctccgagggagggctgggacgtgggtctcgagctaaagttagtggtaacggggtntatacactatacgtacgcgacgtaccggtccggggtcgggggtccgtacaaccgtacgaccgaaccgaagaacgtaaccaaccgtccgaggacactaacaactataactactaaacaagtacgacacacgacgagagacgacggacggacgacgtacgtagttacgttagtgtcgacgacgacgacgtaccgacgtaacgtaccgtacgtcgtcgttcgtttcgtacgttcg

SEQ ID NO: 393758 - DNA, 524 bp, Homo sapiens
  misc_feature: GZ8MTXP02FP5UN.38.28.C06.1.454.CMB.2.raw
  modified_base (304)..(304): a, c, t, g, unknown or other
  modified_base (328)..(328): a, c, t, g, unknown or other
  modified_base (342)..(342): a, c, t, g, unknown or other
  modified_base (352)..(352): a, c, t, g, unknown or other
  modified_base (354)..(354): a, c, t, g, unknown or other
  modified_base (362)..(362): a, c, t, g, unknown or other
  modified_base (386)..(386): a, c, t, g, unknown or other
  modified_base (393)..(393): a, c, t, g, unknown or other
  modified_base (423)..(423): a, c, t, g, unknown or other
  modified_base (436)..(436): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccgccaggctccagggaaggggctgggagtgggtctcagcaaattaatgggtaggggtgattcacatattacgcagactccgtgggggccgttnaccatcacagagacaatccaggancacactatatcaanaaatgcacancngagagagnggacgacggcgtgtattattgtgngagaganaccaacgagacaccttgtgtctttgtattntgtgacgaagganaatagtcgacgtctctcacgctccaccaacggaccgactcgtccttcccctccgccgccgcgcgtccacgacgacaccaccgacgacg

SEQ ID NO: 393759 - DNA, 576 bp, Homo sapiens
  misc_feature: GZ8MTXP02GJGEM.38.28.C06.1.454.CMB.2.raw
  modified_base (414)..(414): a, c, t, g, unknown or other
  modified_base (447)..(447): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatgggtaggggtgattcaccatattacgcagactccggtgggggccgttcaccatcaccagagacaactccaggagcacactatatctaacaaatgccacagcctgagagtcgaggacacgggcctgtattattgtgcgagagataccccgaaagggtnacccaccgtttgggtcgtctttttgattttcgnggttcggccgaaaggggacaagttcggtccaccggttctcttcacgtccctaccaccgaacggggccccagttccggtcccttcccccgtggcccgtccctgcctcccgaaggcgcacccgtcgaagcg

SEQ ID NO: 393760 - DNA, 615 bp, Homo sapiens
  misc_feature: GZ8MTXP02HZI7O.38.28.C06.1.454.CMB.2.raw
  modified_base (183)..(183): a, c, t, g, unknown or other
  modified_base (219)..(219): a, c, t, g, unknown or other
  modified_base (260)..(260): a, c, t, g, unknown or other
  modified_base (500)..(500): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtgtttctaggtggctattttaaaggngtcagtgtgaggtgcaggtgtggagtgtggggaggngttggttcgaggccgggggtcccgtgagactctcctgtgcngtctcgtgtattacgttagtgtactatcgcatagtagtcgtcggtccgccgacgccgaccggacggggaaggggacggtggtaggtgggtcgtacgagacgtaaagttaaggtaggtagggtagtagtactactaatagttacgtcgacgtacgtccgggtcggggtccggtaccgacctactaccaacgaagaacgaacgaaccgacgacggacgacaacaactatactactaacaaanacacacacgacgtagagacggacggacggaacgacggtacgtagttacgttagttgtcgacgacgacgacgtaccgacgtaacgaccgtacgtcgtcgttcgtttcgttacttcg

SEQ ID NO: 393761 - DNA, 559 bp, Homo sapiens
  misc_feature: GZ8MTXP02IDHFM.38.28.C06.1.454.CMB.2.raw
  modified_base (308)..(308): a, c, t, g, unknown or other
  modified_base (426)..(426): a, c, t, g, unknown or other
  modified_base (443)..(443): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagcgtggcgttttctagtggctattttaaaggtgtccagtgtgaggtgcaggtgtcggagtctgggggaggcttggttcagccgtggggggtccctgagactctcctgtgcagtctctggattaacctttagtgactatgccatgatcgtgggtccncaggctccaggggaggggctggagtgggtctcagcaattatgggtaggggtgattcacatattacgcagaccgtcggtggggggccggttcaccatcaccagagacaactccagggancacactatatcctaaanatgacacacgctagagagtacgaggaccgtcggcgttagttattgttcggtacgacgacgacgtacgtaccgtaacggtacgtaccgtaccgttacggttcgttcgtttacgttcg

SEQ ID NO: 393762 - DNA, 582 bp, Homo sapiens
  misc_feature: GZ8MTXP02F9YDQ.38.28.C06.1.454.CMB.2.raw
  modified_base (310)..(310): a, c, t, g, unknown or other
  modified_base (439)..(439): a, c, t, g, unknown or other
  modified_base (447)..(447): a, c, t, g, unknown or other
  modified_base (470)..(470): a, c, t, g, unknown or other
  modified_base (516)..(516): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgttttctaggtggctaattttaaaaggtgtccagtgtgaggtgcaggtgtcggagtcgtgggggaggcttggttcaggcccggggggtcctgagactctcctgtgcagtctctggattaaccttagtgactatgccatgatcgtgggtccnccaggctccgaggggagggctgggagtgggtctcgagctaaattaagtggggtaggggtctattcacctatacttacgcaaagcgtccggggtggggggtcccgttcacccatccaccagacgaacacnccgaggcncacactatactactaacaaatanacacacgccagagagacgacggacgacggcgtggtattattgtcgngacgagacgtaccgaccggtaacgaccgtaacccgttcggtcggtttcgtttacgtttacgtttcg

SEQ ID NO: 393763 - DNA, 530 bp, Homo sapiens
  misc_feature: GZ8MTXP02FJSVW.38.28.C06.1.454.CMB.2.raw
  modified_base (213)..(213): a, c, t, g, unknown or other
  modified_base (360)..(360): a, c, t, g, unknown or other
  modified_base (365)..(365): a, c, t, g, unknown or other
  modified_base (439)..(439): a, c, t, g, unknown or other
  modified_base (441)..(441): a, c, t, g, unknown or other
  modified_base (447)..(447): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagcgtgcgttttctagtggctattttaaaaggtgtccagtgtgaggtgcaggtgtcggagtntgggggagggcttggttcagcctgggggtcccgtgagactctcctgtgcagtctctggataacctttagtgactatgccatgatctggtcgccaggctccaggaaggggcgtggagtgggtcgtcagcaataatgtaggggtgattnaccanattacgcagacgtccgtgggggcgggttcgaccatcaccagagacaacaccagagcacactatatctaaacaananacacanctgagagtacgagacgacgacgtacgtattatgtgacgagacgacgaccgaacggacgaccgtacgttcgtcgtcgtttcgtg

SEQ ID NO: 393764 - DNA, 580 bp, Homo sapiens
  misc_feature: GZ8MTXP02GO0BC.38.28.C06.1.454.CMB.2.raw
  modified_base (199)..(199): a, c, t, g, unknown or other
  modified_base (351)..(351): a, c, t, g, unknown or other
  modified_base (364)..(364): a, c, t, g, unknown or other
  modified_base (482)..(482): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccgagggaaggggctggagtgggtctcagcaattaatggtaggggtnattcaccatattacgcagactccggtgggggccgttcaccatcaccagagacaactccaggagcacactatatctacaaatgcacagcctgagagtcgaggacacggccgtgtattatgtgcgagagatcccgaaaggtgacctacttggtntcttttgatttcngtggccaagggacaagtggtcacgtctcttcacgccctaccaccgaacgggccctacgtccggtcccttcccccgtggcccgccctgcctccgaggcgccacccgtccgagacgcacncggccggcccgtgggcctcgccgtggtaccgaaacggtaccttaccgtacccgaacggttcgaacgtccgacgtcggacggcgggccgtagggaccgg

SEQ ID NO: 393765 - DNA, 560 bp, Homo sapiens
  misc_feature: GZ8MTXP02HU7NH.38.28.C06.1.454.CMB.2.raw
  modified_base (215)..(215): a, c, t, g, unknown or other
  modified_base (331)..(331): a, c, t, g, unknown or other
  modified_base (341)..(341): a, c, t, g, unknown or other
  modified_base (364)..(364): a, c, t, g, unknown or other
  modified_base (369)..(369): a, c, t, g, unknown or other
  modified_base (389)..(389): a, c, t, g, unknown or other
  modified_base (396)..(396): a, c, t, g, unknown or other
  modified_base (528)..(528): a, c, t, g, unknown or other
  modified_base (543)..(543): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcaggcctggggggtccctgagactctcctgtgcagtctctggattaacctttagtgactatgccatgatctgggtccnccaggctccaggggaaggggctggagtgggtctcagcaattaatgggtaggggtgattcacatattacgcagactcggtgggggccgttcaccatcaccagagacaactccaggancacactatanctaacaaatgaccacagcctganagtgngacacggcctgtatatttgngagaganactaccgaacggtcgacctacgttggtgttctttagtatttcgtggtacgacgaaggactagtcgtaccaccgtctctcacgtccctaccaacgacggccctagtcccgtccttccccgcgccgtcccgtcnccgtccgacggaccnccctaccgtcgacgacg

SEQ ID NO: 393766 - DNA, 601 bp, Homo sapiens
  misc_feature: GZ8MTXP02FGLKD.38.28.C06.1.454.CMB.2.raw
  modified_base (212)..(212): a, c, t, g, unknown or other
  modified_base (266)..(266): a, c, t, g, unknown or other
  modified_base (328)..(328): a, c, t, g, unknown or other
  modified_base (332)..(332): a, c, t, g, unknown or other
  modified_base (390)..(390): a, c, t, g, unknown or other
tcagtcgatcacgtcacgaccggtgctcgatttagagctcacgtattgggtttgggctgagcgtggcttttctgtggctattttaaaaggtgtccagtgtgaggtgcaggtgtcggagtctgggggaggcttggttcagcctgggggtccctgagactctcctgtgcagtctctggattaacctttagtgactatgccatgatctgggtccnccaggctccagggaaggggctggagtgggtctcagcaattaatgggtaggggtnattcacatattacgcagactccggtgggggccgttcaccatcaccagagacaactccaggancaanactatactctaacaaatgcccacagcctgagagtcgagacacggcgtgtattattggngagagagactaccgacggtcgacctacgttggtcgttctttagtatttcgtggtacggaccgaagggtactaagttcggtacctaccgttctcgttacgaccgtccctacccgaaccgaacggtcccctacgttcccggttcccttcccccggtcgggcccgtcccgtacgcccgtaccgacggaccgtaccctaccgtaccggacgaccg

SEQ ID NO: 393767 - DNA, 555 bp, Homo sapiens
  misc_feature: GZ8MTXP02GITSL.38.28.C06.1.454.CMB.2.raw
  modified_base (430)..(430): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttctgtggctattttaaaaggtgtccagtgtgaggtgcaggtgtcggagtcgtgggggaggcttggttcaggcccggggggtcctgagactctcctgtgcagtctctggattaaccttagtgactatgccatgatcgtgggtccgccaggctccgaggggaaggggcgtgggaggtggggtctcagcaaattaagtggggtacggggtgattcgaaccattattacgcagacgtccgggtgggggccgttcaccatcaccagacgacacncgagagcacactatatactaacaaatcgacacacgcctagagagtacgaggacacgggcgtgtattattgtcgacgagacgactaccgacggtcgaccctacgttggtcgtctttgtactttcgg

SEQ ID NO: 393768 - DNA, 603 bp, Homo sapiens
  misc_feature: GZ8MTXP02GL6CY.38.28.C06.1.454.CMB.2.raw
  modified_base (158)..(158): a, c, t, g, unknown or other
  modified_base (185)..(185): a, c, t, g, unknown or other
  modified_base (313)..(313): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgngttttctaggtggctattttaaaaggngtcagtgtgaggtgcaggtgtcggagtctgggggaggcttggttcaggcccggggggtccctggagactctcctgtgcagtctctggattaaccttagtgactatgccatgatctggtccgccaggcnccaggaaggggcgtggagtgggtcgtcagcaataagtggtagggtggatcaccatattacgcagaacgtccggtcgggggccgggttcgaccacacaccgagacgaacaacacccgagacgacaacacctaatactacttaacctaaaatacacacgacgacgacgacgacgacggacggaccgacggtacgtacgttacgttagttaggtacgtacggtaacgacgtaccgtaccgtaaccggtaaccgtaccgtacgttacgttcgttacgtttacgtttacgtttcg

SEQ ID NO: 393769 - DNA, 575 bp, Homo sapiens
  misc_feature: GZ8MTXP02GPHR9.38.28.C06.1.454.CMB.2.raw
  modified_base (330)..(330): a, c, t, g, unknown or other
  modified_base (426)..(426): a, c, t, g, unknown or other
  modified_base (442)..(442): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaagtggtaggggtgattcaccatattacgcagactccggtgggggccgttcaccatcaccagagacaactccaggancacactatatctacaaatgccacagcctgagagtcgaggacacgggccgtagtattattgtgcgagagactcccgaaaggtcgaccaccgtttggngtcttttgattttcgnggttggcctaaaggggacctaagttgggtaccaccggttctcgttcagcccctccaccgtaacgggccccagttcccggtccttcccccgtggcccgcccctgcctcccgaggacgccacccgtccgacgacg

SEQ ID NO: 393770 - DNA, 620 bp, Homo sapiens
  misc_feature: GZ8MTXP02GGE2T.38.28.C06.1.454.CMB.2.raw
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccaggggaaggggctgggagtgggtctcagcaattaatggtaggggtgattcaccatattacgcagactccggtgggggccgttcacatcaccagagacaactccaggagcacactatatctaacaaatgcacagcctgagagtcgaggacacggccgtgtattatgtgcgagagactcccgaacggtcgaacctacgttggtgtctttttagacttttcgtggttcgggccgaaaggggacaaagttggtaccaccgttctccttccacgtccctaccgaacccgacggccctacgtcccggttccctcccccgtcggcccgtccctcgccctaccgacggaccgcccgtacccgtcgaacgagacccgacgacggcccggccggtcggcctcgcccgtggaccgaaacggtcctaccgtaccgacgtacgaacgtcgacgtacggcggccgggtcgtacgggacgg

SEQ ID NO: 393771 - DNA, 621 bp, Homo sapiens
  misc_feature: GZ8MTXP02HTI9Y.38.28.C06.1.454.CMB.2.raw
  modified_base (271)..(271): a, c, t, g, unknown or other
  modified_base (325)..(325): a, c, t, g, unknown or other
tcagtcgatcacgtcacgaccggtgctcgatttagagctcacgtattgggtttgggctgagcgtggcgttttctgtggctattttaaaaggtgtccagtgtgaggtgcaggtgtcggagtctggggggaggcttggttcagcctgggggggtccctgagactctcctgtgcagtctctggattaacctttagtgactatgccatgatctgggtccgccaggctccaggggaaggggctggagtgggtctcagcaattaatgggtaggggtnatcacatatacgcagacgtccgggtcgggggccgttcaccatcacagacacacncaggacacacactatatactaacaaagtcgacccacacgcctaggaggacgtacgggacgggaaccgaccgggtccgttagttaatttagttgcgacgaagacgacctacccgaacggtccgaccctaccgtttggtcgttacttttgtactttcgtggtacggaccgtaagggactagtcgtcctaccgttcttctcgacgtcctaccaccgaccggaccgtaccgtccgttcccgttccccgtccggccgtcccgtccgtccgtccgacggacgaccgacccgtaccgacgacg

SEQ ID NO: 393772 - DNA, 509 bp, Homo sapiens
  misc_feature: GZ8MTXP02ITFZV.38.28.C06.1.454.CMB.2.raw
  modified_base (224)..(224): a, c, t, g, unknown or other
  modified_base (501)..(501): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccaccctntcctgcagggccagtcagagtgtttcaacggctacttagcctggtaccagacaaaacctggccaggctcccaggcctcctcatctatggtacatccgtcagggccactggtactccccagacaggttcagtggcagtggtctggggacaggacttcactctcaccatcagcagactgggagctgaagtatttagctagtgttattactgtcagcagtatactacaagacttacacgtttggcagggaccaaggctgacgaccaagaactgtgctcgnaccatctg

SEQ ID NO: 393773 - DNA, 653 bp, Homo sapiens
  misc_feature: GZ8MTXP02JHEO2.38.28.C06.1.454.CMB.2.raw
  modified_base (302)..(302): a, c, t, g, unknown or other
  modified_base (399)..(399): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggaggtcgtttgggttcgacgggccccggggggtccctgacggactctccctgtgcagtctcgtggtacttaaccgtttagngactatgccatcgatcgtggtccgccagggcctaccggaggggtaacggggcgtgggaggttcggggtctcgagactaaagttagtgggtaggggtnagtcacctattaacgttcgctacggaccgttccggggtcgggggtacccgttcaaccgtatacccgaacgacggaacgaaccaaccgtcccgaaggacgacctaactactaactatacctaaacaaagtcgacacacggcctagaggacggtacggaacgcgtacggccgttagttaacgttagtggtacgagtaacgacgtaccgtaccgaaacggtcgtaacctaccggttgtcgttctttagtactttcgg

SEQ ID NO: 393774 - DNA, 563 bp, Homo sapiens
  misc_feature: GZ8MTXP02GQ532.38.28.C06.1.454.CMB.2.raw
  modified_base (371)..(371): a, c, t, g, unknown or other
  modified_base (443)..(443): a, c, t, g, unknown or other
  modified_base (459)..(459): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggctttttcttgtggctattttaaaaggtgtccagtgtgaggtgcaggtgtcggagtctgggggaggcttggttcaggccgtggggggtccctgagactctcctgtgctagtttctggtattaacctttagtgactatgccatgatcgtgggtccgccaggcctccgaggggaaggggctgggagtggggtctcgagcaattagtggtaggggtnattcgacatattacgcagacgtccggtggggggcccgttcaccatcacctagacgacaacctcccgaggacncacactatatactaanaaatcgacacagcctagagagtcgaggacacggcgtagtacttagttgtgcgagacgacgtacccgaggtcgaccctacgttacggcgttcgtttcgattttcg

SEQ ID NO: 393775 - DNA, 634 bp, Homo sapiens
  misc_feature: GZ8MTXP02IUGYP.38.28.C06.1.454.CMB.2.raw
  modified_base (214)..(214): a, c, t, g, unknown or other
  modified_base (267)..(267): a, c, t, g, unknown or other
  modified_base (330)..(330): a, c, t, g, unknown or other
  modified_base (356)..(356): a, c, t, g, unknown or other
  modified_base (393)..(393): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgagggaagggctggagtgggtctcagcaattaatggtaggggtnattcacatattacgcagactccggtgggggcccgttcaccatcaccagagacaactccaggancaacactatatctaacaaatgaccanagcctgagacgtcgaggacacggcctgttattattgngacgagagactaccccgaacggtcgaaccctaccgtttgggtacgtcgtttttagacttttcgtggttcggacccgtaaaaggggacctaaaggttcggtaccgtaaccgttcttacgttccagtcccctaccgaacccgtaacggggcccccaaggttcccgttcccgttcccccgtcggggcccctccccgtggtcccgtacccgaagggtaccgccctaacccgtccgaacggaaccg

SEQ ID NO: 393776 - DNA, 623 bp, Homo sapiens
  misc_feature: GZ8MTXP02JPLTW.38.28.C06.1.454.CMB.2.raw
  modified_base (283)..(283): a, c, t, g, unknown or other
  modified_base (309)..(309): a, c, t, g, unknown or other
  modified_base (376)..(376): a, c, t, g, unknown or other
  modified_base (487)..(487): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgtttctaggtcggctaatttaaaggtgtcagtgtgaggtgcaggtgtcggagtgtgggggagtcttggttcaggcccgggggtcctgacgctctcctgtgcagtctctggtacttaaccttagnactatgcctatgactcgtcgggtccnccgaggtcctaccggaggggaaggcgtgggagtgggtctcgagacgtaagttagtagggtacgggtntacttacacctattacgttacgcgacggtaccgtccggggtcgggggtccgttacacctacgtacaaccagaccgacacgccaggacacaactactactattaccgtaaanaacacgacacacgacgtacgacgacgtacggacggacgacgtacgtacgttacgttagttagtacgtacgtacgtacgtaccgtaccgtacgtaaccgtaccgtacgttacgttacgttcgtttacgttacgttcg

SEQ ID NO: 393777 - DNA, 612 bp, Homo sapiens
  misc_feature: GZ8MTXP02JDVYE.38.28.C06.1.454.CMB.2.raw
  modified_base (215)..(215): a, c, t, g, unknown or other
  modified_base (262)..(262): a, c, t, g, unknown or other
  modified_base (273)..(273): a, c, t, g, unknown or other
  modified_base (287)..(287): a, c, t, g, unknown or other
  modified_base (333)..(333): a, c, t, g, unknown or other
  modified_base (596)..(596): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgaggggaaggggctgggagtgggtctcagcaattaagngggtaggggtnattcacatatacgnagactcggtgggggccgttcaccatcacagacgacaactccaggancaacactatactctaacaaatcgaccacgagccctaggagacgtcgaggaccacgggcctagtatttagtgtacgcgagagactacccgaacggtcgaccctaccgtttgggtacgttcgtttttagattttcgtggttcgggacccgtaaaggggtaccaagttcggtacctaccggttctccttacgacgtccctaccgaaccgaacgggcccctagtcccggtccttcccccgtggcccgccctacgcctcgacggaccnccgacctacggacgcg

SEQ ID NO: 393778 - DNA, 678 bp, Homo sapiens
  misc_feature: GZ8MTXP02HG7SZ.38.28.C06.1.454.CMB.2.raw
  modified_base (214)..(214): a, c, t, g, unknown or other
  modified_base (271)..(271): a, c, t, g, unknown or other
  modified_base (369)..(369): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgagggaaggggctggagtgggtctcagctaattaagtgggtaggggtnattcaccatattacgcagactccggtgggggcccgttcaccatcaccagagacaactccaggagcacactatatctaacaaatgaccacagcctgagngtcgaggacacggccgttgtattagtgtgcgagagtactcccgaacggtcgaaccctaccgtttgggtcgttccgtttttggactttttcgtcgggttcgggaaccccgaaaagggggtacaaacggttcggggttacccaacccggttccttccgtttaccaacggtccccctacccgaaaccccgtaaaaccgggggccccctacggttccccgggttcccctttccccccggtcgggtccccgtcccccgttaggccccgttacccgaacggggtacgcccacccccggtaccggaacgaacccgg

SEQ ID NO: 393779 - DNA, 684 bp, Homo sapiens
  misc_feature: GZ8MTXP02H0S5Y.38.28.C06.1.454.CMB.2.raw
  modified_base (219)..(219): a, c, t, g, unknown or other
  modified_base (275)..(275): a, c, t, g, unknown or other
  modified_base (340)..(340): a, c, t, g, unknown or other
tcagtcgatcacgtcacgaccggtgctcgatttagagctcacgtattgggtttgggctgagctggcttttttcttgtggctattttaaaaggtgtccagtgtgaggtgcaggtgtcggagtctggggggaggcttggttcagccgtggggggtccctgagactctcctgtgcagtctctggatttaacctttagtgactatgccatgatcgtgggtccncaggctcgaggggaagggctggagtgggtctcagactaattaagtgggtaggggtnattcactatatacgcagacgtccgggtgggggccgttcaccatcaccagacgacaactcgagganacacactatactactaacaaatcgaccacacgcctagagagtacgagggacacggtccgtagttattagtgtgacgagacgactacccgaacggtcgaccctaccgtttggtcgttactttttgacttttcgtggtacggtaaccgaaaggggtacctaaaggttcgggtacctaacccggttctttaccgtacgaccggtcccctacccgaaaccggtaaaccggggtcccccttaaccgggtttcccccgttacccccgttccccggtccgggtacccccgttacccgtaccgtcccgtaccggacgggacccctacccgtacccggtaccggaaacgcccg

SEQ ID NO: 393780 - DNA, 588 bp, Homo sapiens
  misc_feature: GZ8MTXP02IHAKV.38.28.C06.1.454.CMB.2.raw
  modified_base (215)..(215): a, c, t, g, unknown or other
  modified_base (269)..(269): a, c, t, g, unknown or other
  modified_base (329)..(329): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgagggaagggctggagtgggtctcagcaattaatgggtaggggtnattcacatatacgcagactccggtgggggccgttcaccatcaccagagacaactcaggancacactatatactaacaaatgaccacagcctagagagtcgaggacacggccgttagtaattgtgtgcgtaagagactacccgaagggtcacctaccgttggtacgtcttttagactttcgtggtcggaccgtaaagggacctaagtcggtaccaccgttctacgttcaacgtccctaccaacccgtaacgggcccctagtccggttcccttcccccgtggccctccctgccctcgacggacgccacccgtcgacgaccg

SEQ ID NO: 393781 - DNA, 533 bp, Homo sapiens
  misc_feature: GZ8MTXP02J21FD.38.28.C06.1.454.CMB.2.raw
  modified_base (447)..(447): a, c, t, g, unknown or other
tcagtcgatcacgtcacgaccggtgctcgatttagagctcacgtattgggtttgggggaggcttggttcagcctggggggtccccgagactctcctgtgcagtctctggattaacctttagtgactatgccatgatctgggtccgccaggctccagggaaggggctggagtgggtctcagcaattaatggtagggtgattcaccatattacgcagactccgtgggggccgttcaccatcaccagagacactccaggagcacactatatctacaaatgcacagcctgagagtcgaggacacggccgtgtattatgtgcgagagatcccaaacggtgacccacctttggtcgctttttgatttctgtggccaggggacaatggtcaccgtctcttcagcctccaccaagggcccatcggtccttccccctggccgccctgctccagganccaccctccgagacgcacagccggccctggggctgcctggtcaacggactacttccacgtgatcgactgacggcggctggcaacgg

SEQ ID NO: 393782 - DNA, 536 bp, Homo sapiens
  misc_feature: GZ8MTXP02JHMYM.38.28.C06.1.454.CMB.2.raw
  modified_base (213)..(213): a, c, t, g, unknown or other
  modified_base (268)..(268): a, c, t, g, unknown or other
  modified_base (442)..(442): a, c, t, g, unknown or other
  modified_base (511)..(511): a, c, t, g, unknown or other
  modified_base (514)..(514): a, c, t, g, unknown or other
  modified_base (521)..(521): a, c, t, g, unknown or other
  modified_base (524)..(524): a, c, t, g, unknown or other
  modified_base (526)..(526): a, c, t, g, unknown or other
  modified_base (529)..(529): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgagggaaggggctggagtgggtctcagcaattaatgggtaggggtnattcaccatatacgcagactccggtgggggccgttcaccatcaccagagacaactccaggagcacactatatctaacaaatgccacagcctgagagtcgaggacacgggccgtgtattatgtgcgagagactacccgaaacggttgaccctacgttggtgtcttttgattttcngttggccaagggcaagtggccacgtctcttcacgcctcacacgggcccagtccgtccttccccgcgccnccngccacgngcncnccncgacgcg

SEQ ID NO: 393783 - DNA, 665 bp, Homo sapiens
  misc_feature: GZ8MTXP02GCZKF.38.28.C06.1.454.CMB.2.raw
  modified_base (272)..(272): a, c, t, g, unknown or other
  modified_base (308)..(309): a, c, t, g, unknown or other
  modified_base (316)..(316): a, c, t, g, unknown or other
  modified_base (321)..(321): a, c, t, g, unknown or other
  modified_base (327)..(327): a, c, t, g, unknown or other
  modified_base (341)..(341): a, c, t, g, unknown or other
tcagtcgatcacgtcacgaccggtgctcgatttagagctcacgtattgggtttgggctgagcgtggcgttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccgccaggctccgaggggaaggggctggagtgggtctcagcaattagtgggtaggggtntatcactatatacgcagacgtcggtggggcctcacnncacaganacacncgagancacatatatacaanaatcgaccacgacgctagagacgtacggacggaccgacggtcgttagttagtttagtgtagacgaagacgtaccgtacccgaacggtaccgacccgtaccgttggtcgttcgtttagtacgttttcgtcgggtacggtacggtaaacggactaaggttccgtaccgtaccgttcttaccgttaccgaccgtaccccgtaaccgaacccggaaccggtaccccttacggtccccggtttacccccttcccccggtacgggccccgtaccccgtcgtaacccgtacccggtaacgggacccaccccgtacccgtaccggaacgacg

SEQ ID NO: 393784 - DNA, 554 bp, Homo sapiens
  misc_feature: GZ8MTXP02JJFIO.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctacagggccagtcagagtgttttcaacggctactagcctggtaccagcaaaacctggcaaggctcccaggctcctcatctatggtacatccgtcagggcccactggtactcccagacgtaggtccagtggcaggtggtcgtgggacagtacttcgactctacaccatcagcacgacgtggacggtctagaaagttatttgactagttagttattacgtagtcgagtctaagtactactaacaacgtaccgtactacgtttacggaccgtacggggacaaggcgtaggacgaacgaaaacgactggcgctacgacactatctcgttac

SEQ ID NO: 393785 - DNA, 553 bp, Homo sapiens
  misc_feature: GZ8MTXP02HAVVG.38.28.C06.1.454.CMB.2.raw
  modified_base (335)..(335): a, c, t, g, unknown or other
  modified_base (363)..(363): a, c, t, g, unknown or other
tcagtcgatcacgtcacgaccggtgctcgatttagagctcacgtattgggtttggggaggcttggttcagcctgggggtccccgagactctcctgtgcagtctctggattaacctttagtgactatgccatgatctgggtccgccaggctccagggaagggctggagtgggtctcagcaattaatggtagggtgattcaccatattacgcagactccgtgggggccgttcaccatcaccagagacaactccaggagcacactatatctaacaaatgcacagcctgagagtcgaggacacggccgtgtattattgtgcgagagatccccaaaggtnaccaccttggtcgtctttttgattttcngtggccaggggacaatggtcaccgtctcttcacgcctccacaacgggcccagtcggtcctcccccgtggccgccctgcctccaggcgcacctccgagacgcacacgccggccctgggctcgccgtggtacaaacgggtacctacgttccgaacgttcgaactcgacgtggacggcggcctggacaacggg

SEQ ID NO: 393786 - DNA, 691 bp, Homo sapiens
  misc_feature: GZ8MTXP02GSC95.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggaggcttgggttcacgggcccggggggtccctggacgactctcctgtgcagtctcgtggtactttaaccttagtgactatcgccatgatcgtcggtccgccagggcctaccggaggggacggggcgtggggaggttgggtctcgagacgtaagttaaaggtggggtagggtgattacgaacattacttacgcgtacggtacggtccggggtcgggggtcccgttacgacctacgtaccaaccgaagaacgaaccctaaaccgaccgaacggacgaccaacctaacttaactaactacctaaactaaatcgacaaccgacgacccgaggacggacggtacgggaaacggaccggaccgggtaccgttagttaacgtttagttcggaggtacgaaggacgtaaccgtacccggtaaacggtaaccgtacccgttaccggtttggttccgttcgttttacgttacgttttcgg

SEQ ID NO: 393787 - DNA, 560 bp, Homo sapiens
  misc_feature: GZ8MTXP02GE1OP.38.28.C06.1.454.CMB.2.raw
  modified_base (433)..(433): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggaggcttggttcaggcccgggggtccctggagactctcctgtgcagtctctggattaacctttagtgactatgccatgatcgtgggtccgccaggctccgaggggaagggctggagtgggtctcagactaagtaagtggtaggggtgattcgacctatacttacgcagacgtccgggtgggggccgttcacgactcacagacgacaactccgagngacaccatatactctaaacaaatcgacacagcctgacgagtccgagacgacggacgttagtagttatgtcgacgagacgactccccgaaaggtcgacctacgtttgggcttacgtttgtacttttcg

SEQ ID NO: 393788 - DNA, 566 bp, Homo sapiens
  misc_feature: GZ8MTXP02FOK9S.38.28.C06.1.454.CMB.2.raw
  modified_base (305)..(305): a, c, t, g, unknown or other
  modified_base (364)..(364): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctaattttaaaaggtgtccagtgtgaggtgcaggtgtcggagtctgggggaggcttggttcaggcccgggggtcctgagactctcctgtgcagtctctggattaaccttagtgactatgccatgatcgtggtccnccaggcctccgaggggagggctgggagtgggtctcgagacaattaagtgggtaggggtnattcacctatattacgcagacgtccgggtgggggccgttcaccgatccaccagacgacaaacgtccgaaggacgtacacaactatactactaaacaaatcgacactagcctagagagtcgaacggacacggtctagtactagttgcgtacgagacgactcccgaaaggtcgaccctaccgttggtcttcgtttagactttcg

SEQ ID NO: 393789 - DNA, 675 bp, Homo sapiens
  misc_feature: GZ8MTXP02HOPZ9.38.28.C06.1.454.CMB.2.raw
  modified_base (272)..(272): a, c, t, g, unknown or other
  modified_base (312)..(312): a, c, t, g, unknown or other
  modified_base (324)..(324): a, c, t, g, unknown or other
  modified_base (330)..(330): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctggagtgggtctcagcaattaagtgggtaggggtntattcacatatacgcagcgtcgggtcggggtccgtcacancacagacacacncgagancacatatatacaacaatcgacccacgcgctaggagacggtcgacgggaccgacggtccgttagttaatttagttgagacgagaacgtaccgtaccccgaacggtaccgacccgttaccgtttggttacgtttcgttttagttacgttttcgtcgggttacggaacggtaaagggtaacgtaacggttcggtacccgtaccgttcttaccgttaccgaccgtccccgtacccgtaacccggtaaccgggtcccctaccggttcccggttcccccgtttccccgtccgggccccgtccccgtcgtaacccgtccggacggaccgacccgtacccgtaccgacgaccg

SEQ ID NO: 393790 - DNA, 647 bp, Homo sapiens
  misc_feature: GZ8MTXP02IMHVZ.38.28.C06.1.454.CMB.2.raw
  modified_base (369)..(369): a, c, t, g, unknown or other
  modified_base (481)..(481): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcagggtgtcggagtctgggggaggcttgggttcaggcccggggggtccctgagactctcctgtgcagtctctggattaaccttgtgactatgccatgatcgtggtccgccaggcctccgaggggaaggggctgggaggtgggtctcgagactaagttaagtggtaggggtnattcacctatattacgcgagtacgtcccggggtcgggggtcccggttacacctagtcccaaccaggaacaaccaaactcccgaaggacgacaacgaactatattacctaaanaaaacgtgaccaacgtagaccccttggaagacggtacgaaacgggacctaacggggccgttaggttaactttagttggtcgaccggtaaagacggtaacctcccccgtaaaaggggtccgaaaccccgttaccgtttggggttacgtcctttttaggacttttcgg

SEQ ID NO: 393791 - DNA, 583 bp, Homo sapiens
  misc_feature: GZ8MTXP02GRYJY.38.28.C06.1.454.CMB.2.raw
  modified_base (365)..(365): a, c, t, g, unknown or other
  modified_base (438)..(438): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagcgtggcttttctgtggctatttaaaggtgtccagtgtgaggtgcaggtgtcggagtctgggggaggcttggttcagccgtggggggtccctgagactctcctgtgcagtctctggattaaccttagtgactatgccatgatcgtgggtccgccaggctccgaggggagggcgtgggaggtgggtctcgagcaaagttagtggggtaggggtntattcacagttattacgcagtaccgtccgggtgggggccgttcaccgatccaccagacgacaactccaggacncacactatatactaacaatgacacgacgccgtagagagcgaggaccgacggccgttagtatttagttgtcgacggagacgacgttacccggaaacggtttccggaaaccctaccggtttgggtactttccgtttttacggtttcg

SEQ ID NO: 393792 - DNA, 594 bp, Homo sapiens
  misc_feature: GZ8MTXP02FVWYN.38.28.C06.1.454.CMB.2.raw
  modified_base (331)..(331): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatgggtaggggtgattcaccatattacgcagactccggtgggggccgttcaccatcaccagagacaactccaggancacactatatctaacaaatgaccacagcctagagagtcgaggacacggcgtgtattatgtgcgagagactacccgaaggtgacccacgttggtgtcttttgattttcgtggtcggtaccgaaagggactaagttcggtaccacccggttctctttaccgacgtccctacccgaccgaaacggggtcccctaagtcccgggttccctttcccccgtggcccgccccgtcgccctacccgaggaccgccacccgtccggagaccg

SEQ ID NO: 393793 - DNA, 542 bp, Homo sapiens
  misc_feature: GZ8MTXP02F5UCU.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctgcagggccagtcagagtgtttcaacggctacttagcctggtaccagcaaaacctggccaggctcccaggctcctcatctatggtacatccgtcagggccactggtatcccagacaggttcagtggcagtggggtctggggacaggacttcactctcaccatcagcagactggagctagaagtatttgctagtgtattactgtcagcagtatactacaagaccgtactacgtttggaccgtaagggggaccaacggtcctaggaacgtaaacccgaaaacgtaaccgtgtacggctacggacctactactcttcg

SEQ ID NO: 393794 - DNA, 597 bp, Homo sapiens
  misc_feature: GZ8MTXP02ISV9A.38.28.C06.1.454.CMB.2.raw
  modified_base (185)..(185): a, c, t, g, unknown or other
  modified_base (229)..(229): a, c, t, g, unknown or other
  modified_base (263)..(263): a, c, t, g, unknown or other
  modified_base (280)..(280): a, c, t, g, unknown or other
  modified_base (284)..(284): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgtttctaggtcggctaatttaaaggngtccagtgtgaggtgcaggtgtcggagtgtggggagcttggtcnggcccgggggtcctgagctctcctgtgcagtctntggattaaccttaggtnactncgcatgcgtcgtcggtccgcgacgcgcggagggaggcgtggtaggtggtcgtcgacgtacgtaagtaaggtaggtaggtagtacgtactactatactacgcgtacgtacggtccgggtcggggtccgtacgacacacgacacgacgacacgacgacgacgacacactactactactaactaagtacgacacgacgacgacgacgacgacgacggacgacgacgtacgtacgtagttagttacgtacgacgacgacgtaacgtaaccgtaacgtacgtaccgttacgttacgttacgtttacgtttacgtttcg

SEQ ID NO: 393795 - DNA, 594 bp, Homo sapiens
  misc_feature: GZ8MTXP02F8QSF.38.28.C06.1.454.CMB.2.raw
  modified_base (269)..(269): a, c, t, g, unknown or other
  modified_base (358)..(358): a, c, t, g, unknown or other
  modified_base (416)..(416): a, c, t, g, unknown or other
  modified_base (445)..(445): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctgggagtgggtctcagcaattaagtggtaggggtnattcacatattacgcagactccggtgggggccgttcaccatcaccagagacaactccaggagcacactatatctaacaaatgaccaacncgcctaggaagtagtacggaggggaccacgggtccgtgttattagtttgagacgaganactcccgaaaggtcgacctaccttgggtntcgttttgatttcgtggtaggacccgtaaaggggacaaagttggtaccaccggttcttacgttcactcctccaccgacggaccgactccggttccttccccgtccgccgcccgtcgccgtccgacggacggccgaccaccgacgaaccg

SEQ ID NO: 393796 - DNA, 689 bp, Homo sapiens
  misc_feature: GZ8MTXP02HW49P.38.28.C06.1.454.CMB.2.raw
  modified_base (214)..(214): a, c, t, g, unknown or other
  modified_base (271)..(271): a, c, t, g, unknown or other
  modified_base (312)..(312): a, c, t, g, unknown or other
  modified_base (333)..(333): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaaggggctggagtgggtctcagcaattaagtgggtaggggtnattcaccatattacgcagactccggtgggggccgttcaccntcaccagagacaactccaggngcacactatatctaacaaatgaccacacgcctagagagtcgaggacacgggccgtgtaattatgtgcgagagactacccgaaacggtgaaccctaccgtttggtcgtctttttgattttcgtggttcggacccgtaaagggggtacctaaagggttcgggtaccctaacccggttccttccgtttaccgaaccggtccccttaccccgaaacccgaaaaccgggggtccccctaaaggttcccccggggttccctttcccccccggtggggtacccccgtccccccgttggtcccccgttacccgaaacggggtaacccggcccctaaacccccggttcccggaacggtaacccgg

SEQ ID NO: 393797 - DNA, 617 bp, Homo sapiens
  misc_feature: GZ8MTXP02HM1A7.38.28.C06.1.454.CMB.2.raw
  modified_base (538)..(538): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtcgtgggggaggcttggttcaggcccgggggtccctggagactctcctgtgcagtctctggtattaaccttagtgactatgccatgatcgtcgggtccgccgaggcctccgaggggaaggggctgggagtgggtctcgagactaaagttaagtgggtaaggggtgtattcaccgtatacgttacgcgtagaccgtccgggtgggggtccgttcacctatccaccagaacgacaactcccgaggacgacaacactaatataccttaacaaatcgacacacgcctgagacggtacgaacgggacaaccgggtcgttgtaacgttagttgnggaccggagtaacgacgtaacccgaagggtcccgtaacctaccgtttcgggtacgttccgttttagttacgttttccgg

SEQ ID NO: 393798 - DNA, 588 bp, Homo sapiens
  misc_feature: GZ8MTXP02GDKID.38.28.C06.1.454.CMB.2.raw
  modified_base (369)..(369): a, c, t, g, unknown or other
  modified_base (494)..(494): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggagcttggttcaggcccgggggtcctgagactctctgtgcagtctctggtattaaccttgtgactatgccatgatcgtggtccgccaggtcctccgaggggaaggggcgtgggaggtggggtctgagactaaagttaagtgggtaggggtnacgttcaacctattacttacgcgagaccgtccgggtcggggggcccgttcgaacctatacccaaccgaagacgaaccaactccgaggacgacaacactatactactaaacaaatgacacacgccngagagtacggaggaccgacggcgttagtaattgttgtgacgagacgactacccgtaaggcgtaccctaccgttggcgttctttggtactttcgg

SEQ ID NO: 393799 - DNA, 599 bp, Homo sapiens
  misc_feature: GZ8MTXP02IQVBR.38.28.C06.1.454.CMB.2.raw
  modified_base (214)..(214): a, c, t, g, unknown or other
  modified_base (269)..(269): a, c, t, g, unknown or other
  modified_base (328)..(328): a, c, t, g, unknown or other
  modified_base (442)..(442): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccnccaggctccgagggaagggctggagtgggtctcagcaattaagtgggtaggggtnattcactatatacgcagacgtcggtgggggccttcacatcaccagagacactccaggancacactaatacgtactaacaaagtcgaccacacgcctagagacgtcgaggacacgggcctagttaattgtgtgacgagagactccgaacggtcgaacctaccgttggtcgtttntttgtatttcgtggtacggacgtaaggtactagtcgtacctaccgttctacgtcacgtccctaccgaaccgtacggtaccctacgttcccggttccccttccccggtcggcccgtaccgtcgtccgtcgacgaccgaccgtacccgtacgacgaccg

SEQ ID NO: 393800 - DNA, 555 bp, Homo sapiens
  misc_feature: GZ8MTXP02FXW90.38.28.C06.1.454.CMB.2.raw
  modified_base (302)..(302): a, c, t, g, unknown or other
  modified_base (358)..(358): a, c, t, g, unknown or other
  modified_base (434)..(434): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtctgggggagcttggttcagcccggggggtccctgagactctcctgtgcagtctctggattaaccttagtgactatgccatgatctggtccncaggctccgaggggagggctggagtgggtctcgagcaaattaagtgggtaggggtnattacgaccatattacgcagacgtcggtgggggccgttcaccatcaccagagacaactccgaggacgacacactanatactaacaaatcgacacagcctgagagtcgagacacggcgtgtattagttgtgcgtagacgtactcccgtaaacggtcgaacccgtaccgtttgggtacgttccttttggaacttttcgg

SEQ ID NO: 393801 - DNA, 642 bp, Homo sapiens
  misc_feature: GZ8MTXP02HK2O8.38.28.C06.1.454.CMB.2.raw
  modified_base (285)..(285): a, c, t, g, unknown or other
  modified_base (311)..(311): a, c, t, g, unknown or other
  modified_base (349)..(349): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgtttctaggtggctaatttaaaaggtgtccagtgtgaggtgcaggtgtcggagtctgggggagcgttggttcgaggcccggggggtccctgagactctcctgtgcagtctctggattaaccgttgngactatgccatgatcgtggggtcccncgacggccacggaggggagggtcgtgggtaggtggtcncgagtactaaagttaggtggggtagggtactacttacactataacgttacgcgtacgccggtccggggtcgggggtaccgttacgaacctctaccgaacgaagaaccgaacgaacctaccgaaggactaccaactaactactaactactaaacgaaactcgaaccacgacgtacgtaggacgtacggacgaacggaccgtacggtcgttagttacgttgttgacgacgacgacgacgtaaccgtaacggtaacgtaccgttacgttcgtcgtttacgtttacgttacgtttcg

SEQ ID NO: 393802 - DNA, 570 bp, Homo sapiens
  misc_feature: GZ8MTXP02IZS3U.38.28.C06.1.454.CMB.2.raw
  modified_base (304)..(304): a, c, t, g, unknown or other
  modified_base (360)..(360): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagcgtgcgttttctagtggctattttaaaaggtgtccagtgtgaggtgcaggtgtcggagtctgggggaggcttggttcagccgtggggggtccctgagactctcctgtgcagtctctggattaaccttgtgactatgccatgatctggtccnccaggctccgaggagggctggagtgggctcgagacaaattaagtgggtaaggggtntactacactattactacgcacgtaccggtccggggtcgggggtccgtacaccgtactaccacgagaacgaactaacgacgagacacaacactatactacaaacgaatacgacacacgacgagagacgacgacgacgacgtacgtacgtagttagtcgtagacgacgacgacgtacgaacgtacgacgtacgtcgtcgttcgtttacgtcg

SEQ ID NO: 393803 - DNA, 638 bp, Homo sapiens
  misc_feature: GZ8MTXP02FV4XS.38.28.C06.1.454.CMB.2.raw
  modified_base (270)..(270): a, c, t, g, unknown or other
  modified_base (337)..(337): a, c, t, g, unknown or other
  modified_base (359)..(359): a, c, t, g, unknown or other
  modified_base (366)..(366): a, c, t, g, unknown or other
  modified_base (480)..(480): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggtccgccaggctccaggggaggggctgggagtgggtctcagcaattaagtggggtaggggtnactttcacctatattacgcagactccggtggggggccgttcaccatcaccagagacaactccaggancacactatatctaacaaaagtnaccaacngcctagagacgtcgagggacaccggccgtgttatttagttgtcgacgagaacgacgttacccccaaagggggttcaaccctaccgtttgggtcgttcgttttggatttttccgnggttcgggaccctaaagggggactaaagtgggtaccctacggtcttcttacgacgtcctccaccgaaccggacccgacgtccggttcccgttcccccgttccggtcccgcccgttccgtccgtcccgacggaacgccgacccgtaccggacgaaccgg

SEQ ID NO: 393804 - DNA, 594 bp, Homo sapiens
  misc_feature: GZ8MTXP02IOU41.38.28.C06.1.454.CMB.2.raw
  modified_base (447)..(447): a, c, t, g, unknown or other
  modified_base (455)..(455): a, c, t, g, unknown or other
  modified_base (517)..(517): a, c, t, g, unknown or other
  modified_base (521)..(521): a, c, t, g, unknown or other
  modified_base (530)..(530): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttcttgtggctaattttaaaaggtgtccagtgtgaggtgtaggtgtcggagtcgtgggggaggcttggttcgaggccccgggggtccctggagacgtctcctgtgcagtctctggattaacctttagtgactatgccatgatcgtggtccgccgaggctccgaggggaacggggctggaggtggtctcgagctaaagttagtagggtagggtgtattccaaccgtattacttaaccgcacgactccggggtcgggggcccgttacaccatccacagacgacaacnccaggacncaacactaatatactaaaaatgacacacacctgaacgagtcgaggacgacggcgtagtattnttgngacgtaganacgtaccaacggtcgaaccgtaaccgttaggtcgttacgtttgtacttttcgtaggtttaccgg

SEQ ID NO: 393805 - DNA, 621 bp, Homo sapiens
  misc_feature: GZ8MTXP02HYQVC.38.28.C06.1.454.CMB.2.raw
  modified_base (211)..(211): a, c, t, g, unknown or other
  modified_base (262)..(262): a, c, t, g, unknown or other
  modified_base (279)..(279): a, c, t, g, unknown or other
  modified_base (287)..(287): a, c, t, g, unknown or other
  modified_base (301)..(301): a, c, t, g, unknown or other
  modified_base (323)..(323): a, c, t, g, unknown or other
  modified_base (332)..(332): a, c, t, g, unknown or other
  modified_base (409)..(409): a, c, t, g, unknown or other
  modified_base (570)..(570): a, c, t, g, unknown or other
  modified_base (577)..(577): a, c, t, g, unknown or other
  modified_base (599)..(599): a, c, t, g, unknown or other
tcagtcgatcacgtcacgaccggtgctcgatttagagctcacgtattgggtttggctgagctggctttttcttgtggctattttaaaaggtgtccagtgtgaggtgcaggtgtcggagtctgggggaggcttggttcagcctgggggtccctgagactctcctgtgcagtctctggattaacctttagtgactatgccatgatctggtccncaggctcagggaagggctggagtgggtctcagcaattaagtggtaggggtnattcaaccatattacgnagactcgngggggccgtcacgntcacagagacaactccaggacncaacactanatactaacaaatgacccaacagtcctaggaagtacggtacgaggaccacgggtccgtagttattagtgtgacgaganactacccgaacggtacaccctaccgtttgggtacgttccttttaggtactttccgtggttcggaacccgtaaaggggtaccaagtcggtaccaacccggttcttcccttacgaccgtccctaccgaaccgaaccgggccctagtccggtcccttcccccgngggcccncccttcgcctaccgaacggacncccgaaccctccggacaaccgg

SEQ ID NO: 393806 - DNA, 580 bp, Homo sapiens
  misc_feature: GZ8MTXP02J272X.38.28.C06.1.454.CMB.2.raw
  modified_base (213)..(213): a, c, t, g, unknown or other
  modified_base (257)..(257): a, c, t, g, unknown or other
  modified_base (267)..(267): a, c, t, g, unknown or other
  modified_base (394)..(394): a, c, t, g, unknown or other
  modified_base (415)..(415): a, c, t, g, unknown or other
  modified_base (566)..(566): a, c, t, g, unknown or other
  modified_base (573)..(573): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccnccaggctccgagggaaggggctggagtgggtctcagcaattaanggtaggggtnattcaccatattacgcagactccgtgggggccgttcaccatcacccagagacaactccaggagcacactatatctaacaaatgccacagccctagagagtcgaggacacgggccgtgtattatttgngcgagagataccccaacggtnacccgaccttgggtgtcctttttgacttttcgtgttcgggcccgaaaggggacctaaagtgggtacctaccccggtctcctttcgacgtccctaccgacccaacggggcccagtccggtccttcccccgcgcccgcctcgccgcgacggcnccgaccncgacgcg

SEQ ID NO: 393807 - DNA, 566 bp, Homo sapiens
  misc_feature: GZ8MTXP02HDZUX.38.28.C06.1.454.CMB.2.raw
  modified_base (334)..(334): a, c, t, g, unknown or other
  modified_base (550)..(550): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaagtgggtaggggtgattcaccatattacgcagactccggtgggggccgttcaccatcaccagagacaactccaggancacactatatctaacaaatgaccaacagcctgagagtcgaggacacggccgtgtattagttgtgacgagagactacccgaaggtcgacctaccgttggtgtctttgatttctggttggccgaagggacaagtgtcaccgtctcttcacgtcctaccacccgaacgggccctagtcccggtccttcccccgcggcccgccctggcctccgacggacnccgacccgcgacgacg

SEQ ID NO: 393808 - DNA, 597 bp, Homo sapiens
  misc_feature: GZ8MTXP02JT0TB.38.28.C06.1.454.CMB.2.raw
  modified_base (387)..(387): a, c, t, g, unknown or other
  modified_base (579)..(579): a, c, t, g, unknown or other
tcagtcgatcacgtcacgaccggtgctcgatttagagctcacgtattgggtttggggagctctgagagaggagcccagtcctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggcgttggttcgacggccccgggggtccctgagactctcctgtgcagtctctggacttaaccttagtgactatgccatgatcgtcgggtccgccgagggcctccggaggggaaggggcgtgggaggtcggggtctcgagtactaaattaaggtgggtacggggtntattcacgtatattacgcagtacgtccgggtgggggccgttcaccatcaccagaacgacaacgtcccgagacgacactactatatacctaactaaactgacacgacgacctaggacgagtacggacgaacgacggtacgtgttacttagtcgtagcgagacgactaccgacgtaacgaccgtacgttcggtntacgttttgtacgtttcg

SEQ ID NO: 393809 - DNA, 548 bp, Homo sapiens
  misc_feature: GZ8MTXP02G6AY2.38.28.C06.1.454.CMB.2.raw
  modified_base (184)..(184): a, c, t, g, unknown or other
  modified_base (311)..(311): a, c, t, g, unknown or other
  modified_base (342)..(342): a, c, t, g, unknown or other
  modified_base (434)..(434): a, c, t, g, unknown or other
  modified_base (440)..(440): a, c, t, g, unknown or other
  modified_base (451)..(451): a, c, t, g, unknown or other
  modified_base (453)..(453): a, c, t, g, unknown or other
  modified_base (455)..(455): a, c, t, g, unknown or other
  modified_base (463)..(463): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtgtttctaggtggctattttaaaaggngtcagtgtgaggtgcaggtgtggagtgtgggggaggcgttggttcgaggccgggggtcccgtgaggactctcctgtgcagtctctggattaaccttagtgactatgccatgatctggtcgccaggcnccaggaaggggcgtggagtgggtcgtcaggnaataaataggtaggggtaggattctaccatatttacgcagaactccggtcgggggccgggttcggaccacacaccagagacaacacacgagnacacanatatacaaaanananacacgacngagagacgacgacgacgacgtagtagttagttgtcgagacgacgacgaccgacgaacgacgacgtcgtgtcgtttcgttagttcg

SEQ ID NO: 393810 - DNA, 568 bp, Homo sapiens
  misc_feature: GZ8MTXP02F9TQZ.38.28.C06.1.454.CMB.2.raw
  modified_base (368)..(368): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctatttaaaaggtgtccagtgtgaggtgcaggtgtcggagtcgtgggggaggcttggttcgaggcccggggggtcctgaggactctcctgtgcagtctctggattaaccttagtgactatgccatgatcgtgggtcccgcaggctccgaggggaaggggctgggagtgggtctcgagcaaattaagtgggtaggggtntagtcacatacttacgcagacgtcgggtcgggggccgttcaccgtatcacagacaacactcgagacgacacactatatactaacaaatcgacacacgacctagagacgtcgaaggaccacgggcgtagtacttagtgtcgcgtaagacgtaccacccgtaaggccgaccgtaccgttggtcgttcgtttagtactttcgg

SEQ ID NO: 393811 - DNA, 585 bp, Homo sapiens
  misc_feature: GZ8MTXP02GO7VL.38.28.C06.1.454.CMB.2.raw
  modified_base (287)..(287): a, c, t, g, unknown or other
  modified_base (311)..(311): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttctgtggctattttaaaaggtgtccagtgtgaggtgcaggtgtcggagtcgtggggggaggcgttggttcgaggcccggggggtccctggagactctcctgtgcagtctctggattaaccttagngactatgccatgatcgtgggtccnccgaggcctccgaaggggaggggctgggaggtgggtctcgagctaaagttaagtgggtacggggtgtattcacctagttacttacgcgacgacgtccggggtggggggcccgttcaccatccacagacgacactccgaggacgacacactatactactaaacaaatcgacacacgcctagaagacgtcggaaggaccgacgggccgtagttacttagttggacggcgagacgtacctacccgaagtcgaccctcgttgtgtctttgtactttcg

SEQ ID NO: 393812 - DNA, 561 bp, Homo sapiens
  misc_feature: GZ8MTXP02G8ULF.38.28.C06.1.454.CMB.2.raw
  modified_base (254)..(254): a, c, t, g, unknown or other
  modified_base (279)..(279): a, c, t, g, unknown or other
  modified_base (289)..(289): a, c, t, g, unknown or other
  modified_base (311)..(311): a, c, t, g, unknown or other
  modified_base (324)..(324): a, c, t, g, unknown or other
  modified_base (334)..(334): a, c, t, g, unknown or other
  modified_base (350)..(350): a, c, t, g, unknown or other
  modified_base (359)..(359): a, c, t, g, unknown or other
  modified_base (384)..(384): a, c, t, g, unknown or other
  modified_base (475)..(475): a, c, t, g, unknown or other
tcagtcgatcacgtcacgaccggtgctcgatttagagctcacgtattgggtttgggctgagcgtggcttttctgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgcaggctccagggaagggctggagtgggtctcagcaattaangggtaggggtgattcacatatacgnagactccggnggggccgttcacatcaccaganacaactccaggancacactatanctacaaatgcacagcngagagacgnggacgacggccgtgtattatgtggngagagactaccgacgacgtacgtaccgttcgtcgtcgttgttagttcgttgtcggacgaaggacgtagtagtacgtaccgtactctctacncctaccgaccgacgaccgtacgtccgtccgttcccgtccgtccgtcccgtccgtccgtccgacgacgaccgaccgtaccgacgacg

SEQ ID NO: 393813 - DNA, 561 bp, Homo sapiens
  misc_feature: GZ8MTXP02GEMUL.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaanagccaccctctcctgcagggccagtcagagtgttttcaacggtctacttagcctggtaccagcaaaacctggccaggctcccaggctcctcatctatggtacatccgtcagggccactggtatcccagacagttcagtgcagtggtctggggacagacttcactctcacatcagcagactggaggctagaagtatttagctaggtgtattactgtcagcagtatactacaagacctactacgtttcggaccgtaggggacccaaggaccttacgggaaacgtaacccgaaaacggtaaacgtaacggtacggaccgttacggaccgaacccgtaactccgtttaccg

SEQ ID NO: 393814 - DNA, 529 bp, Homo sapiens
  misc_feature: GZ8MTXP02FE6FF.38.28.C06.1.454.CMB.2.raw
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcacatattacgcagactccgtggggggccgttcaccatcaccagagacaactccaggagcacactatatcacaaatgccacagcctgagagtcgaggacacggccgtgtattattgtgcgagagatcccaaaggtgaccaccttggtgcttttgatttctgtggccaaggggacaaatggtcaccgtctcttcagcctccaccaagggcccatcggtcttccccctggccgccctgctcccaggacgcacctccgagacg

SEQ ID NO: 393815 - DNA, 561 bp, Homo sapiens
  misc_feature: GZ8MTXP02JPL97.38.28.C06.1.454.CMB.2.raw
  modified_base (283)..(283): a, c, t, g, unknown or other
  modified_base (305)..(305): a, c, t, g, unknown or other
  modified_base (361)..(361): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttggttcaggcccggggggtccctgagactctcctgtgcagtctctggattaaccttagngactatgccatgatctggtccncaggctcgaggggaggctgggagtgggtctcagactaattaaagtgggtaggggtnattcaccgtatacttacgcagacgtccgggtggggggcccgttcaccgataccacccgaagacgaacaactcccgaggacgacaacactatatactaacaaatcgacaacacgccgtagagacgcgaaggacgacggcgtagtatattggcgacgacgacgacgtacgacgcgacgtacgtcgtgttcgttagtacttcg

SEQ ID NO: 393816 - DNA, 616 bp, Homo sapiens
  misc_feature: GZ8MTXP02H5LCA.38.28.C06.1.454.CMB.2.raw
  modified_base (213)..(213): a, c, t, g, unknown or other
  modified_base (316)..(316): a, c, t, g, unknown or other
  modified_base (336)..(336): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggtccnccaggctccgagggaagggctggagtgggtctcgagcaattaagtggtaggggtgattcaccatattacgcagacgtccggtggggccgttcacatcaccagnacaactcaggagcacactanatctaacgaaatgaccacagtcctagagagtcgaggactacggcctagtattagttgcgagagagacgtaccccgaaaggtcaccgtaccttgggttgttcgtttgtacgtttcgtaggtacggaccgtaaagggaactaaggttcggtaccgtaccgttctcgttacgaccgtccctacccgaaaccgtaaccggccctacgttcccggttccccttacccccgtcggcccctcccgtacgtcccgtaccgaccggacgaccgacccgtaccgacgacg

SEQ ID NO: 393817 - DNA, 700 bp, Homo sapiens
  misc_feature: GZ8MTXP02IYK78.38.28.C06.1.454.CMB.2.raw
  modified_base (317)..(317): a, c, t, g, unknown or other
tcagtcgatcacgtcacgaccggtgctcgatttagagctcacgtattgggtttgggggaggcttggttcagcctgggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatatctaacaaatgcacagcctgagagtcgaggacacggcgtgtattatgngcgagagatccccgaaaggtgacctaccgttggtcgtctttttgactttttcgtggttcgggcccaaaggggtacaaagttggtacccaacccggttcttcctttccgacgtccctacccgacccgaaacggggccccacgttcccgggttcccttccccccgtcgggcccgtacccctcggtccccttacccgacggggtaccgacccgtacccgtacccggaacgaccggaccaaccggtacgggcccggccccggtacggggcccgttccggtacccgttacgggtaacccgaaacggttacccgttaacccgttacccgtaacggttacggtaaccgttccggaacgtcgggaacgggccggggtaccgtacgggaccg

SEQ ID NO: 393818 - DNA, 695 bp, Homo sapiens
  misc_feature: GZ8MTXP02JU8N2.38.28.C06.1.454.CMB.2.raw
  modified_base (271)..(271): a, c, t, g, unknown or other
  modified_base (332)..(332): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccagggctccgaggggaaggggctgggagtgggtctcagcaattaatgggtaggggtnatcacatatacgcagacgtccgggtgggggccgtcaccatcacagacgacactcgaggacncacactatactactaacaaatcgacccacgacgtcctaggagacggtacgacgggaccgaccggggtccgttagttaatttagttggtacggacgaagaacgtaccgtaccccgaaacgggtaccgtaaccctaccgtttggttcgttcgttttagtacgttttccgtggtacgggaccgtaaagggactaaggttccggtaccctaccggttcttacgttaccgaccgtcccctacccgaaacccggtaaccgggcccctacggttccccggttccccgttcccccggtcgggcccccgtcccgtcggtaacccgtacccggaacgggtacccgacccgtaccccggtaccggaacgtaccg

SEQ ID NO: 393819 - DNA, 620 bp, Homo sapiens
  misc_feature: GZ8MTXP02G1CIN.38.28.C06.1.454.CMB.2.raw
  modified_base (289)..(289): a, c, t, g, unknown or other
  modified_base (314)..(314): a, c, t, g, unknown or other
  modified_base (370)..(370): a, c, t, g, unknown or other
  modified_base (457)..(457): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggaggcttgggttcacggcccggggggtccctggagactctcctgtgcagtctctggattaaccttagngactatgccatgatcgtgggtcccnccaggctccgaggggagggctgggagtgggtctgagctaattaggtggtaggggtntatcactatattacgcagacgtccggggtgggggcccgttcaccataccaccagagacaactccgaggagcacactatactactaanaaatcgacacacgaccgtagaacggacggtacgaacggaaccgtaccgggaccgttagttacgtttaaagttggtacgggtacgaaggtacggtaaccttaccccggaaacggtaacgtaccgtaacccgttgggttacgttcgtttacgtttagttttacgg

SEQ ID NO: 393820 - DNA, 631 bp, Homo sapiens
  misc_feature: GZ8MTXP02GII9U.38.28.C06.1.454.CMB.2.raw
  modified_base (307)..(307): a, c, t, g, unknown or other
  modified_base (347)..(347): a, c, t, g, unknown or other
  modified_base (422)..(422): a, c, t, g, unknown or other
  modified_base (479)..(479): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggaggcttggttcaggcccgggggtcctgagactctcctgtgcagtctctggtattaaccttagtgactatgccatgatcgtcgggtccnccagggcctccgaggggaacggggcgtgggaggtgggtcncgagcaaattagtgggtaggggtgacttcaacctattattacgcacgacgtccggggtgggggcccgttcaaccntaccaccagacgacaactccgaaggcgacaacactatatactaaacaaatcgacaanacgacctggaagacggtacggaacggtacgaccgggtaccgttagttaaacgtttgttaggtcgaacggaggtacgtaacctaccccggaaacggtaaccgaacccgttaaccggtttgggtaccgtttccgtttttaggtactttttcggg

SEQ ID NO: 393821 - DNA, 596 bp, Homo sapiens
  misc_feature: GZ8MTXP02GOXKS.38.28.C06.1.454.CMB.2.raw
  modified_base (270)..(270): a, c, t, g, unknown or other
  modified_base (334)..(334): a, c, t, g, unknown or other
  modified_base (555)..(555): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattatgggtaggggtnattcaccatattacgcagactccggtgggggccgttcaccgatcaccagagacaactccaggancacactatatctaacaaatgaccacagcctagagagtcgaggacacgggccgttagtattagtgtgcgagagactacccgaaaggtgaccctaccgtttggtcgtccttttgattttccgtggttcggacccgtaaaggggacctaaagttcggtacctaccgtcttcttcacgtccctaccaccgaacgggccccagtccggttccttccccctggcccnccccttgcccgtccgaggtaccgccaacccgtccgagaccg

SEQ ID NO: 393822 - DNA, 558 bp, Homo sapiens
  misc_feature: GZ8MTXP02JQCT8.38.28.C06.1.454.CMB.2.raw
  modified_base (270)..(270): a, c, t, g, unknown or other
  modified_base (307)..(307): a, c, t, g, unknown or other
  modified_base (319)..(319): a, c, t, g, unknown or other
  modified_base (324)..(324): a, c, t, g, unknown or other
tcagtcgatcacgtcacgaccggtgctcgatttagagctcacgtattgggtttgggctgagcgtggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaatgggtaggggtntatcactatatcgcagcgtcggtcggggccgtcacancacagacacacncgagncacactatactacaacaaatgaccacacgacgtagagagacgagacgacggtacgtagttattagttgtgtgagagacgtaccgtacgtacgacgtacgttcgttgttcgtttgttcgtttcgttgtcggacgacggacgtagtacgtcgtacgtctctctcgtcctaccaccgacgccgacgtccgtccgtcccgtccgccgccgcgcgcgacgacgaccgaccgcgacgacg

SEQ ID NO: 393823 - DNA, 585 bp, Homo sapiens
  misc_feature: GZ8MTXP02JV4LZ.38.28.C06.1.454.CMB.2.raw
  modified_base (287)..(287): a, c, t, g, unknown or other
  modified_base (313)..(313): a, c, t, g, unknown or other
  modified_base (376)..(376): a, c, t, g, unknown or other
  modified_base (523)..(523): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttctgtggctattttaaaaggtgtccagtgtgaggtgcaggtgtcggagtcgtgggggaggcttggttcaggccccgggggtcctggagactctcctgtgcagtctcgtggtattaacctttagngactatgccatgatcgtcgggtcccncgaggcctccgaaggggacgggctgggagtgggtctcgagactaagttagtggggtaggggtntagtcactatattacgcagacgtccggggtcgggggcccgttcaacctagtccaaccgagaagacaacctcgagcgacacactatactactacgaaatgacacagctagagagtacgaggacacgggcgtagttacttattggacgnggtagacgaccttacccggaaggttccgacttacccggtggttcgtcgttttacgtgtttcg

SEQ ID NO: 393824 - DNA, 583 bp, Homo sapiens
  misc_feature: GZ8MTXP02FTKZE.38.28.C06.1.454.CMB.2.raw
  modified_base (307)..(307): a, c, t, g, unknown or other
  modified_base (368)..(368): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtcgtgggggaggcttggttcaggcccggggggtccctgagactctcctgtgcagtctctggattaaccttagtgactatgccatgatcgtgggtccnccaggcctccgaggggagggctgggagtggggtctcgagcaaagttaagtgggtaggggtnattcactatacttacgcagaccgtccgggtggggggtcccgttacaccatccaaccgagaacgaacaactcgaggacgcaacactatactactaacaaatcgacaacagcctagagacgtcgaacggacgaacggtccgtagtacttagttgtcgtacgagacgacgtacccgaacggtcgaccctaccgtttggtcttcgtttagtacttttcg

SEQ ID NO: 393825 - DNA, 610 bp, Homo sapiens
  misc_feature: GZ8MTXP02JBQF4.38.28.C06.1.454.CMB.2.raw
  modified_base (216)..(216): a, c, t, g, unknown or other
  modified_base (271)..(271): a, c, t, g, unknown or other
  modified_base (336)..(336): a, c, t, g, unknown or other
  modified_base (352)..(352): a, c, t, g, unknown or other
  modified_base (401)..(401): a, c, t, g, unknown or other
  modified_base (408)..(408): a, c, t, g, unknown or other
  modified_base (454)..(454): a, c, t, g, unknown or other
  modified_base (506)..(506): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatcgtgggtccncaggctcgaggggaagggctggagtgggtctcagctaattaagtgggtaggggtntattcactatatacgcagacgtcggtgggggccgttcaccatccaccagacgacaactcgaggancacactatatactaanaaatgacccacagcctagagagtcgaggacacggtcgtgtattagttgngacgtanagactacccgaggtcgacctacgttggtcgttctttagattttcgnggttacggaccgaaagggactaagttcgtaacgtaccgttcgtctacgaccnccctaccgaaccgtaaaccggggccctaggttccccgggttcccttcccccggtcggcccctcccgtccgcccgtcgacggacgcccaccgttaccgaggaccg

SEQ ID NO: 393826 - DNA, 626 bp, Homo sapiens
  misc_feature: GZ8MTXP02FPJQA.38.28.C06.1.454.CMB.2.raw
  modified_base (269)..(269): a, c, t, g, unknown or other
  modified_base (282)..(282): a, c, t, g, unknown or other
  modified_base (305)..(305): a, c, t, g, unknown or other
  modified_base (312)..(312): a, c, t, g, unknown or other
  modified_base (317)..(317): a, c, t, g, unknown or other
  modified_base (323)..(323): a, c, t, g, unknown or other
  modified_base (337)..(337): a, c, t, g, unknown or other
  modified_base (392)..(392): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaatgggtaggggtnatcacatatacgnagcgtcggtcggggccgtcacancacaganacacncgagancacatatatacaanaaatcgaccacagctagagacgtacgacggacgacggtcgttagttattagtggngacgaagacgaccgtacccgtaacggtcgaacccgtaccgtttggtcgttcgttttagtacttttcggtaggtacggaaccggtaaagggtaactaaggtccggttacccgtaccgttcttcttaccgacgtcccgtacccgaaccgaaccggacccgtaccgtccggttcccgttccccgtccgtcccgtcccgtccgtccgtccgacggaccgaccgacccgaccgacgacg

SEQ ID NO: 393827 - DNA, 568 bp, Homo sapiens
  misc_feature: GZ8MTXP02JSD9Z.38.28.C06.1.454.CMB.2.raw
  modified_base (292)..(292): a, c, t, g, unknown or other
  modified_base (395)..(395): a, c, t, g, unknown or other
  modified_base (446)..(446): a, c, t, g, unknown or other
  modified_base (540)..(540): a, c, t, g, unknown or other
tcagtcgatcacgtcacgaccggtgctcgatttagagctcacgtattgggtttgggctgagctggcttttctgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaagtgggtaggggtgattcaccatatacgcagactcggnggggccgttcacatcaccagagacaactccagagcacactatatactaacgaaatgaccacagcctagagagtcgaggaccacgggccttagtattagtttgngcgagagactcccgaacggtgaacctccgttggtcgtcttttgactttcgnggttaggccgaaagggacaagtcggtccaccgttctcttcacgcctaccacgaacgggcccagtccggtccttccccgtcggcctcccgtgccncccgagggaccaccgaccgacgacgacg

SEQ ID NO: 393828 - DNA, 585 bp, Homo sapiens
  misc_feature: GZ8MTXP02JNPW2.38.28.C06.1.454.CMB.2.raw
  modified_base (278)..(278): a, c, t, g, unknown or other
  modified_base (366)..(366): a, c, t, g, unknown or other
  modified_base (384)..(384): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctatttaaaggtgtccagtgtgaggtgcaggtgtcggagtcgtgggggagcttggttcaggcccgggggtcctgagactctcctgtgcagtctctggattaaccttagngtactatgccatgatcgtgggtcccgcaggcctccgaaggggtaacgggctgggagtgggtctgagactaagtaagtgggtaggggtnacttcactatattaccgnagaccgtccggggtcgggggccgttcaccagtccacgagacgacaactccgaggacacactactatataccaacaaatcgacaacgacgtaccagacgtacgacgaaggaccgaaccggtcgttaggtattacgttgcggacgaagtacgacgtacccgaaggtcgtacccgtacgttggtacttctttaggtactttcgg

SEQ ID NO: 393829 - DNA, 688 bp, Homo sapiens
  misc_feature: GZ8MTXP02I7VG5.38.28.C06.1.454.CMB.2.raw
  modified_base (283)..(283): a, c, t, g, unknown or other
  modified_base (287)..(287): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctagtggctattttaaaggtgtccagtgtgaggtgcaggtgtcggagtcgtgggggagcttggttcaggcccgggggtcctggagactctcctgtgcagtctctggattaaccttaggnactncgctatgactcgtcggtccacgacggccgtacggaaggggacgggtcgtgggtacggttcgggtactacgagtacgtaaagttaggtaggggtaggggtatactcaactatacgtacgcgacggtaccggtccgggggtacgggggtacccgtacaccgtacgaccaaccgacgtaacgaaccgaacgtaccgaggacgacctaacaactacttactaacgtaactaaagtcgaccgacgtacgaccgtaggacgtacggtacggaacggaccggtaccggtccgttaagttacgttacgttaggtacggacggtaacggacgtaaaccggttaccccgaaacggttaaccggtaacccgttacggtttcggttacgtttccgttttacgtacgttttccg

SEQ ID NO: 393830 - DNA, 619 bp, Homo sapiens
  misc_feature: GZ8MTXP02HZS1M.38.28.C06.1.454.CMB.2.raw
  modified_base (214)..(214): a, c, t, g, unknown or other
  modified_base (267)..(267): a, c, t, g, unknown or other
  modified_base (296)..(296): a, c, t, g, unknown or other
  modified_base (321)..(321): a, c, t, g, unknown or other
  modified_base (335)..(335): a, c, t, g, unknown or other
  modified_base (346)..(346): a, c, t, g, unknown or other
  modified_base (584)..(584): a, c, t, g, unknown or other
  modified_base (604)..(604): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctggggggtccctgagactctcctgtgcagtctctggatttaacctttagtgactatgccatgatctggccncaggctcgaggggagggctggagtgggtctcagcaattaagtgggtaggggtnattcaccgtatattacgcagaccgtcggngggggccgttcaccgatcaccaganacaactccaggacncacaactatanacgtaacaaatgaccacagtccagagagcgagacacggcgttgtattacgttgagacgaagagacctacccgaacgggtcacccgtaccgtttggtacgttccgtttttagtaacgtttcgttacgggttagacccggttaaaagggactaaggtcgggtactacccggttcttccgttacaccgtcccaccgaaccgtacgggaccctgtcccggttccccttcccgcgccctcccncgtaaccgaccgacggaccncaccctcgaacgccg

SEQ ID NO: 393831 - DNA, 694 bp, Homo sapiens
  misc_feature: GZ8MTXP02JJW3D.38.28.C06.1.454.CMB.2.raw
  modified_base (367)..(367): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtcgtgggggaggcttggttcaggcccgggggtcctgagactctcctgtgcagtctctggattaaccttagtgactatgccatgatcgtgggtccgccaggcctccgaggggaaggggctgggaggtgggtctcagactaattaagtgggtaggggtntagttcaaccgtattaacgttacgcaacggtaccgttcccggggtacgggggggtcccgttacgaaccctatcccgaaccgaaggaacggaaacccaaacctaccccggaaagggacgaccaaaccctaacttactaacttaacctaaaccaaaaattcgaccaaacgacggacccgttaagaaggacggtaccggaagggaacccgaaccggggtccgtaggtttaactttagttggtacggacgaagggtacgtaacgtacccccgaaaacgggtccgaaacccgtacccggtttgggtcgttaccgtttttggactttttccgg

SEQ ID NO: 393832 - DNA, 631 bp, Homo sapiens
  misc_feature: GZ8MTXP02G0CEQ.38.28.C06.1.454.CMB.2.raw
  modified_base (356)..(356): a, c, t, g, unknown or other
  modified_base (436)..(436): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggcttggttcaggcccgggggtccccgagactctcctgtgcagtctctggtattaaccttagtgactatgccatgatcgtggtcccgcgaggctccgaggggaagggctggaggtgggtctcgagcaaattagngggtagggtgtattcactatattacgcagaccgtcgggtgggggccgtcaccgatcaaccagacgacaacgtccaagganacacactaatactactaaacaaatcgaccacacgaccgtagaacgtacgacggaagggaaccgaccgggtaccgttagttaatttaacgttcggtaggaccgaaaggaacgtaccgttacccccgaaacggggtccgtaacccgttaacccggttgggttacgttccgtttttagtaacgtttttccgtacgggg

SEQ ID NO: 393833 - DNA, 662 bp, Homo sapiens
  misc_feature: GZ8MTXP02J1AH7.38.28.C06.1.454.CMB.2.raw
  modified_base (379)..(379): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtcgtgggggagcttggttcaggcccgggggtcctgagactctcctgtgcagtctctggtacttaacctttagtgactatgcctatgatcgtcgggtccgccaggcctccggaaggggaaggggcgtgggaggtgggtctcgagtactaaagttaaggtgggtaggggtntagttccaacgtatacttacgcaggtaccgttccgggggtggggggtcccgtttacaacccgtactacccgaacccgaagaacgaaccaaaccgtcccgaggacgaccaactaacctatactactaaacaaatcgacacacgaccgtagaggacgtacgggacggaaccgacggtaccgttgttaacgttagttggcggtacggaggacgtaccgtaccccgtaaacggtcgtaaaccccgttaccggttgggttcgtttccgttttagtacgtttttccggg

SEQ ID NO: 393834 - DNA, 568 bp, Homo sapiens
  misc_feature: GZ8MTXP02H040M.38.28.C06.1.454.CMB.2.raw
  modified_base (356)..(356): a, c, t, g, unknown or other
  modified_base (414)..(414): a, c, t, g, unknown or other
  modified_base (429)..(429): a, c, t, g, unknown or other
  modified_base (461)..(461): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcgttttctagtggctattttaaaaggtgtccagtgtgaggtgcaggtgtcggagtcgtggggagcttggttcaggcccgggggtcctgagactctcctgtgcagtctcgtggattaaccttagtgactatgccaatgatctggtccgcaggctccgaagggaaggggctgggagtggggtctgagactaattaaagnggtagggtgattcgactatattacgcagacgtcccggtgggggcccttcgaaccgtancaccagagaacaacnccaggacacacaactataatactaaacaaaanacgacacacgacagagagacgacgacgacgacgtacgtacgttagttgtcgacgacgacgacgaccgacgtaacgacgtacgttcgtacgttcgtttcgttacttcg

SEQ ID NO: 393835 - DNA, 555 bp, Homo sapiens
  misc_feature: GZ8MTXP02JLB3K.38.28.C06.1.454.CMB.2.raw
  modified_base (268)..(268): a, c, t, g, unknown or other
  modified_base (354)..(354): a, c, t, g, unknown or other
  modified_base (522)..(522): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccgccaggctccagggaaggggctgggagtgggtctcagcaattaatgggtaggggtnattcaccatattacgcagactccggtgggggccgttcaccatcaccagagacaactccaggagcacactatatctacaaatgccanagcctgagagtcgaggacacggccgtgtattattgtgcgagagatcccaaacggtgaccctaccttgggtcgtcttttgattttctgtggccaaaggggactaagtggtcaccgtctcttcagtccctacaccaacgggcccagtccggtccttcccccgtgggcccnccctgcctcccgaggacgccaccctcgacgacg

SEQ ID NO: 393836 - DNA, 610 bp, Homo sapiens
  misc_feature: GZ8MTXP02IH07Q.38.28.C06.1.454.CMB.2.raw
  modified_base (270)..(270): a, c, t, g, unknown or other
  modified_base (294)..(294): a, c, t, g, unknown or other
  modified_base (315)..(315): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtnattcacatatacgcagactccggnggggccgtcaccatcacaganacaactcagagcacactatatactaacaaatcgaccaacagcctaggacgagtacgaggggaccacgggccgttagttattagttgtgacgagagactcccgaacggtgaccctaccgttggtgtctttgatttcgtggtgaccgaagggactaagtcggtcctaccgttctccgttcacgtccctacccgaaccgtaaacggggcccctacgttcccggttccccttccccccgtgggcccctccccgttggccctacccgaacgggacaccctacccgtaccggaacgaccgg

SEQ ID NO: 393837 - DNA, 573 bp, Homo sapiens
  misc_feature: GZ8MTXP02JL2LX.38.28.C06.1.454.CMB.2.raw
  modified_base (316)..(316): a, c, t, g, unknown or other
  modified_base (375)..(375): a, c, t, g, unknown or other
  modified_base (466)..(466): a, c, t, g, unknown or other
  modified_base (566)..(566): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcaggtgtcggagtcgtgggggagtcttggttcagggtcccggggggtccctggacgactctcctgtgcagtctctggatttaaccttagtgactatgccatgatcgtgggtccncaggcctcgaggggaacgggctgggaggtgggtctcgagctaattaagtggtaggggtnattcacatattacgcagactcgggtgggggccgttcaccgatcaccagagaacactccgagacgacaccaatatatacaacaaatcgacanacgtccagacgagtcggaaggacctacgggccgtaggttacttagttgagacggagacgactaccgaacggtcgaccctacgttgggtactcttttacgnttttcgg

SEQ ID NO: 393838 - DNA, 662 bp, Homo sapiens
  misc_feature: GZ8MTXP02JBBF5.38.28.C06.1.454.CMB.2.raw
  modified_base (398)..(398): a, c, t, g, unknown or other
  modified_base (516)..(516): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggaggtcgttgggttcgacgggccccgggggggttcccctggacgacctcctcccgtggtgcagtctctggaactttaaccttagtgactatcgaccatgatcgtgggtcccgccaggcctccgaggggaacgggcgtgggaggtgggtctcgagactaaagttaagtcggggtaggggtnagttcacctataacgttacgcgaacgtacgttcccggggtacggggggcccgttaccaaccgtatacccgaaccgaagaacgaacaaacctccgaggacacaacactatactactaanaaatcgacaacgacgcctaggacgtaggtcggaacggacaccgggtcgtagttaacttagttggacggtacgaagaacgtaaccgtacccgaaaacgggtcgaaaccccgttcggttaggtcgttccgttttaggtaacttttcgg

SEQ ID NO: 393839 - DNA, 594 bp, Homo sapiens
  misc_feature: GZ8MTXP02JTLQV.38.28.C06.1.454.CMB.2.raw
  modified_base (292)..(292): a, c, t, g, unknown or other
  modified_base (318)..(318): a, c, t, g, unknown or other
  modified_base (379)..(379): a, c, t, g, unknown or other
  modified_base (395)..(395): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggcgttggttcacggccccggggggtcctgacgactctcctgtgcagtctcgtggtacttaacctttagngactatcgccatgatcgtgggtcccnccgaggcctccgaggggagggcgtgggaggtgggtctcgagctaaagttagtggtagggtnattcactatacttacncacgacgtccgggtgggggccgtcacatccacagacgacactccgaggacaccaactactaatactactaacaaatcgacacgtacgcctaggaacgtacggtacggaacggaccgaccgggtcgtagttaatttacggttgacgacgagtacgactcccggaaagtcgacctacgtttggcttcgtttgtactttcgg

SEQ ID NO: 393840 - DNA, 663 bp, Homo sapiens
  misc_feature: GZ8MTXP02JXHAT.38.28.C06.1.454.CMB.2.raw
  modified_base (284)..(284): a, c, t, g, unknown or other
  modified_base (288)..(288): a, c, t, g, unknown or other
  modified_base (290)..(290): a, c, t, g, unknown or other
  modified_base (308)..(308): a, c, t, g, unknown or other
  modified_base (338)..(338): a, c, t, g, unknown or other
  modified_base (359)..(359): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctattttaaaaggtgtccagtgtgaggtgcaggtgtcggagtcgtgggggagcttggttcaggcccggggggtccctgagactctctgtgcagtctctggattaacctttagtnactncncatgatcgtcggccgcgnggctcggaggggaggcgtggaggtggtcanagataagtagtgggtagggtntatacactatacgttacgcgacggtaccggtccggggtcgggggtcccgttaccgaaccgtacgtacccgaaccgaaaggaaccgaacctaaaccgtacccgaagggaccgacctaaaccgtaacttaacttaactaactaaactaaagtacgacacacgacgtacgaggacggtacggacggaccggtacggtaccgttacgttacgttagttaggtacggtacggaacggacgtaccgtacccgtaaccggtaaccggtaccgttaccgttacggttcgtttacgtttacgtttacgtttcg

SEQ ID NO: 393841 - DNA, 566 bp, Homo sapiens
  misc_feature: GZ8MTXP02H0VZ3.38.28.C06.1.454.CMB.2.raw
  modified_base (284)..(284): a, c, t, g, unknown or other
  modified_base (473)..(473): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtctgggggaggcttgggttcaggcccggggggtccctgagactctcctgtgcagtctctggattaacctttagngactatgccatgatctgggtccgccaggcctccgaggggaagggctgggagtgggtctcgagcaattagtgggtaggggtgtattcacctatacttacgcagtactcccggggtgggggcccgttcgaccataccaccagacgaacaactccgaggacgacacaactatactactaacaaatgacaacngtaccagagagtcgagacacggcgtgttacttagttgtcgacgagacgaactcccgaaggtcgacctaccgttggtcgtcttttgtactttcg

SEQ ID NO: 393842 - DNA, 577 bp, Homo sapiens
  misc_feature: GZ8MTXP02FJ1EY.38.28.C06.1.454.CMB.2.raw
  modified_base (270)..(270): a, c, t, g, unknown or other
  modified_base (334)..(334): a, c, t, g, unknown or other
  modified_base (349)..(349): a, c, t, g, unknown or other
  modified_base (377)..(377): a, c, t, g, unknown or other
  modified_base (393)..(393): a, c, t, g, unknown or other
  modified_base (413)..(413): a, c, t, g, unknown or other
  modified_base (440)..(440): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaatgggtaggggtnattcaccatattacgcagactccggtggggggccgttcaccatcaccagagacaactccaggancacactatatctaanaaatgcccacagcctgagagtcgagacncggccgtgtattatgngcgagagactcccgaaggtnacccacttggtagtcttttgatttcgnggtggaccaagggacaaagtggccacgtctcttcacgcctccaaccgtaacgggccccaagttcccggtccctttccccccgtgggtccccgccccgttgcccgtaccgacgggactccaacccgtcccggagaccg

SEQ ID NO: 393843 - DNA, 582 bp, Homo sapiens
  misc_feature: GZ8MTXP02JXVAH.38.28.C06.1.454.CMB.2.raw
  modified_base (553)..(553): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctcaggcacctgtctttgtctccgaaggggaaagacgccaccctctcctgcagggccagtcaggtagttgttttacaacggtctacgttagcctggtaccagacaaaaacctggaccaggcctcccgaggcctcctcattcctagtggtacactccggtcacgggccacgtggtactcccgagactacggttcagtggcgaggtgggtcgtggggacaggtacttcgactctcaccagtcagccagacgtgggaacgctagaaagtatttgataggtagttaattcgtgtcagctaagtataactacgaaacgtacgttactaacgtttcggacgacggggaaccaggcgtagggacaaaccgaacgtaacgnggttacgcgtacggactacgactcgttcg

SEQ ID NO: 393844 - DNA, 617 bp, Homo sapiens
  misc_feature: GZ8MTXP02FRI24.38.28.C06.1.454.CMB.2.raw
  modified_base (266)..(266): a, c, t, g, unknown or other
  modified_base (303)..(304): a, c, t, g, unknown or other
  modified_base (311)..(311): a, c, t, g, unknown or other
  modified_base (316)..(316): a, c, t, g, unknown or other
  modified_base (323)..(323): a, c, t, g, unknown or other
  modified_base (332)..(332): a, c, t, g, unknown or other
  modified_base (338)..(338): a, c, t, g, unknown or other
tcagtcgatcacgtcacgaccggtgctcgatttagagctcacgtattgggtttgggctgagcgtggcttttctgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattagtggtaggggtnattcactatactacgcagcgtcgggtggggcctcacnncacaganacacncgagacncacatatanactaanaatcgaccacgtacgcgtaggagagtcggacgacgacgggtcgtagttattagtgagacgagacgactacccgaacggtcgaccctacgtttgtcgttcttttagtctttcgttcggtacggtacgtaacggtacgtaacgtacggtaccgtaccgttcttcttcgtaccgtaccgtacccgaaccgaaccggtacccgtaccgtccgttcccgttaccccgtccggtcccgtcccgtccgtccgtaccgacggaccgaccgtacccgtaccgacgacg

SEQ ID NO: 393845 - DNA, 567 bp, Homo sapiens
  misc_feature: GZ8MTXP02JMES3.38.28.C06.1.454.CMB.2.raw
  modified_base (359)..(359): a, c, t, g, unknown or other
  modified_base (379)..(379): a, c, t, g, unknown or other
  modified_base (477)..(477): a, c, t, g, unknown or other
  modified_base (503)..(503): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtctttttcttggtggcttaattttaaaaggtgtccagtgtgaggtgcaggtgtcggagtcgtgggggaggtcgttggttcgacgggtccccggggggtccctggacgactcgtcctgtcgcagtctcgtggattaaccgtttagtgactatgccatgatcgtgggtccgcaggctccgaggggaggctgggagtgggtctnagacaattagtggtagggtnattcactatattacgcagacgtcgggtcgggggtccgttcaccagtccacgaagacgaacaactccgagacgacaacactatatacaacaaatgcacncgacctgagaggacgaggacgacggnagtcgtattagtcgtgacgagacgacacccgaagtcgacctacggttgtcgtttctttgttacg

SEQ ID NO: 393846 - DNA, 696 bp, Homo sapiens
  misc_feature: GZ8MTXP02JL0DX.38.28.C06.1.454.CMB.2.raw
  modified_base (329)..(329): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgcaggctccgagggaagggctggagtggtctcagcaattaatgggtaggggtgattcaccatatacgcagactccggtgggggccgttcaccatcaccagagacaactccaggacncacactatatctaacaaatgacccaacagcctagagaggtcgaggacacgggccgttgtatttatggtgacgagagactacccgaaagggtcgaccctaccgttgggttctccgtttttagactttttcgtggttcggaacccggtaaaggggtactaaaagggttcgggtacctaacccgggtttccttcctttaccgaacggtcccccttaaccccgaacccggtaaaacccgggggtccccctaaacggtttcccgggggttccccctttaccccccggtcggggtcccccgtccccttacgggcccttaccccggaaacggggaccggcccctaaacccgttcccccgggaaaggtaacccgg

SEQ ID NO: 393847 - DNA, 681 bp, Homo sapiens
  misc_feature: GZ8MTXP02FU1US.38.28.C06.1.454.CMB.2.raw
  modified_base (314)..(314): a, c, t, g, unknown or other
  modified_base (381)..(381): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctatttaaaaggtgtccagtgtgaggtgcaggtgtcggagtcgtgggggagcttggttcacggtccccggggggtccctggacgactctccgtgtgcagtctctggtattaaccttagtgactatgcctatgatcgtcgggtccnccgagggcctccggaggggaagggcgtggaggtggggtctcgagactaagttaagtgggtaggggtntacttcgaacctatacttaccgctaggtaccgtccggggtcgggggtccgttacaccgatccaccagagacacgtacgaggacgacaactactatacttactaaacaaactcgacctacgacggtaccctggaacgtacggtacggaacgggacctaccgggtacccgttagttaaacgttgttacggttaggacggtaaacggtacgtaaacccgtcccccgggtaaaaacgggtcccgtaaacccccgttaacggtttgggttaaccggtttccttttaacggtaagtttttcccggg

SEQ ID NO: 393848 - DNA, 587 bp, Homo sapiens
  misc_feature: GZ8MTXP02H3J6I.38.28.C06.1.454.CMB.2.raw
  modified_base (261)..(261): a, c, t, g, unknown or other
  modified_base (470)..(470): a, c, t, g, unknown or other
  modified_base (488)..(488): a, c, t, g, unknown or other
tcagtcgatcacgtcacgaccggtgctcgatttagagctcacgtattgggtttgggggaggcttggttcagcctgggggggtccctgagactctcctgtgcagtctctggattaacctttagtgactatgccatgatctgggtccgccaggctccagggaaggggctggagtgggtctcagcaattaatggtaggggtgattcacatattacgcagactccggtgggggccgttcaccatcaccagagacaactccaggancacactatatctaacaaatgcacagcctgagagtcgaggacacggcgtgtattattgtgcgagagactccccgaaaggtcgaccctaccgtttgggtgtcctttttgacttttcgtggttcgggccgaaaggggactaagttcgggtaccacccgttctcttcacgccctccaacgaacgggcccagtccggtccttcccccgtggccnccctcgcctccgagggcnccaccgtccgagacgacacgtacgccggcccgtggggcctcggccgtggtacaacggtacctacctccgacgtcgaatccgactcggagcggctggacg

SEQ ID NO: 393849 - DNA, 654 bp, Homo sapiens
  misc_feature: GZ8MTXP02HI28K.38.28.C06.1.454.CMB.2.raw
  modified_base (182)..(182): a, c, t, g, unknown or other
  modified_base (424)..(424): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcttttctgtggctattttaaaggngtccagtgtgaggtgcaggtgtcggagtcgtgggggagcttggttcacggcccgggggtccctgagtactctccgtgtgcagtctcgtggatttaccttagtgactatgccatgatcgtcggtccgcgaggccgtccgagggaagggcgtggaggtgggtctcgagactaagttagtggtaccggggtagattacacctatacttacgcgagacgtccggtgggggtccgttacgacctacnccacccgaagacgaaccaacgtcccaaggacgacctaacctaactatacttacgaaactaagtacgacacacgacccgtacgacgaggacggacggaacgaccggtacccggtacggttacgttaacgttaggttcggtacggtaggtacgacgtaacccgtaaccggtaaccggtaaacccgtacccgttacggttacggtttacccgtttacgtttagttttaccggg

SEQ ID NO: 393850 - DNA, 554 bp, Homo sapiens
  misc_feature: GZ8MTXP02G9S1G.38.28.C06.1.454.CMB.2.raw
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccaccctctcctgcagggccagtcagagtgttttcaacggctacttagcctggtaccagacaaaacctggccaggctcccaggctcctcatctatggtacatccgtcacgggccactggtactcccagacacggttcagtggcaggtggtctggggtacaggacttcgacctctcacccatcagcagactgggagctagaagtatttgctagtgtattactgtcagtcagtatactaacgaacgaccgtactacgttttcggaccaagggggtaccaaaggtcgtaggaacgaaaccaaaacgaactaaggtacggctacggaccacacttacgttcg

SEQ ID NO: 393851 - DNA, 617 bp, Homo sapiens
  misc_feature: GZ8MTXP02FJNP0.38.28.C06.1.454.CMB.2.raw
  modified_base (261)..(261): a, c, t, g, unknown or other
  modified_base (340)..(340): a, c, t, g, unknown or other
  modified_base (370)..(370): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccaggggaaggggctggagtgggtctcagcaattaatggtaggggtgattcaccatattacgcagactccggtgggggccgttcaccatcacagagacaactccaggancacactatatctaacaaatgcacagcctgagagtcgaggacacggccgtgtattatgtgcgagagactcccgaacggtnaccctacgttgggtctcttttgattttcgnggtgggccgaaagggactaagtcgggtacaccgttctcttacacgtccctaccaacgacggccctacgtccggttcccctccccgtggccctcccgtcgccctaccgacggcgaccctacccgtcggaacgcgacccacgacgggcccggtcccgtggggcctcggtcccgtaggtaccgaaacggttccttaccgttacccgacgttagaaccgtacgacgtaggacggtccgggacgcggaacgg

SEQ ID NO: 393852 - DNA, 754 bp, Homo sapiens
  misc_feature: GZ8MTXP02IOT9E.38.28.C06.1.454.CMB.2.raw
  modified_base (283)..(283): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcgtttctaggtggctatttaaaggtgtccagtgtgaggtgcaggtgtcggagtcgtgggggagcttggttcaggcccgggggtcctgacgactctcctgtgcagtctcgtggattaaccttagngactatgccatgatcgtcgggtccgccgagggcctaccggaaggggaacggggtcgtaggggacggttggggtactccgaggacttaaagttaaagtggggttaacgggggtgtaactttacaacctattaaacgtttaccgcgtaaggtaaccggtcccggggttacggggggggccctttcgaaacccgtagttacccaaacccgaggaaacggtacctaaacccgtacccgaaaggggaaccgacctaaaccaaaccttaataaacgtaccttaaaactaaaacctaggacgaacgaactaccgtacggaacggtaggtacggaacggaaccggaaccgggcccggttacgtttaacgttaagtttaggttcggtacggaacggtaagaccgttaacccgtaaccggaaccggtaacccttaacccggttacggttacggtttacccttttacggtttttacgtttcg

SEQ ID NO: 393853 - DNA, 612 bp, Homo sapiens
  misc_feature: GZ8MTXP02H9U4E.38.28.C06.1.454.CMB.2.raw
  modified_base (307)..(307): a, c, t, g, unknown or other
  modified_base (492)..(492): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggagcgttggttcaggcccgggggttccctgagactctcctgtgcagtctctggattaaccttagtgactatgccatgatcgtggtccnccaggcctccgaggggaagggctgggagtgggtctcgagactaaagttaagtggggtacggggtgtagtttcaacctattacttacgcgaacggtacgttcccgggggtggggggtccccgtttccacctactccgaaccagacgaaccaaccgtcccgaggacgcaacaactatataccgtaanaaatgacacagcctagaagtcgacgaaggaccacggttccgtgttaacttagttgtcgacgtagacgaccgtacccgaacggtcgaccctaccgttggtcgttcttttaggtactttcgg

SEQ ID NO: 393854 - DNA, 587 bp, Homo sapiens
  misc_feature: GZ8MTXP02F4XRV.38.28.C06.1.454.CMB.2.raw
  modified_base (396)..(396): a, c, t, g, unknown or other
  modified_base (449)..(449): a, c, t, g, unknown or other
  modified_base (481)..(481): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttttcttgtggctaattttaaaaggtgtccagtgtgaggtgcaggtgtcggagtcgtgggggaggcttggttcaggcccggggggtcctgagactctcctgtgcagtctctggtatttaaacctttagtgaactatcgaccatgatcgtggtccgcaggctccgaggggaagggcgtggagtgggtctgagacaataaagtggggtaaggggtgtattcaacctataacttacggnacgacgtccggggtggggggacccgttcaaccatccaaccagacgaactaacncaggacactaacactatactactaacaaatanacacacgacctacgagagacgaggacgacggacgtagtattattagtgacgacgagacgtaccgaacgtaacgacctaccgttcgtgtacgtttcgttactttacg

SEQ ID NO: 393855 - DNA, 620 bp, Homo sapiens
  misc_feature: GZ8MTXP02GESPH.38.28.C06.1.454.CMB.2.raw
  modified_base (214)..(214): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccgaggggaanagccaccctctcctgcagggccagtcagtagttgtttcaacggtctacttagcctggtaccagacaaaaccgtggaccaggcctacccaggcctcctcactctatggtaccactccgtcgacgggccacgttcggtactacccagacctaggttccgagtggacgtagggttcgggtacgtggggacaggtaccttcaccgttctacacctatcgagcgaaggtacgtaggagtcgtaggtaagttagtttcgattaggttagttacgttactggtacagtacctaagttactaaacctagaaacgtaccgttagtacgtttacgggaccgtaaggggaccctaagtaccggaggaccgaaaaccgtaaacgtacgtaaggtcgacgtcgaccgactactcgtttc

SEQ ID NO: 393856 - DNA, 641 bp, Homo sapiens
  misc_feature: GZ8MTXP02ININF.38.28.C06.1.454.CMB.2.raw
  modified_base (406)..(406): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggtcttaattttaaaaggtgtccagtgtgaggtgcaggtgtcggagtcgtgggggaggtcgttggttcgacgggtcccgggggtcctggacgtactctcctgtcgcagtctcgtggtaatttaaccgttgtgtactatcgacctatcgtactcggtcgggtcccgccgaggccgtaccggaaggggaacgggcgtgggaggtgggtctcgagtactaaagttaggtgggtaggggtntatcaacgtataacgttacgcgtacgtaccggtcggggtcgggggtccgtacacctacaccacgaagacgaacactaccgagacgacactaactataactactaaacaatcgacaactcgacctagacgtacgacggacggaccgtacggtcgtagttacttagttggacgacgtaagacgtacctaccgaacggtcaccgtacggtttcgtagtttctttacgttacgtttcgg

SEQ ID NO: 393857 - DNA, 544 bp, Homo sapiens
  misc_feature: GZ8MTXP02FS1GU.38.28.C06.1.454.CMB.2.raw
  modified_base (408)..(408): a, c, t, g, unknown or other
  modified_base (495)..(495): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttcttgtggctaattttaaaaggtgtccagtgtgaggtgcaggtgtcggagtcgtgggggaggcttggttcaggcccgggggtcctgagactctcctgtgcagtctctggattaacctttagtgactatgccatgatcgtggtccgccagggctccgagggaaggggctggagtgggtctcagcaataagtggtacggggtgattcaaccatacttacgcagactccggtgggggccgttcaccgntcaccagagaacaactccagagcaacactatactacaacaaatcgacacaggcctgagagtcgagacaacggcctaggattattggngcgagacacacccgaacggcaccgtacttggtactctttcgtactttcg

SEQ ID NO: 393858 - DNA, 715 bp, Homo sapiens
  misc_feature: GZ8MTXP02FQ7WH.38.28.C06.1.454.CMB.2.raw
  modified_base (313)..(313): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttctgtggctaattttaaaaggtgtccagtgtgaggtgcaggtggtcggagtcgtgggggaggcttggttcaggcccgggggtcctgagactctcctgtgcagtctcgtggtattaaccttagtgactatcgccatgatcgtggggtcccnccgagggcctaccggaggggaacggggcgtagggaggttggggtcctacgagacgtaaagtttaaaggtggggtaacggggttgtaacttaccgaacctaattaacgtttaaccgacgaacggtacccggttcccgggggtaccggggggtcccggtttaccaacccgtatacccgaacccgaaaggaaccgaaactaacccgtacccgaagggacaccaacaacttaatacttactaaacgaaagtcgaccacgtacgcccgtagacgtaggtaccggaacgggaccaccggggtcgttagttaacgtttagttgggagtaccggaaggacgtaccgttaccccggaaaacggtcgtaacccccgttagtttgggtacttcgtttttaggtacttttcggg

SEQ ID NO: 393859 - DNA, 584 bp, Homo sapiens
  misc_feature: GZ8MTXP02IRZ2J.38.28.C06.1.454.CMB.2.raw
  modified_base (325)..(325): a, c, t, g, unknown or other
  modified_base (333)..(333): a, c, t, g, unknown or other
  modified_base (356)..(357): a, c, t, g, unknown or other
  modified_base (405)..(405): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgacttattccatgatctcgggtccggccacggcgtccagggaaggggcgtggaggtgggtcgtcagcaattaagtggtaggggtggattcaccatatacgcagacgtccggtcggggccggtccacactcacanagacaacncacgagcacatatatcaacaaanncaccagcctgagagtacgaggacgacggcgtgttattgttgtgcgagnactcccgaacgggtagaccctaccgtttgggttcgtctttttggtctttacgttggtacggaccgaaagggtacaatcgggtcaccgtcttcttcgacgccctcaccgaacgggtccacgtcggttccctcccgtcggccgccctcgactcccgaggaccgcaccgtcccgagacgacc

SEQ ID NO: 393860 - DNA, 607 bp, Homo sapiens
  misc_feature: GZ8MTXP02JO0D6.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcgttttctaggtggctaatttaaaggtgtcagtgtgaggtgcaggtgtcggagtcgtgggggaggcgttggttcaggcccggggggtcctgagactctcctgtgcagtctctggattaaccttagtgactatgcatgatcgtggtccgccaggctccgagggaagggcgtgggagtggggtctcgaggactaatttaaagtggggtaagggtcgatttacaaccgtatattacgcacgtacggtccggtcggggggtccgttacgaacctctacgaccgaagacgaacaactcccgaggacacaacacctatactactaaacaagagacaacacgacctacgagagacggaacggacgacggtccgtcgtacgttacgttagtgtacgacgagacgtaccgaaccggtaacgaccgtaaccgttcggtagtccgtttcgttatttcgg

SEQ ID NO: 393861 - DNA, 589 bp, Homo sapiens
  misc_feature: GZ8MTXP02H8GFR.38.28.C06.1.454.CMB.2.raw
  modified_base (386)..(386): a, c, t, g, unknown or other
  modified_base (455)..(455): a, c, t, g, unknown or other
  modified_base (484)..(484): a, c, t, g, unknown or other
  modified_base (566)..(566): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggaggcttggttcaggcccggggggtccctgagactctcctgtgcagtctctggattaaccttagtgtactatgccatgatcgtgggtccgccaggctccgaggggaggggctgggagtggggtctgagacaagttaagtgggtaggggtgtattcacctatattacgngagtactccggggtgggggcccgttcgacctatccgaccagacgaacaactccgaggagacacacttanatctaaacaaatgccaacagcctgaacgngtaccggaggaccgacggccgttaggtatttacgtggtgacggaagacgtacgtccccgaaggttcgaccctaaccgttggngttccgttttggtaacttttcgg

SEQ ID NO: 393862 - DNA, 641 bp, Homo sapiens
  misc_feature: GZ8MTXP02HGUOF.38.28.C06.1.454.CMB.2.raw
  modified_base (336)..(336): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcgagcaaattaagtgggtaggggtgattcaccatattacgcagacctccggtgggggccgttcaccatcaccagagacaactccaggancactactatatactaacaaatcgaccacacgcctagagacgtacggagggacacggccgtagttattatggtggacgagagtacgtcccgaacggtacgacctaccgtttggtcgttcgttttagacgttttctggttcggacccgtaaagggacctaaagtcgtacctaccgttctcttacgaccgtaccctacccgaaccgtaaacgggcccccttaagtcccgggttccctttcccccggtcgcccgtcccccgttcggaacccttcccggaacgggccaccgaccccgtccggaacgaccg

SEQ ID NO: 393863 - DNA, 619 bp, Homo sapiens
  misc_feature: GZ8MTXP02JQMRH.38.28.C06.1.454.CMB.2.raw
  modified_base (340)..(340): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctgggagtgggtctcagcaattaatggtaggggtgattcaccatattacgcagactccggtgggggccgttcaccatcaccagagacaactccaggagcacactatatctacaaatgcacagcctgagagtcgaggacacggccgtgtattatgtgcgagagactcccgaaaggtnaccctacttgggtctcgtttttgattttctggtcgggcccgaaaggggactaaagttcggtcctaccgttcttccttcacgtccctacccaccgacgggccccagtcccggtccttcccccgtggcccgccctcgcctccgacggacgccacccgtaccgacgacgccaacgcggccgggcccgtggggccttcggcccgttcgggtaccgaaacgggtaccttaaccgttccgaaccggttgaacgttcggacgtcggacggcgggaccgtggaccgg

SEQ ID NO: 393864 - DNA, 637 bp, Homo sapiens
  misc_feature: GZ8MTXP02JYQCT.38.28.C06.1.454.CMB.2.raw
  modified_base (270)..(270): a, c, t, g, unknown or other
  modified_base (285)..(285): a, c, t, g, unknown or other
  modified_base (502)..(502): a, c, t, g, unknown or other
  modified_base (579)..(579): a, c, t, g, unknown or other
  modified_base (588)..(588): a, c, t, g, unknown or other
  modified_base (619)..(619): a, c, t, g, unknown or other
tcagtcgatcacgtcacgaccggtgctcgatttagagctcacgtattgggtttgggggagctctgagagaggagcccagccctgggattttcaggcgttttcatttggtgatcaggactgaacagagagaactcaccatggagttttgggctgagctggctttttcttgtggctattttaaaaggtgtccagtgtgaggtgcaggtgtcggagtctgggggaggctttggttcaggcccgggggtcctgagactctcctgtgcagtctcnggattaacctttagngactatcgccatgatcgtcggggtccgccgagggcctccgaagggggaagggctaggagtggggtctcgagctaaattaaagtggggttaacggggtgtacttcaaccgtataacgttaccgcgaacgtaccgttcccgggggtcggggggtcccggttccaacccgtaacgtcccaaaccgaaaggaacgaacccaaaccgtacccgaaggggacncaaaccctactaaattactactaaacgaaaatgaccacagcctagagagtcgacgggacaccggggctaggtatttnttgcgcganacgactcccgaaggtcaccgttacgttggtnttcgttttgacttttcgg

SEQ ID NO: 393865 - DNA, 695 bp, Homo sapiens
  misc_feature: GZ8MTXP02JPQ0J.38.28.C06.1.454.CMB.2.raw
  modified_base (214)..(214): a, c, t, g, unknown or other
  modified_base (266)..(266): a, c, t, g, unknown or other
  modified_base (279)..(279): a, c, t, g, unknown or other
  modified_base (313)..(313): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccagggaagggctggagtgggtctcagcaattatgggtaggggtnatcactatatcgnagcgtcggtggggcctacacatcacagacacacncgagacacacactatactactaacaaagtcgacccacgacgccgtaggacgtacggtacggacggaccgacgggtaccgttagttaagtttacgttcggtacgacgtaaggaacgtaccgtacccggtaaacgggtaccgaacccgttacggtttaggttcgtttacgttttacgttacttttcggaggttacgggaaccggtaaagggtactaacggttcggtaccgtaccgttcttcgttacgaccgtccccgtaccgaaacccggtaaccgggtcccttacggttccccgggttaccccttcccccggtcgggtccccgtcccgtacgtccccgtaccggaacggtacccgtacccgtaacccggtaccggaacgaccg

SEQ ID NO: 393866 - DNA, 613 bp, Homo sapiens
  misc_feature: GZ8MTXP02FXZJB.38.28.C06.1.454.CMB.2.raw
  modified_base (216)..(216): a, c, t, g, unknown or other
tcagtcgatcacgtcacgaccggtgctcgatttagagctcacgtattgggtttgggggagagctctggagaagagctgctcagttaggacccagagggaaccatggaaaccccagcgcagcttctcttcctcctgctactctggctcccagattccaccggagagattgtgttgacgcagtctccaggccaccctgtctttgtctccgaggggaangccacctctcctgcgagggccagtcagtagttgttttacaacggtctacttacgcctggtaccagacaaaaccgtggaccaggcctcccgaggcctcctcactctatcggtacacgtccgtcgacgggccacgtacgtactccagacgtaggttcagtggactaggtcgggtcgtggggacacggtacttcacgtctacacctatacagacaagtaagtgggaacggtctaaggaacgttagtttacgagtagttacgttaatttacgtgtacaggtacctaagtactaactaacgaaacgtaccgttactacgtttcggaccgacggggtaacacggtacgtaggaacgtaaaccgaaacgtaacgtggtacgacgtacgaccactacgtctttcg

SEQ ID NO: 393867 - DNA, 602 bp, Homo sapiens
  misc_feature: GZ8MTXP02I6GRY.38.28.C06.1.454.CMB.2.raw
  modified_base (270)..(270): a, c, t, g, unknown or other
  modified_base (333)..(333): a, c, t, g, unknown or other
  modified_base (403)..(403): a, c, t, g, unknown or other
  modified_base (452)..(452): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaagtgggtaggggtnattcaccatattacgcagactccggtgggggccttcaccatcaccagacgacaactccaggancacactatatacaacaaatgacccaacagcctagagaggtcgaggaccacgggccgttgtaatttagtgngacgagagactcccgaacggtcacctccttagtgtctttagattttcgngtggaccaaagggacaaagtggtaccacgtctcttcgaccgtcctaccaaccgaacgggtcccaacgttcccggtaccctttcccccgtggcccccgtcccttccgccgtaccccgtaaggaccgccctaccccgtaccggacgaacccg

SEQ ID NO: 393868 - DNA, 601 bp, Homo sapiens
  misc_feature: GZ8MTXP02I423O.38.28.C06.1.454.CMB.2.raw
  modified_base (214)..(214): a, c, t, g, unknown or other
  modified_base (259)..(259): a, c, t, g, unknown or other
  modified_base (338)..(338): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgagggaaggggctggagtgggtctcagcaattaagngggtaggggtgattcaccatattacgcagaccgtccggtgggggcccgttcaccgatccaccagagacaactccaggancacactatatctaacaaatgccacagcctagagacgtcgagggcacggccgtgtattagtgtgcgagagactacccgaacggtcgacctaccgttggtcgttcctttgtactttcgtcggtggaccgtaaggggacctaagtcggtcctaccgtcttccttcgacgtcccgtacccgtaacccgaacggggtcccacgtccggttcccttcccccgtcggcccgtcccgtcgccgtccgacggacgcctacccgcgacgaccg

SEQ ID NO: 393869 - DNA, 595 bp, Homo sapiens
  misc_feature: GZ8MTXP02HV089.38.28.C06.1.454.CMB.2.raw
  modified_base (213)..(213): a, c, t, g, unknown or other
  modified_base (255)..(255): a, c, t, g, unknown or other
  modified_base (290)..(290): a, c, t, g, unknown or other
  modified_base (325)..(325): a, c, t, g, unknown or other
  modified_base (333)..(333): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggtccctgagactctcctgtgcagtctctggatttaacctttagtgactatgccatgatctggtccnccaggctccagggaagggctggagtgggtctcagcaattaangggtaggggtgattcacatatacgcagactccggngggggccgttcacatcaccagagacaactcaggancacactanatctaacaaatgccaacagcctgagagtcgagggacacgggccgttgtaatttatgtgacgaagaagactcccccgaaaggtcgaccctaccgtttgggtctcgtttttagattttccgtgttacgggacctaaaggggactaaagttcggtacaacccgttcttcttcgaacgtccctaccaaccgtaacgggccccatcccggtcctcccccgtgggcctccccctggccctccgaggaccaccgaccctacggacgacg

SEQ ID NO: 393870 - DNA, 603 bp, Homo sapiens
  misc_feature: GZ8MTXP02G8ZQ1.38.28.C06.1.454.CMB.2.raw
  modified_base (213)..(213): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtcttgtctccaggggaaangccaccctctcctgcagggccagtcagagttgttttcaacggtctacttagcctggtaccagacaaaacctggccaggcctcccaggcctcctcatctatggtacatccgtcgacgggcctacgtcggtactcccgagacacggttcaggtggtaggtgggtcgtacggggacacgtacttacgactcctacaccatacagccagacgtgggagtactaggaagttagttttgactaggtttataagtttactaggttacagtactaagtaactaactaacgaacgtaccgtacttacgtttagccgtaacggggtaccaaggccgtaggaaacgaacccgtaaaacgacgttaggcggactacggactaacccagttcgtacgttaccc

SEQ ID NO: 393871 - DNA, 645 bp, Homo sapiens
  misc_feature: GZ8MTXP02F7MVZ.38.28.C06.1.454.CMB.2.raw
  modified_base (322)..(322): a, c, t, g, unknown or other
  modified_base (386)..(386): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcgaggtgtcggagtcgtgggggaggtcgttgggttcgagggccccggggggtccctggacgacctctcctgtgcagtctctggattaaccgttagtgactatgccatgatcgtgggtccnccaggcctccgaggggaagggcgtggaggtgggtctcgaggctaaattaagtgggtaaggggtnattcaacctattaacttacgcgacgacgttcccggggtcggggggtacccttacgacctatacccaacccgaagaacgaaccaaacgtcccgaaaggacgacaacactatatacctaaacaaatcgacacacgcctagagacgtcggaagaccgaacggtcgtagttacttagttggtcggacgtaggacgtaccgtaccccgtaaacggtcgtaacccgtaaccgtttgggtccgtttacgttttacgactttttcgg

SEQ ID NO: 393872 - DNA, 730 bp, Homo sapiens
  misc_feature: GZ8MTXP02G94ZC.38.28.C06.1.454.CMB.2.raw
  modified_base (214)..(214): a, c, t, g, unknown or other
  modified_base (341)..(341): a, c, t, g, unknown or other
  modified_base (372)..(372): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccncaggctcgaggggaagggctggagtgggtctcagctaaattaagtgggtagggtgattcacatatacgcagaccgtccggtgggggcccgttcaccgatccaccgagacgaacaacctccgaggacncaacactatactactaacaaatgaccccaancgtcctaggaaggtacgtacgggagggaccaaccggggtccgttagttaagtttagtgggtacgacggaagaaccgtacgtaccccgaaagggtcgaaaccctccggtttgggtccgtttacttttaggactttttcgagggttacggaacccgtaaagggggtaaccttaagggttcggtaccctaaccggtttcctcgtttaccgaacgtcccctaccgaaccccggtaaacgggtccccttagtcccccggtttaccccttcccccggtcgggcccccgtaccccgttcggaacccccgttcccggaaaaccgggtaccgccccgaaacccccggttccgggaaaacgaccccgg

SEQ ID NO: 393873 - DNA, 641 bp, Homo sapiens
  misc_feature: GZ8MTXP02FNIR7.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcgaggtgtcggagtcgtgggggaggcttgggttcgaggccccggggggtccctggagactctcctgtgcagtctctggtattaaccttagtgactatgccatgatctgggtccgccagggcctccgaggggacgggctgggaggtgggtctcgagactaaagttaagtggggtaggggtatagttcaaacctattacgttacgcgaacgtaccggttcccgggggtcggggggtcccgttacacccgtagtaccaacccgagaacgaacaacctccgaggacgaccaacactaatactacctaaacaaatcgaccaacacgacctaggagacgtcggaacggacaaccgggtcgttaaggttattacgttggtacgacggaagacgactaccccgtaaacggtcgacccgtacgttggtacgttcgttttgacttttcgg

SEQ ID NO: 393874 - DNA, 580 bp, Homo sapiens
  misc_feature: GZ8MTXP02H9OJ1.38.28.C06.1.454.CMB.2.raw
  modified_base (309)..(309): a, c, t, g, unknown or other
  modified_base (358)..(358): a, c, t, g, unknown or other
  modified_base (477)..(477): a, c, t, g, unknown or other
  modified_base (490)..(490): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctaattttaaaaggtgtccagtgtgaggtgcatgtgtcggagtcgtgggggagcttggttcaggcccgggggtcctgagactctcctgtgcacgtctctggtattaaccttagtgactatgccatgatcgtgggtcccncgtaggctccgaggggaggggctgggagtgggtctcgagacaaattagnggggtaggggtgtattaccgacattacgttacgctagtaccgtccggggtagggggcccgtttcaacccatccaccgagacgaaccactaccgaggacacactactatactacctaaanaactcacacgacncgtagagacggtacggacgacgcggtactagttattagtgcgacgacgacgtacaccgaacgtcgtaccttcgtgtcgtttctttacgtg

SEQ ID NO: 393875 - DNA, 713 bp, Homo sapiens
  misc_feature: GZ8MTXP02IOLPH.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctaatttaaaggtgtccagtgtgaggtgcgaggtgtcggagtcgtgggggagtcgttggttcgacggcccgggggtcctgacgactctcctgtgctagtctcgtggtactttaaccttagtgtactatcgcctatcgatcgtcggtcccgccgaggcctaccggaggggaacggggtctagggacggttcgggtcctacgacgtactaaagttaaaggtggggtaggggtagtacttacaacctaagttacgttacgcgtaacgtaccgtccgggggtcgggggtaccccttacgaacctactacccgaaccgacgaacgaaccaaccgtaccgaacgggacaccactaactatactacctaaactaaatcgaccaacgtacgaccgtagaagtacggtacggaacggaccgtaaccgggtcgttagttaacgttagtttggaacggtacgaaacggtaacgtacccgtaaccccggtaaacggtaaccgtaaccccgttacggtttcgggttactttccgtttttacggttacgttttccgg

SEQ ID NO: 393876 - DNA, 696 bp, Homo sapiens
  misc_feature: GZ8MTXP02H6ETL.38.28.C06.1.454.CMB.2.raw
  modified_base (198)..(198): a, c, t, g, unknown or other
  modified_base (282)..(282): a, c, t, g, unknown or other
  modified_base (339)..(339): a, c, t, g, unknown or other
tcagtcgatcacgtcacgaccggtgctcgatttagagctcacgtattgggtttggggaggcttggttcagcctggggggtccctgagactctcctgtgcagtctctggattaacctttagtgactatgccatgatctgggtccgccaggctccgagggaaggggctggagtgggtctcagcaattaatggtaggggtnattcacatattacgcagactcggtgggggccgttcacatcacagagacaactcaggagcacactatatctaacaaatgacaacngcctgagagtcgaggacacggctgtattattgtgcgagacgactacccgaaacggtnaacccgtacgttgggtacgttcctttttaggactttttcgtaggttacgggaccgaaaagggggtaactaaagtttcggggtacctaccccggtcttaccttacccgagtccccttacccgaaccgtaaacggggcccctaacgttcccggttcccttcccccgtcgggccctccccgtgccccgttccgaagggtaccgcctaacccgtcccggaagaaccgcaacggacggccccgggtccgtcgggccttcggaccccgttaggggtaccgaaaacgggtcccttaaccgtacccgtacggttacgaaccgttaccggacgtacggacgggccccggggttagcggggaaacgg

SEQ ID NO: 393877 - DNA, 575 bp, Homo sapiens
  misc_feature: GZ8MTXP02IF2SS.38.28.C06.1.454.CMB.2.raw
  modified_base (352)..(352): a, c, t, g, unknown or other
  modified_base (465)..(465): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttctgtggctaattttaaaaggtgtccagtgtgaggtgcaggtgtcggagtctgggggagcgttggttcagccgtgggggtccctgagactctcctgtgcagtctctggattaacctttagtgactatgccatgatcgtggtccgccaggctccgaggggaagggctggagtgggtctcgagcaattaagngggtagggtgacttcgaacctattacttacgcagtaccgtccggtggggggccgttcaccgatcacccagacgacaactcgaggagcacactataatctaaaccaatgaccanacgctagagcgacgagacgacgtcgtagttacgttagttcgtaggacgacgacgtaaccgtacccgtaacggtaccgtaccgttaccgttgttacgttcgtttacgtacg

SEQ ID NO: 393878 - DNA, 642 bp, Homo sapiens
  misc_feature: GZ8MTXP02HUYHP.38.28.C06.1.454.CMB.2.raw
  modified_base (185)..(185): a, c, t, g, unknown or other
  modified_base (262)..(262): a, c, t, g, unknown or other
  modified_base (306)..(306): a, c, t, g, unknown or other
  modified_base (369)..(369): a, c, t, g, unknown or other
  modified_base (483)..(483): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgttttctaggtggctatttaaaaggngtcagtgtgaggtgcaggtgtcggagtctgggggagcttgggttcaggcccgggggtccctgagactctcctgtgcngtctctggtattaaccttagtgactatgccatgatctgggtccnccaggctccgaaggggaggggctgggagtggggtcctgagcaaagttaagtgggtaggggttntactcactatacgtacgctacgtaccggtccggggtcgggggtccttaccacctactaccacgaagacgaacaacgccgaaggacactaactactatactaactaaacgaatanacacacgacgtagaggacggtacggacggacggaccggtacggttacgttacgtttagttagtacggtacggaacggtacgtaaccgtaacccggtaaccggtaaccggtaacccgttaccggttacggttacggtttacgtttacgtttacgtttacg

SEQ ID NO: 393879 - DNA, 634 bp, Homo sapiens
  misc_feature: GZ8MTXP02JPR80.38.28.C06.1.454.CMB.2.raw
  modified_base (372)..(372): a, c, t, g, unknown or other
  modified_base (499)..(499): a, c, t, g, unknown or other
tcagtcgatcacgtcacgaccggtgctcgatttagagctcacgtattgggtttggggagaagaggaagactgacggtcctgccacaggtggtgctgggcacggtgggcactcgacacaacattttgcgctcaactgtcttgtccaccttgctgagctggctttttcttgtggctattttaaaaggtgtccagtgtgaggtgcaggtgtcggagtcgtgggggaggcttggttcaggccgtggggggtccctgagactctcctgtgcagtctctggattaacctttagtgactatgccatgatcgtgggtccgcacggctaccgaggggaggggctgggagtgggtctcgagctaattaagtgggtaggggtnacttcgacctattacgttacgcgagtacccgtccggggtcggggggacccgtttcgacccacgtccaaccgaaggacaacgaactccgaaggacgacaactactaataattacctaaacaaaagttnaccaacgacgacccgtagaaggacggtacggaacggaaccgacgggtaccggttagttagttaacgttggtaggcgaacggacgtacgaacccgaaacggggttcaacccgtacgtttcggtcgtactttttcgg

SEQ ID NO: 393880 - DNA, 640 bp, Homo sapiens
  misc_feature: GZ8MTXP02IRUUD.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggaggcttggttcgaggccccggggggtccctgagactctcctgtgcagtctctggatttaaccttagtgactatgccatgatctggtccgccaggctccgaggggaaggggctgggaggtgggtctcgagactaattaagtggggtaggggtgtattcacctattacttacgcgtaagaccgttccggggtcggggggtcccggttacaacccgtatccgaacccgaggacgaaaccaaccgtacccgaaggacgaccaactactatactactaaacaaatcgacacgagcctagacgagtcggaaggaccgaacgggtccgtagttaactttgttcgtcggacgaacgacgacccttacccggaaacggtcgaaaccccgttcgtttacgggtcggtttacctttttaggtactttttcgg

SEQ ID NO: 393881 - DNA, 610 bp, Homo sapiens
  misc_feature: GZ8MTXP02JHNIM.38.28.C06.1.454.CMB.2.raw
  modified_base (274)..(274): a, c, t, g, unknown or other
  modified_base (288)..(288): a, c, t, g, unknown or other
  modified_base (298)..(298): a, c, t, g, unknown or other
  modified_base (337)..(337): a, c, t, g, unknown or other
  modified_base (457)..(457): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctggggggtccctgagactctcctgtgcagtctctggattaacctttagtgactatgccatgatctgggtccgccaggctccgaggggaaggggctggagtgggtctcgagcaaattaagtgggtaggggtnattcacatatacgnagacctcggngggggccgttcaccatcaccagacgacaactccgaggancaacactatatctaacaaatgacccacagcctaggagagtcgagggacacggtccgtgtaattagttgagcgagagactccgaacggtgaaccctccgttggtgttctttgtattttcgnggtcggaacgaaggtaactagtcgtaccgtaccgtctctcgacctcccgtaccgaaccggaccggtaccctacggttcccggtcccttaccccggtccgtcccgtcccgtcgcccgtaccgacggtaccgacccgtaccgtaccggacgaccg

SEQ ID NO: 393882 - DNA, 605 bp, Homo sapiens
  misc_feature: GZ8MTXP02HY1GG.38.28.C06.1.454.CMB.2.raw
  modified_base (307)..(307): a, c, t, g, unknown or other
  modified_base (335)..(335): a, c, t, g, unknown or other
  modified_base (340)..(340): a, c, t, g, unknown or other
  modified_base (350)..(350): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagccgtggggggtccctgagactctcctgtgcagtctctggattaacctttagtgactatgccatgatctgggtccgccaggcctccgaggggaaggggctgggagtgggtctcgagctaagttaagtggggtaggggtgtattacaccatattacgcagacgtcggngggggccgttcacatcacagagacaacncagancacactatanactaacaaatgacccacacgcctagagacggtacgacgggacgaacggtccgtagttaagtttagttgtaggaccgtagaagtacgacccgaaacggtcgacctaccgttggtcgttcttttgtactttcgtgttacggaccgtaagggacctagtcggtacctaccgtcttctacgctccctccgaacgacggccctacgttcccgtccttccccgcggcctccctcgccgtacgacgcgcacccgcgagaccg

SEQ ID NO: 393883 - DNA, 602 bp, Homo sapiens
  misc_feature: GZ8MTXP02HDV6W.38.28.C06.1.454.CMB.2.raw
  modified_base (469)..(469): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggaggcttggttcaggcccgggggtcctgagactctcctgtgcagtctctggtattaaccgttagtgtactatgccatgtatcgtcgggtccgccaggcctccgaggggaagggcgtggaggtgggtctcgagactaaagttagtgggtacggggtgattcacgtatattacgcaggacgtccgggtcgggggccgttcaccagtaccgaccgacgagaccacgtcccaggacgcaacactatactacaaanaaatcgacaacgacggacctagaaggacgacggaacggaccgacggccggttagtaatttagttggagcggagtacgtaccgtacccaaaggtccgaaccgtaccgtttggtcgtcgttttcggtattttcgg

SEQ ID NO: 393884 - DNA, 615 bp, Homo sapiens
  misc_feature: GZ8MTXP02IM7H7.38.28.C06.1.454.CMB.2.raw
  modified_base (278)..(278): a, c, t, g, unknown or other
  modified_base (299)..(299): a, c, t, g, unknown or other
  modified_base (355)..(355): a, c, t, g, unknown or other
  modified_base (459)..(459): a, c, t, g, unknown or other
  modified_base (478)..(478): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaggtgtccagtgtgaggtgcaggtgtcggagtctgggggagcttggttcaggcccgggggtcctgagactctcctgtgcagtctctggattaaccttagngactatgcatgatctggtccncaggctccgagggaaggctggagtgggtctgagactaattaaagtgggtaggggtnagttcacctattacttacgcgtagaccgttccggggtcgggggcccggttcaccctagtacccaacgaggacgaccgaacctcccgaagggacacacgaactanatactaacaaatgccaacnggacctagagagtcggaacgacgacggtaccgttagttaacgttagtttggagaccggaagtacgtaaccgtaccccgtaaacgggtaacgacccctaccggtttggggttacttccgtttttaggactttttccgg

SEQ ID NO: 393885 - DNA, 713 bp, Homo sapiens
  misc_feature: GZ8MTXP02HQADH.38.28.C06.1.454.CMB.2.raw
  modified_base (213)..(213): a, c, t, g, unknown or other
  modified_base (268)..(268): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaagggctggagtgggtctcagcaattaatgggtaggggtnatcactatatacgcacgcgtcgggtcggggtcctcaccatccacagacgacaactcgaggacacactactatatactaacaaatcgaccaacacgcgtaggagtacggtacggacgggaccgaccgggtaccgttagttaattagttggacgggacgaacggaacgtacccgtaacccggaacgggttaccgtaacccgttaccggtttgggttcgtttcgttttaggttacgttttcggtacgggtacggtaaaccggtaaaggggtaactaacggttcggtacccgtaccgttccttacctccgaccgtacccctacccgaacccggtaaccgggtacccctacgttccccggttcccctttcccccggtccgggtcccccgtaccccgtcggtcccgtacccggaacggtacccgtacccgtacccggtaccgacggtaccg

SEQ ID NO: 393886 - DNA, 661 bp, Homo sapiens
  misc_feature: GZ8MTXP02H06XP.38.28.C06.1.454.CMB.2.raw
  modified_base (214)..(214): a, c, t, g, unknown or other
  modified_base (519)..(519): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccgaggggaangccaccctctcctgcgagggccagtcagtagttgtttacaacggtcttactagcctggtaccagacaaaaccgtcggaccaggcctcccgaggcctcctcacttctatacggtacctacgtccggtacgacgggccctacgtcggtaactaccccgagacgtacggttacaggtggaccgtagggttcggggttcgtaggggacctacggtaccttcgacctcctcaaccctataccgagtacgacgtacgtaggggacggtacgtagtaagttatttggactaggttagttacttacgtcgtanacgtactaacgttactactaacgaaacgtacccgttacgttaccgtttacggacggtaacgggggtaccaaggtcgtaaacggaccgaaaaaccgtaacgtaacgtaaggtacgacgttacaccgtaacctgttacctaccg

SEQ ID NO: 393887 - DNA, 597 bp, Homo sapiens
  misc_feature: GZ8MTXP02IUQGE.38.28.C06.1.454.CMB.2.raw
  modified_base (280)..(280): a, c, t, g, unknown or other
  modified_base (304)..(304): a, c, t, g, unknown or other
  modified_base (363)..(363): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttcttgtggctattttaaaaggtgtccagtgtgaggtgcaggtgtcggagtcgtgggggaggcttggttcaggcccgggggtcctgagctctcctgtgcagtctctggattaaccttgngactatgccatgatctcgggtccnccaggctccgaggggaacgggctggagtgggtctcagctaattaagtgggtacggggtnattcacctattacttacgctaggaccgtccggggtcggggggtcccgttacaaccgtactccgaacccgaggaacgaaccaaccgtcccgaaaggggacacaaccactatactaccttaaacaaaatcgacacgagcctagagagtcggagacacgggctagtattactgtcgcgtagacgactacccgaacggtcgacccgtacgtttcgggtctcgttttacgtattttcgg

SEQ ID NO: 393888 - DNA, 544 bp, Homo sapiens
  misc_feature: GZ8MTXP02IJOK2.38.28.C06.1.454.CMB.2.raw
  modified_base (263)..(263): a, c, t, g, unknown or other
  modified_base (280)..(280): a, c, t, g, unknown or other
  modified_base (284)..(285): a, c, t, g, unknown or other
  modified_base (288)..(289): a, c, t, g, unknown or other
  modified_base (300)..(300): a, c, t, g, unknown or other
  modified_base (303)..(303): a, c, t, g, unknown or other
  modified_base (312)..(312): a, c, t, g, unknown or other
  modified_base (314)..(314): a, c, t, g, unknown or other
  modified_base (316)..(316): a, c, t, g, unknown or other
  modified_base (361)..(361): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggccttttctgtggctattttaaaaggtgtccagtgtgaggtgcaggtgtcggagtctggggagcttggttcaggcccgggggtcctgagactctcctgtgcagtctntggattaaacctttagnatanncannatcgtcgcgcngcncgaggaggngngngtggtcgtcagacaataagtaggtaggtagtatacactatatacncacgacgtcggtcggggtccgtcgacacacacagagacacacgagacgacacaactatatactaacaaatacgacacacacgtacgagagacgacgacgacgacgtagtacgttagttagtcgacgagacgaactacgaacgtaacgtaccgtacgttacgtcgttacgtttacgttagttcg

SEQ ID NO: 393889 - DNA, 617 bp, Homo sapiens
  misc_feature: GZ8MTXP02GG88Y.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcgttgggttcgacgggccccggggggtccctggagactctcctgtgcagtctctggtattaaccttagtgactatgccatgatcgtggtccgccaggcctccgaggggaaggggcgtgggagtggggtctcgagactaaagttaagtgggtaggggtgattcaactattacttacgcgtaagaccgtccggggtaggggggtcccgttacacctatccaaccgagacgaaccaactccgaaggacgacaacaactatactactaaacaaatcgacaacgacgacctaggagaggtcggaacggaccgacggtcgttagttaacgttagtggtcggacgaggacgacgtacccgaaggtcgaccctacgtttggtgttacttttggacttttcgg

SEQ ID NO: 393890 - DNA, 757 bp, Homo sapiens
  misc_feature: GZ8MTXP02FTDNV.38.28.C06.1.454.CMB.2.raw
  modified_base (387)..(387): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatatctaacaaatgcacagcctgagagtcggaggacacggccgtgtattattgtgcgagagactccccgaaacggtcgaaccctaccgtttgggtacgttcctttttaggactttttcgnggttcgggacccgtaaaagggggactaaaagttcggggtacctaacccggtttccttcctttacccacggtcccccttacccgaaacccgaaaccggggtacccccgtaacgtttcccgggttccctttcccccccggttcgggtcccccgtcccccgttcggtaccccgttacccgaacggggtacgacccctaccccgtacccgggaacggaccgaccgaaccgaacgggcccgggaccccgtggggcccgttcggcccggttacgggtaccgaaacgggtaacccgttacccgttacccgaccggtaccggaacgtttacccgggaaccgttcgggaaccggtcgggggccgttacggggaacccgg

SEQ ID NO: 393891 - DNA, 582 bp, Homo sapiens
  misc_feature: GZ8MTXP02FIPQW.38.28.C06.1.454.CMB.2.raw
  modified_base (214)..(214): a, c, t, g, unknown or other
  modified_base (347)..(347): a, c, t, g, unknown or other
  modified_base (540)..(540): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgagggaaggggctggagtgggtctcagcaattaagtgggtaggggtgattcacatattacgcagactccggtgggggccgttcaccatcaccagagacaactccaggagcacactatatctaanaaatgcacagctgagagtcggagaccacggccgcgttattatgtgcgagagatcccgaaggtcgaccaccgttggtcgtcttttgattttcgtgtcggaccgaaggggactaaagttggtacctaccggttcttcctttcgacgccctacccgaaccgtaacgggccctaacgttccggtacccttcccccgnggcccgcccttgccgtccaaggacgccacccgtcgacgaccg

SEQ ID NO: 393892 - DNA, 681 bp, Homo sapiens
  misc_feature: GZ8MTXP02HDA1J.38.28.C06.1.454.CMB.2.raw
  modified_base (272)..(272): a, c, t, g, unknown or other
  modified_base (339)..(339): a, c, t, g, unknown or other
  modified_base (348)..(348): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaagggctggagtgggtctcagctaaattaagtgggtaggggtnattcaccatactacgcagaccgtccgggtgggggcccgttcaccgatccaaccgagacgaactaacnccagggacncaacacttatactactaaacaaagtcgacccaacgacgcctagaacgacgtcgaggggaccaacggggtccgttagttaatttagtggtcggacgaagacgtactacccgaaaggtcgaccgtaccgtttggtcgttcttttgtatttcgtggttacggaccgtaaaggggacctaaggttacggtacccgtaccggttcttaccttacgaccgtccccgtacccgtaacccgaaacggggtccccctaagttccccggtttccccttcccccgttcggccccgtcccttacggcccttaccgaacggtcgacccacccgtaccggacgaccg

SEQ ID NO: 393893 - DNA, 605 bp, Homo sapiens
  misc_feature: GZ8MTXP02JBL2L.38.28.C06.1.454.CMB.2.raw
  modified_base (213)..(213): a, c, t, g, unknown or other
  modified_base (266)..(266): a, c, t, g, unknown or other
  modified_base (306)..(306): a, c, t, g, unknown or other
  modified_base (313)..(313): a, c, t, g, unknown or other
  modified_base (405)..(405): a, c, t, g, unknown or other
  modified_base (590)..(590): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccagggaagggctggagtgggtctcagcaattaatgggtaggggtnatcacatatacgcagcgtcgggtcgggggccgttcaccancacaganacactcgaggacacacactatactactaacaaatcgaccacagtcctaggagacgtcggacggaccacgggtcgttagttaatttagttggngacgagacgactaccgaacggtcgacccgtacgttggtcgttcgtttagtactttcgtggtacggaccgtaaagggactaaggttcggtacctaccgttcttctacacgtccctaccgaaccgacggccctacgttcccgttcccttccccgtcggcccgtcccgtcgaaccgtccgacggtacncctaccgtcgacgcg

SEQ ID NO: 393894 - DNA, 597 bp, Homo sapiens
  misc_feature: GZ8MTXP02G6VEZ.38.28.C06.1.454.CMB.2.raw
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggctttttcttgtggctattttaaaaggtgtccagtgtgaggtgcaggtgtcggagtctgggggaggcttggttcagccgtgggggtccctgagactctcctgtgcagtctctggattaacttagtgactatgccatgatcgtcgggtccgccgaggcctccggaggggaaggggcgtggggaggtcggggtctcgagacgtaaagttagtggggtaggggtgtattccactattacttacgcacggtaccgtccgggtcggggggtccgttcacctagtaccaccgagacgaacaccgtacgaggacgcaaccatactatacaaacaaagtcgacacgagcctagagtacgacggaacggacgacggacgttagttattagtgtcgacgagacgtctaaccgaacggtacgaccgtacgttggtcgtttactttggttac

SEQ ID NO: 393895 - DNA, 606 bp, Homo sapiens
  misc_feature: GZ8MTXP02GTSMM.38.28.C06.1.454.CMB.2.raw
  modified_base (269)..(269): a, c, t, g, unknown or other
tcagtcgatcacgtcacgaccggtgctcgatttagagctcacgtattgggtttgggctgagctggtctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtggtccgccaggctccgagggaagggctggagtgggtctcagcaattaatgggtaggggtnattcacatatacgcagactcggtgggggccgttcaccatcaccagagacaactccaggagcacactatatctaacaaatgaccacagcctagagagtcgaggacacgggccgtagtattatgtgcgagagactacccgaacggtcgaccctaccgtttggtcgtcttttgattttcgtggttggaccgtaaaggggacctaaagtcggtacctaccggtcttcctttcacgtccctaccgacccgaaacgggcccctaagtcccggttcccttcccccgtcggcccgccccgttcggaaccttcccgacggtacgaccgtaccctccggacgaaccg

SEQ ID NO: 393896 - DNA, 641 bp, Homo sapiens
  misc_feature: GZ8MTXP02FSM7Y.38.28.C06.1.454.CMB.2.raw
  modified_base (313)..(313): a, c, t, g, unknown or other
  modified_base (465)..(465): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttcttgtggctaattttaaaaggtgtccagtgtgaggtgcaggtgtcggagtcgtgggggagcttggttcagggtccccggggggtccctggacgactctcctgtgcagtctctggattaacctttagtgactatgccatgatcgtggtccncaggctccgagggagggctgggagtgggtctcgagtcaaattaagtggggtaggggtgactttacacctattaacgttaccgcaacgacccggttccgggggtcggggggtaccccgttccaaacccgtataccgaccgagacgaactaacncccgaagacgacaactactaactatactaaccaaaatcgacacacgcctagaacgagtacggaacggacgaaccgggtccgttaaggtactttaagttggtcgacgtaggaactacgtaccccgtaaaggtccgaaacccgttacgttcggttcgtttccgtttaggtcttttcgg

SEQ ID NO: 393897 - DNA, 734 bp, Homo sapiens
  misc_feature: GZ8MTXP02HVYYS.38.28.C06.1.454.CMB.2.raw
  modified_base (214)..(214): a, c, t, g, unknown or other
  modified_base (273)..(273): a, c, t, g, unknown or other
  modified_base (331)..(331): a, c, t, g, unknown or other
  modified_base (346)..(346): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaagggctggagtgggtctcgagactaattaagtgggtaggggtntattcacatatacgcagacgtcggtggggccgtcacatcacagagacactccaggacncacatatatactaanaaatcgaccacacgcctaggagacggtcgagggacacggtccgttataattagtgtagacgaagacgtacgtacccgaaacggtcgtaacccgtaccgtttagggtcgtttaccgtttttagaacgtttttccgtgggttacggaaacccgggttaaagggggtaaccttaaagggttccgggtacctaaccccggtttcttacccgttacgaaccggtacccctacccgaaaacccggtaaaccggggtacccctaacggtttcccccggggttaccccttttacccccccggcgggggtaccccctcccccgttaggaacccccgttacccggaacgggggttaccccaacccgtacccccggttaccgggaaaacggtaccccgg

SEQ ID NO: 393898 - DNA, 757 bp, Homo sapiens
  misc_feature: GZ8MTXP02GYEOD.38.28.C06.1.454.CMB.2.raw
  modified_base (252)..(252): a, c, t, g, unknown or other
  modified_base (273)..(273): a, c, t, g, unknown or other
  modified_base (340)..(340): a, c, t, g, unknown or other
  modified_base (360)..(360): a, c, t, g, unknown or other
tcagtcgatcacgtcacgaccggtgctcgatttagagctcacgtattgggtttgggctgagctggcttttttcttgtggctattttaaaaggtgtccagtgtgaggtgcaggtgtcggagtctgggggaggcttggttcagcctggggggtccctgagactctcctgtgcagtctctggatttaacctttagtgactatgccatgatcgtgggtccgccaggctccgaggggaaggggctggagtgggtctnagcaattagtgggtaggggtnattcacatatacgcagacgtccggtgggggcccgttcaccatccaccagacgacaactccgaagganacactaactatactactaanaaatgaccctaacgagcctaggacgtaacggtcggacggaaccgacggggtaccgttagttaaacgtttagttcgggtggaaccgtagaaacgtaaccttaccccggaaacgggttcggaacccttaaccggtttgggtacgtttccgtttttagtaacgtttttccgagggtttacggaacccggttaaaaggggaacctaaagggttccggtaacctacccggttctttaccttacgaccggtaccttaccccgaacccgaaaacggggtccccctaaacgtttccgggttcccccttcccccggttccggggaaccccttccccgttcggaaaccccgttcccgaacgggggtaacccccgtacccgtaacccggtacccggaaacgtacccgg

SEQ ID NO: 393899 - DNA, 601 bp, Homo sapiens
  misc_feature: GZ8MTXP02JLN5D.38.28.C06.1.454.CMB.2.raw
  modified_base (182)..(182): a, c, t, g, unknown or other
  modified_base (290)..(290): a, c, t, g, unknown or other
  modified_base (296)..(296): a, c, t, g, unknown or other
  modified_base (304)..(304): a, c, t, g, unknown or other
  modified_base (316)..(316): a, c, t, g, unknown or other
  modified_base (350)..(350): a, c, t, g, unknown or other
  modified_base (417)..(417): a, c, t, g, unknown or other
  modified_base (444)..(444): a, c, t, g, unknown or other
  modified_base (496)..(496): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcttttctgtggctattttaaaggngtccagtgtgaggtgcaggtgtcggagtcgtggggggagtcgttggttcgccggggtcccggggtcctgacgtctctcgtgtgactgtctgtaggtacttaacttagngaactncgcagtgntcggtcggtccncgacggtccgtcggaaggggaaggtcgtaggggnggttcgggttccacgagtaacgtaagttaaggtggggtaggggtactacttaccactattagtaccngacgcgtcgggggtcggggcgtcacgnaccacgagacacaacgcgaaggtccacaaactataatactactaaaggaaanacgacacacgacgagagacgacggacggacgacgtacgtagtacgttagtgtcgacgacgacgacgaccgacgaacgacgtacgtacgtcgtcgttacgtcgtcg

SEQ ID NO: 393900 - DNA, 610 bp, Homo sapiens
  misc_feature: GZ8MTXP02JS27L.38.28.C06.1.454.CMB.2.raw
  modified_base (356)..(356): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccgtgggggccgttcaccatcaccagagacaactccaggagcacactatatctaacaaatgcacagcctgagagtcgaaggaccacgggccgtgtattattgtgcgagagatccccgaaaggtgaccctacttggtntctttttgattttcgtgttcggcctaaaggggactaaagttgggtccaccggttcttccttccacgtccctacccaaccgtaacgggcccctacgtcccggtccttccccccgtgggcccgccccgtgccgtccgacggacgccaccgtcccgagacgcacgacgccggcccgtcgggcttcggccgtcgggtaccaaacgggtacctaccgttacccgacgttgaacgtcgacgtcggacgcgggctggaccg

SEQ ID NO: 393901 - DNA, 617 bp, Homo sapiens
  misc_feature: GZ8MTXP02H0VD8.38.28.C06.1.454.CMB.2.raw
  modified_base (288)..(288): a, c, t, g, unknown or other
  modified_base (309)..(309): a, c, t, g, unknown or other
  modified_base (358)..(358): a, c, t, g, unknown or other
  modified_base (370)..(370): a, c, t, g, unknown or other
  modified_base (477)..(477): a, c, t, g, unknown or other
  modified_base (491)..(491): a, c, t, g, unknown or other
  modified_base (615)..(615): a, c, t, g, unknown or other
tcagtcgatcacgtcacgaccggtgctcgatttagagctcacgtattgggtttggggagctctgagagaggagcccagccccgggattttcaggcgttttcatttggtgatcaggactgaacagagagaactcaccatggagtttgggctgagcgtggtctttttctgtggctattttaaaaggtgtccagtgtgaggtgcaggtgtcggagtcgtgggggagcttggtcacgggcccggggggtccctgacgactctcctgtgcagtctctggacttaacctttagngactatgcatgatcgtggccncgagctccgaggggacgggctggagtcgggtctcagactaaagttaggnggggtaggggtntacgttccactaattacttaccgctacggccggttccggggtcggggggtccccttacaccgagccaaacccagaacgtaaccacctcccggagactcaacaactanatacctaaagaaancacacgacgtacgagaggacgacggaacggacgtaccggtcgttagttacttacgtggtcgacgaagacgaccgtaccgtaacgtcgtaacccgtcggttcgtcgttcgtttacgtctttcggngg

SEQ ID NO: 393902 - DNA, 605 bp, Homo sapiens
  misc_feature: GZ8MTXP02GYEU4.38.28.C06.1.454.CMB.2.raw
  modified_base (306)..(306): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagctggctttttcttgtggctattttaaaaggtgtccagtgtgaggtgcaggtgtcggagtcgtgggggagcttggttcagccgtgggtggtccctgagactctcctgtgcagtctctggattaaccttagtgactatgccatgatcgtggtccncaggctccgaggggagggctgggagtgggtctgagactaattagtgggtagggtgattcaacatacgttacgcagaccgtccggggtgggggtcccttcacccataccgaccgagaacgaccaacgtccgaggacgaccaactactaaatactactaaacaaatcgaccaacacgaccgtagacggaacggtacggaacggacgaccggtaccgttagtttaaattgttcggtaggaccgaaggacgaacgaacccgtaaacggtacgaacccgtacccgttggttcgttacgttttag

SEQ ID NO: 393903 - DNA, 614 bp, Homo sapiens
  misc_feature: GZ8MTXP02F17J1.38.28.C06.1.454.CMB.2.raw
  modified_base (271)..(271): a, c, t, g, unknown or other
  modified_base (311)..(311): a, c, t, g, unknown or other
  modified_base (318)..(318): a, c, t, g, unknown or other
  modified_base (323)..(323): a, c, t, g, unknown or other
  modified_base (347)..(347): a, c, t, g, unknown or other
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtaggggtnattcacatatacgcagacgtccgggtgggggccgtcacancacaganacacncagagcacatatatactaacaatnccacacgctgagagcgaggacacggcgtattattagttgtgacgagagactaccgaacggtacgacccgtacgttggtcgttcgttttagtactttcgttggtcggaccgaagggaacgtaaacgttcggtaccgtacccgttcttaccttacgacgtaccgtacccgtaacccgaaccggacccgtaccgtaccggttcccgttccccgtcccggtcccgtcccgtccgtcccgtccgtaccggacgaccgaccgtaccgacgacg

SEQ ID NO: 393904 - DNA, 607 bp, Homo sapiens
  misc_feature: GZ8MTXP02G6IBL.38.28.C06.1.454.CMB.2.raw
  modified_base (345)..(345): a, c, t, g, unknown or other
  modified_base (466)..(466): a, c, t, g, unknown or other
tcagtcgatcacgtcacgaccggtgctcgatttagagctcacgtattgggtttgggctgagctggcttttttcttgtggctattttaaaaggtgtccagtgtgaggtgcaggtgtcggagtctgggggaggcttggttcagccgtggggggtccctgagactctcctgtgcagtctctggtatttaacctttagtgactatgccatgatcgtgggtccgcaggctccgaggggaaggggctggaggtgggtctcagactaattaagtggggtaggggtgtattcacctatattacgcagacgtccggtgggggccgtcaccatcacagacacaacctcgaggacncacaactatatactaacaaatcgaccacacgcctgaggtagcgaggaccgacggtccgtgttattagtgtagcgaagagactacccgaaggtcgacctcgttgtcgttctttgtatttcgngtcggtaccgaagggctagtcgtccacgttctcgtcacgccctaccaccggtaaccgggccctacgtcccgttccccgtcccccgtcggcccctcccgtcgtcccgtaccggacggcccaccctacccgaccgacgacccg

SEQ ID NO: 393905 - DNA, 680 bp, Homo sapiens
  misc_feature: GZ8MTXP02HD48W.38.28.C06.1.454.CMB.2.raw
  modified_base (314)..(314): a, c, t, g, unknown or other
  modified_base (379)..(379): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcttggttcacggcccgggggtcctgagactctcctgtgcagtctcgtggtactttaacctttagtgactatcgccatgatcgtcgggtccnccgaggcctccgaggggaacggggctgggaggtgggtctcgagactaagttagtgggtaggggtntattcacctatacttacgcgaagtaccggttcccggggtaggggggtcccgttacaacccgtactacccgaaccgaacggaacgaaccaaaccgtacccgaagggacgaccaaacctaactactaacttacctaaacaaaatcgacaacgacgacctaggacggtacgtacggaacggaaccgtacgggtaccgttaggttaacttagttggtacggaccggaagtacgtaccgtaccccggtaaacgggtccgaacccgttaccggtttggtacgtttaccgttttggttaacttttcgg

SEQ ID NO: 393906 - DNA, 514 bp, Homo sapiens
  misc_feature: GZ8MTXP02HQKN3.38.28.C06.1.454.CMB.2.raw
  modified_base (372)..(372): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccaggggaaagagccaccctctcctgcagggccagtcagagtgttttcaacggctacttagcctggtaccagcaaaacctggccaggctcccaggctcctcatctatggtacatccgtcagggccactggtgtccccagccaggttcagtggcagtgggtctggggacngagttcactctcaccatcagcagccctgcagtctagaatattttgctagttttattatttgtcagtcagtatgatcagtgcctcgatcaccttcggccgaggggacacgactggaacaagtaaacgactggtacggctcgac

SEQ ID NO: 393907 - DNA, 616 bp, Homo sapiens
  misc_feature: GZ8MTXP02I5Z7G.38.28.C06.1.454.CMB.2.raw
  modified_base (259)..(259): a, c, t, g, unknown or other
  modified_base (281)..(281): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggagcttggttcaggcccgggggtcctgagactctcctgtncagtctctggattaaccttagngactatgccatgatcgtggtccgccaggctccgaggggaaggggtctgggaggttgggtctcgaggactaagttaagtggggtaggggtagatttacaccgtattacttacgcgagaccgttcccggggtggggggtcccgttacgacctacgtaccaaccgagaacgaaccaacgtcccgaaggaccgacacaactatactactaaacaaatcgacacgagcccgtagacggacgtacggaacggaccgaacgggccgttaggttacttagtggtagcgagtacgacctcccgaaaggtcgaccgtaccgttggtacgtctttagtacttttcg

SEQ ID NO: 393908 - DNA, 600 bp, Homo sapiens
  misc_feature: GZ8MTXP02HYZYB.38.28.C06.1.454.CMB.2.raw
  modified_base (213)..(213): a, c, t, g, unknown or other
  modified_base (439)..(439): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctctgctactctggctcccagattccaccggagagattgtgttgacgcagtctccaggcaccctgtctttgtctccaggggaaanagccaccctctcctgcagggccagtcagagttgttttcaaacggtctacttagcctggtaccagacaaaaacctggaccaggcctcccgaggcctcctcatctatggtacatccgtcgagggcctacgtggtactccccgagactacggttcaggtggctaggtggggtcgtggggacaggtaccttcgacctctacaccatcgagcagactggagtctagaagtntttgcgtagttagtatttacgtgtacagactagttactaactaacgaaacggtaaccttacgtacgttttacgggaccgtaacggggaacccgaaagtcgtaacggaacgaaaccgaaaacgtacgtaaggtacggactacgaccaccgtacttacgttcg

SEQ ID NO: 393909 - DNA, 607 bp, Homo sapiens
  misc_feature: GZ8MTXP02IRQRB.38.28.C06.1.454.CMB.2.raw
  modified_base (286)..(286): a, c, t, g, unknown or other
  modified_base (311)..(311): a, c, t, g, unknown or other
  modified_base (358)..(358): a, c, t, g, unknown or other
  modified_base (368)..(368): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggttgagctggtctttttcttgtggctattttaaaaggtgtccagtgtgaggtgcaggtgtcggagtcgtgggggagcttggttcacggcccggggggtcctggagactctcctgtgcagtctcgtggattaacctttgngactatgccatgatcgtgggtcccncaggctccgaggggaggggctgggagtgggtctcgagactaattagngggtagggtntagttcactatattacgcagaccgtcgggtcggggggtcccttacaccgatccaaccagacgacaactcgaaggacgacaacaactactatactaaacaaaatcgacaacacgcctagacgaacggtacggaacggaaccgacgggccgtagtaaacgtttcgtaggttgaccgaagtacgacctacccggaacggtcgaaccgtcgttacggttcgtcgtttacgtactttcgtaggg

SEQ ID NO: 393910 - DNA, 617 bp, Homo sapiens
  misc_feature: GZ8MTXP02JRLQ5.38.28.C06.1.454.CMB.2.raw
  modified_base (379)..(379): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttcttgtggctattttaaaaggtgtccagtgtgaggtgcaggtgtcggagtcgtgggggagtcttggttcagccgtggggggtccctgagactctcctgtgctagtctctggtacttaaccttagtgactatcgaccatgatcgtcgggtcccgcgacggtcctaccgaggggaaggggctggaggtggtctcgagactaaagttagtgggtagggtntattcaactatactcgcaggtaccgtcggggtagggggtcccgttcaccgtactccaaccgagaacgaccaaccgtccgaaggacaccaactactaactaatacctaaacaaagtcgacacgacgtccgtagacgtacgacggaggaccgacggtcgttagtatttagtcgtacggacgtacgacgtacctacccgaacggtcgtaaacccctcggttggtacttcgttttagttacg

SEQ ID NO: 393911 - DNA, 617 bp, Homo sapiens
  misc_feature: GZ8MTXP02JH9X5.38.28.C06.1.454.CMB.2.raw
  modified_base (281)..(281): a, c, t, g, unknown or other
  modified_base (304)..(304): a, c, t, g, unknown or other
  modified_base (377)..(377): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtcgtgggggaggcttggttcaggcccgggggtcctgagactctcctgtgcagtctctggattaaccttagngactatgccatgatctgggtccncaggctccgaggggaagggctgggagtggggtctcgagcaattaagtgggtaggggtagttcacatattacgnagactcggtgggggccttcaccatcaccagacgacaactccgaggacgcacactatactacaacaaatcgaccaacacgacctagaggacgtaccggaaggaccgaacggggtcccgttagttaacgtttagttgggtacggacggtaaggaacggaaccgtacccccgtaaaacggggttcgaaacccccgttaaccggtttcggggttacgtttaccgtttttggtaactttttccgg

SEQ ID NO: 393912 - DNA, 640 bp, Homo sapiens
  misc_feature: GZ8MTXP02GBGPK.38.28.C06.1.454.CMB.2.raw
  modified_base (293)..(293): a, c, t, g, unknown or other
  modified_base (330)..(330): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaagtgggtaggggcattcacatatacgcagactcggnggggccgttcaccatcaccagagacaactccgaggancacactatatactaacaaatcgccacagcctagagacgtcgaggacacgggccgttagtatttagttggtcgacgtagacgtactaccccgaacggttcgaccctacgtttggtacgttcttttagacttttcgtggtacgggacccgtaaaggggtacctaaaggttcggtaccctaccggttcttacgttaccacgtccctacccgaaccgaaacggggtcccctacgttcccggttcccttccccccggtggcccgtccccgttgcccgttacccgacggtaccgacctaacccgtccggacgaccg

SEQ ID NO: 393913 - DNA, 731 bp, Homo sapiens
  misc_feature: GZ8MTXP02ID28L.38.28.C06.1.454.CMB.2.raw
  modified_base (314)..(314): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcagggtgtcggagtcgtgggggagtcttgggttcaggccccgggggtcctgagactctcctgtgcagtctctggtattaaccttgtgactatgccatgatcgtcgggtcccncaggctccgaggggaagggctgggaggtgggtctacgaggactaaagtttaagtggggtaggggtgatttccgaacctattaacgttacgcgtaacggtaccggttcccgggggtcggggggtccccgttacaacccgtactacccaaccgaggtaaacgaacctaaaccgtacccgaagggacgaccaaactaaccttaaataacttaaccgtaaaccgaaaatcggaaccaaccgacggaccctaggaaacggacggtaccggaaaacgggacctaaccggggtacccgttagtttaaacgtttagttggtacggaacggaacggaacgtaacccgttaaccccggaaaacggggttccaaaccccgttaaccggttttggggttactttaccgttttttggaactttttccggg

SEQ ID NO: 393914 - DNA, 652 bp, Homo sapiens
  misc_feature: GZ8MTXP02F5TLP.38.28.C06.1.454.CMB.2.raw
  modified_base (216)..(216): a, c, t, g, unknown or other
  modified_base (272)..(272): a, c, t, g, unknown or other
  modified_base (286)..(286): a, c, t, g, unknown or other
  modified_base (308)..(308): a, c, t, g, unknown or other
  modified_base (315)..(315): a, c, t, g, unknown or other
  modified_base (326)..(326): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatcgtgggtccnccaggctccgagggagggctggagtgggtctcagactaattaagtgggtaggggtnattcacatatacgnagacgtcggtggggcctcacancacaganacactcaggcncacactatatactaacaaatcgaccacacgcctagacgtagtacggacggacacgggtccgttattacgtttagtgtcgacgtaagacgacgtacccgaacggtcgacccgtaccgtttgggttacgttcgtttttagtacttttcgtgggttacgggacccgtaaaggggaactaaggttcggtacctaccggttcttccgttacacggtaccctaccgaaaccggtaacgggtcccctagttcccgggttcccttcccccgcggggtcccctcccgttcgaacccgttccgaacggggacccacccgtacccgtaccgacgacg

SEQ ID NO: 393915 - DNA, 564 bp, Homo sapiens
  misc_feature: GZ8MTXP02HIRL4.38.28.C06.1.454.CMB.2.raw
  modified_base (213)..(213): a, c, t, g, unknown or other
  modified_base (270)..(270): a, c, t, g, unknown or other
  modified_base (284)..(284): a, c, t, g, unknown or other
  modified_base (293)..(293): a, c, t, g, unknown or other
  modified_base (312)..(312): a, c, t, g, unknown or other
  modified_base (317)..(317): a, c, t, g, unknown or other
  modified_base (323)..(323): a, c, t, g, unknown or other
  modified_base (326)..(326): a, c, t, g, unknown or other
  modified_base (331)..(331): a, c, t, g, unknown or other
  modified_base (333)..(333): a, c, t, g, unknown or other
  modified_base (338)..(338): a, c, t, g, unknown or other
  modified_base (356)..(356): a, c, t, g, unknown or other
  modified_base (483)..(483): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggtccncaggctccgaggggaagggctggagtgggtctcgagcaaattaagtgggtaggggtnattcacatatacgnagactcggnggggcctcacatcacaganacacncaggancanactananctaanaaatgacacagctagagngcgacgactacggccgttagtatttagcgtagagagagactacccgaaagggtcacctacgtttgggtctcttttgatttcgtggtcggaccgtaaagggactaagtcgtactaccgtctctcgacnccctacaacgacggccctagtcccggtcccttccccggcgcccgtacctcgccgtacgacggccaccaccgtacgacgacg

SEQ ID NO: 393916 - DNA, 648 bp, Homo sapiens
  misc_feature: GZ8MTXP02GAZEF.38.28.C06.1.454.CMB.2.raw
  modified_base (316)..(316): a, c, t, g, unknown or other
  modified_base (603)..(603): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcgaggtgtcggagtcgtgggggagcttggttcacggcccgggggtcctggagactctcctgtgcagtctctggtacttaaccgttgtgactatcgaccatgatcgtcgggtccnccaggccgtaccgaggggaagggcgtaggggacggttcgggtctcgaagactaaagttaaggtggggtaggggtatagttccaacctattaacgttacgcgtaacgtaccggttccgggggtcgggggtcccgttaacaacccgtataccaaaccgaacgaagaaaccaacgtacccgaaagggacaccttaaacacttaaatacaccttaaacaaattcgacaacgacgctagaacgagacgacggacgacggtcgtagttaatagttcgaggccgaagacgtacnccgtaaagccgtaaacctcgttggtcttacgtttacgtgtttacg

SEQ ID NO: 393917 - DNA, 614 bp, Homo sapiens
  misc_feature: GZ8MTXP02I64F7.38.28.C06.1.454.CMB.2.raw
  modified_base (213)..(213): a, c, t, g, unknown or other
  modified_base (255)..(255): a, c, t, g, unknown or other
  modified_base (266)..(266): a, c, t, g, unknown or other
  modified_base (303)..(303): a, c, t, g, unknown or other
  modified_base (329)..(329): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgagggaagggctggagtgggtctcagcaattangggtaggggtnattcacatattacgcagactccggtgggggcccgttnaccatcaccagagacaactccaggancacactatatctaacaaagtgaccacagcctgagacgtcgaggacacggggcctgttattagtgtacgcgagagactacccgaaggttcgaacctaccgttgggtgttccttttgacttttcgtggttacggaccgtaaaggggactaaagttcgggaccctaccggttcttccgttaccgccgtccctacccgaaccgacggtccctacgttcccggttccccttcccccggtcggcccgtcccgtcgaaccgtccggacggaccgccctacccgtcgaacgcg

SEQ ID NO: 393918 - DNA, 596 bp, Homo sapiens
  misc_feature: GZ8MTXP02H6FW8.38.28.C06.1.454.CMB.2.raw
  modified_base (216)..(216): a, c, t, g, unknown or other
  modified_base (309)..(309): a, c, t, g, unknown or other
  modified_base (594)..(594): a, c, t, g, unknown or other
tcagtcgatcacgtcacgaccggtgctcgatttagagctcacgtattgggtttgggctgagctggcttttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgaggggaagggctgggagtgggtctcagactaaagtttaagtggggtaaggggtgattcaacctatattacgcagacgtccggnggggggcccgttcaccatcaaccagagaccaactccaggacgcaactactatatactaacaaagtcgccacacgcctagacgagtcgagggacacggccgtagtattagtgtgcgagagactacccgaaggtcaaccgtaccgttggtgttacttttagtactttctggttacggaccgtaagggacaagtcgtacaccgtctctcagccctacgaccaacggccctatccggtacccttcccgtcgccgtccctagcctccgaacgcgacctacccgtcgaacncg

SEQ ID NO: 393919 - DNA, 658 bp, Homo sapiens
  misc_feature: GZ8MTXP02IAJ8G.38.28.C06.1.454.CMB.2.raw
  modified_base (218)..(218): a, c, t, g, unknown or other
  modified_base (620)..(620): a, c, t, g, unknown or other
tcagtcgatcacgtcacgaccggtgctcgatttagagctcacgtattgggtttgggctgagctggcttttttcttgtggctattttaaaaggtgtccagtgtgaggtgcaggtgtcggagtctggggggaggcttggttcagcctgggggggtccctgagactctcctgtgcagtctctggatttaacctttagtgactatgccatgatctgggtccncaggctccgaggggaagggctggaggtgggtctcagacaatttaagtggggtaggggtgtattcaccatattacgcagacgtccgggtggggggccgttcaccatcaccaagacacaacctcgagacgcacactatactactaacaaatgacccacacgcctaggagtagtacggacggaccgacgggtccgttagttatttagtgtcgacgaagacgtactacccgaaacggtacgtacccgtaccgtttggttcgttacgtttttagactttttcgtggttacggaccggtaaaggggtactaaagtcgggttaccaccggttcttcttaccgacgccctacccgaacccgaacgggtcccctacgttccggttccccttccccggtgccccggttcccncgtcccgccgaacggccaccctacccgacggaacgccg

SEQ ID NO: 393920 - DNA, 665 bp, Homo sapiens
  misc_feature: GZ8MTXP02G46GH.38.28.C06.1.454.CMB.2.raw
  modified_base (301)..(301): a, c, t, g, unknown or other
  modified_base (399)..(399): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttattttaaaaggtgtccagtgtgaggtgcaggtgtcggagtcgtgggggaggtcgttgggttcgacgggccccgggggggtccctggacggacctctcctgtgcagtcctctggtacttaacctttgngactatcgccatgatcgtcgggtccgccgaggcctccggaaggggaaggggcgtggggaggtgggtctcgagactaaagttaaggtgggtaggggtanattcactagtacttacgcgaggtaccgtccggggtcggggggtacccgttacaccgtactaccgaaccgaagaacgaaccaaccgtcccgaagggacaccaaactactaactacttacctaaacaaaatcgaaccaacgacgtacctaggaacgacggtacgaacggaccgaccgggtcgttagttaattagtggtacgacggaagacgtaccgtacccgaaacggtcgtaacccgtacgttggtacgtcgttttggtactttcgg

SEQ ID NO: 393921 - DNA, 731 bp, Homo sapiens
  misc_feature: GZ8MTXP02F4USM.38.28.C06.1.454.CMB.2.raw
  modified_base (182)..(182): a, c, t, g, unknown or other
  modified_base (265)..(265): a, c, t, g, unknown or other
  modified_base (284)..(284): a, c, t, g, unknown or other
  modified_base (288)..(288): a, c, t, g, unknown or other
  modified_base (312)..(312): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgtttctagtggctatttaaaggngtccagtgtgaggtgcaggtgtcggagtctgggggagcttggttcaggcccgggggtcctgacgactctcctgtgcagtcctntaggtattaaccttaggtnactntcgctagtgtacgtcgtcggtccncgacggtcgtcggaaggggtacggcgtgggtggttcgggtctcgtagactaaagttaggtggggtagggtctactacaacgtattacgtacgcgtacggtaccggttccggggtccgggggtccgtaccaccgtacgtaccgacgaagaacaaccgtaaccgacccggaacggacgaacctaaacgtacttaaactaacttaaacctaaacgtaaactaacgtaaccaaccgtacgtaccgtacgaacggtaacggtacggtaacggaaccggtaaccgggtacggttaacggtttaacgtttaggtttacggttacggtacggaacggtaacggtaacccggttaacccggtaacccgggtaaccggtaacccggttaccggtttacggtttacgtttacgtttacgtttacgtttcg

SEQ ID NO: 393922 - DNA, 599 bp, Homo sapiens
  misc_feature: GZ8MTXP02FMPGU.38.28.C06.1.454.CMB.2.raw
  modified_base (215)..(215): a, c, t, g, unknown or other
  modified_base (276)..(276): a, c, t, g, unknown or other
  modified_base (291)..(291): a, c, t, g, unknown or other
  modified_base (315)..(315): a, c, t, g, unknown or other
  modified_base (322)..(322): a, c, t, g, unknown or other
  modified_base (335)..(335): a, c, t, g, unknown or other
  modified_base (352)..(352): a, c, t, g, unknown or other
  modified_base (477)..(477): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccnccaggctccgaggggaaggggctgggagtgggtctcgagactaattaagtgggtaggggtnattcacatattacgnagaccgtcggtgggggcctcacancacaganacactccgaggancacactatactactaanaaatcgacccaacgacgcctagagacgtcggacggaccgacgggtccgttagttaatttagttgagacgagaacgacctaacccggaaggttcgaccctacgtttggtcgttctttgtatttcgnggtacggaccgaaagggactaaggtcgtacccacgttctcgttcacgcctaccaaccgacgggccctagtccgtccctcccgtggaccctcctagccctacgacgacgccaccgccgagccg

SEQ ID NO: 393923 - DNA, 712 bp, Homo sapiens
  misc_feature: GZ8MTXP02IR6V9.38.28.C06.1.454.CMB.2.raw
  modified_base (269)..(269): a, c, t, g, unknown or other
  modified_base (328)..(328): a, c, t, g, unknown or other
  modified_base (335)..(335): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaagggctggagtgggtctcagcaattaagtgggtaggggtnattcactatatacgcagaccgtcgggtcgggggtccgttcaccatcacagacgacaacncgagacncactactatactactaacaaatcgacccacacgcctaggacgtacggtcggacgggaccgaccgggtaccgttagttaactttagttgggtacggacggtaagacggtaccgtaaccccggtaacggtaccgaacccgttaccggtttgggttcgtttcgtttttagtacgtttttcgtagggttacgggaacccggtaaaggggtaacctaaggttccgtacccgtacccgttcttcgttaccgaccgtacccctacccgaaaccggtaaccgggccccttacggttccccggttaccccgttcccccggtcggtccccgtcccgtcgtaacccgtaccggaacgggtaccacccgtacccgtaccggaacgaccg

SEQ ID NO: 393924 - DNA, 723 bp, Homo sapiens
  misc_feature: GZ8MTXP02IZMEP.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggaggctttggttcaggcccgggggtccctgagactctcctgtgcagtctcgtggatttaaccttagtgactatgccatgatcgtcgggtccgccaggcctccgaaggggaacggggctggggtaggtcggggtctcgagactaaagttaagtggggtaggggtgtacttcgaacctattaagttacgcgtaacggtaccgttccgggggtacggggggtccccgtttaccgaaccctactacccgaacccgaaggaaccgaaacaaacccgtcccgaaaggggacaccgaacctaaaccttaattaacttaaccctaaactaaaacttcggaaccaacgaacggtacccgtaggacggtaacggtaccgggaaaggacccggaacgggtacccggtagtttaactttaggttggtcggacggaaagacgtaaccgtacccggaaacgggtaaccgtaaccccgtaccgtttaggtcgtttaccgttttagtaccgttttacgg

SEQ ID NO: 393925 - DNA, 629 bp, Homo sapiens
  misc_feature: GZ8MTXP02HXGAX.38.28.C06.1.454.CMB.2.raw
  modified_base (215)..(215): a, c, t, g, unknown or other
  modified_base (272)..(272): a, c, t, g, unknown or other
  modified_base (287)..(287): a, c, t, g, unknown or other
  modified_base (319)..(319): a, c, t, g, unknown or other
  modified_base (331)..(331): a, c, t, g, unknown or other
  modified_base (340)..(340): a, c, t, g, unknown or other
  modified_base (348)..(348): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgaggggaagggctggagtgggtctcagctaattaagtgggtaggggtnattcactatatacgnagcgtccggtgggggccttcaccatcacaganacaactcaggancacacttanatctaaanaaatcgaccaacacgcctaggagacggtcgagggaccacggtccgttagtaatttgtggtgacgtaagagtactacccgaagggtcacctaccgtttggtgttcgttttagtacgttttcgtgggttacggaccgtaaaggggtacctaaggttcgggtaccacccgttcttcgttcaaccgtcctacccgaaccggaaccgggtccctagttcccggtccctttcccccgacggccccgtccctacgccgtccggaagcccgacctaccgacgacgaccg

SEQ ID NO: 393926 - DNA, 777 bp, Homo sapiens
  misc_feature: GZ8MTXP02I04TY.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcgttggttcaggcccgggggtccctggagactctcctgtgcagtctctggattaacctttagtgactatcgccatgatcgtggtccgccaggcctccgaggggaagggctgggaggtgggtctcgagactaaagttaacgtggggtaggggtgtagtttaccaaccgtattaacttaccgcaacggtaccgtcccggggtagggggggtcccgtttaccgaaccgaacgttaccgaacccaaggaacgaaccaaacccgttacccgaaagggacgaccaacctaaaccttaatacttaaccgtaaacctaaaagtcgtaccaaaccaacggtaccccttacggaaggtacggttaccgggaaacggggaacccgaaccggggtaccccgggtaacggttttaaacgtttacgttttaggttacgggtacccgggaaacggtacggtaaaacccgttaacccccggtaaaaccgggggttccggtaaaccccgtttaacccggttttaccggggttacgtttccgtttttaccgggttaagtttttttccccgggg

SEQ ID NO: 393927 - DNA, 603 bp, Homo sapiens
  misc_feature: GZ8MTXP02G47C6.38.28.C06.1.454.CMB.2.raw
  modified_base (306)..(306): a, c, t, g, unknown or other
  modified_base (371)..(371): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttggttcaggcccgggggtcctgagactctcctgtgcagtctctggattaaccttagtgactatgccatgatcgtcgggtccnccaggcctccggaggggaaggggctgggagtcggggtctcgagactaagtaagtgggtaggggtnattcacctatacttacgcgtacgacgtccggggtcgggggtcccgttcaccgacttaccgaccaaggacaaccaacctcccgaggacgacaactactatactactaacaaatcgacacagccctagagtacgacgaacggacgaacgggtccgtagtactttagtggtcgacgtagacgactacccgaaggtccgaccgttaccggttggtcgttaccgtttgacttttcgg

SEQ ID NO: 393928 - DNA, 616 bp, Homo sapiens
  misc_feature: GZ8MTXP02JFG8M.38.28.C06.1.454.CMB.2.raw
  modified_base (287)..(287): a, c, t, g, unknown or other
  modified_base (363)..(363): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtactttttctagtggctattttaaaaggtgtccagtgtgaggtgcaggtgtcggagtcgtgggggagcgttggttcacggccccggggggtcctgacgactctcctgtgcagtctctggattaacttagngactatgccatgatcgtggtccgcaggctccgagggtaggctggagtgggtctgagctaagtaagtcggtagggtntactacactatacgtcgcgtacgtccggtccggggtcgggggtccgtacacctactacccgaacgaggacgaacaaccgtacgaaggaccactaactactactactacgtaaacaaagtacgacacacgaccgacgagacgtacggacggacgtacgtacgtacgttacgttagttgtacgacgacgacgtaccgtacccgtaccggtaaccgtaccgtaccgttacggttcgttcgtttacgttacgtttcg

SEQ ID NO: 393929 - DNA, 730 bp, Homo sapiens
  misc_feature: GZ8MTXP02HABRL.38.28.C06.1.454.CMB.2.raw
  modified_base (270)..(270): a, c, t, g, unknown or other
  modified_base (284)..(284): a, c, t, g, unknown or other
  modified_base (300)..(300): a, c, t, g, unknown or other
  modified_base (307)..(307): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcttggttcacggcccggggggtcctgacgactctcctgtgcagtctntggattaaccttgngactatgccatgatcngggtccncaggcctacggaggggaaggctgggagtgggtctgagactaaagttaagtggggtaggggtgtacttcgaacctagttaacgttacgcgaaggtacccgttccgggggtcggggggggtacccctttacgaacccgaaacgttacccgaacccgaaaggtaacggaaaccaaacccgttcccgaaaggggaacaccgaaacaacttaactaactaaccttaaacaaaactcggactaacgacgggtaccctagggaacggaggttaccgggaacggaaccgtaccgggggtacctttaggttaaacgtttacggttggttaggaccggttaaacggacgtaacccgtacccggtaaaacgggtccgttaacccgtaacccggttttggtacggtttccgtttttacggtaagtttttaccggg

SEQ ID NO: 393930 - DNA, 593 bp, Homo sapiens
  misc_feature: GZ8MTXP02I6CMP.38.28.C06.1.454.CMB.2.raw
  modified_base (259)..(259): a, c, t, g, unknown or other
  modified_base (331)..(331): a, c, t, g, unknown or other
  modified_base (339)..(339): a, c, t, g, unknown or other
  modified_base (395)..(395): a, c, t, g, unknown or other
  modified_base (503)..(503): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgcaggctccgaggggaaggggctggagtgggtctcagcaattaagngggtaggggtgattcacatattacgcagactccggtgggggccgttcaccatcaccagagacaactccaggncacactanatctaacaaatgccacagctgagacgtcgaggacacgggccgtagtatttattggngacgagaacgactacccgaaacggtcgaccgtacccgttggtgttcttttgattttcgtggttgggacccgtaagggtaccaagttcggtaccaccgttcttcttacncgtcctaccaccgaacggccctaagttccgggtcccttcccccgtggtcccgccctgtcccgtccgacggaccgccacccgtcgacgacg

SEQ ID NO: 393931 - DNA, 651 bp, Homo sapiens
  misc_feature: GZ8MTXP02HWJIR.38.28.C06.1.454.CMB.2.raw
  modified_base (294)..(294): a, c, t, g, unknown or other
  modified_base (312)..(312): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggaggcttggttcgaggcccggggggtccctggagactctcctgtgcagtctctggtaattaacctttagtgactangccatgatctcgggtccnccaggctccgaggggaaggggctgggagtggtctcgagctaaattaagtggggtacggggtgtacttcgaacctatagttacgctaggtaccgttcccggggtgggggggtccccgtttacaacccgtatcccaaacccgaaggaacgaacctaaacccgtcccgaaaggggaacgaccaacaccttaataactacctaaacaaaatcgacacacgcctagacgacgtacggaaggaccgacggtccggtagttaacttgtttgagtccgaaggacgacgttaccccgaagggtaacgacccgtaccgtttgggtcgttccgtttttagtacgttttcg

SEQ ID NO: 393932 - DNA, 704 bp, Homo sapiens
  misc_feature: GZ8MTXP02I1IDN.38.28.C06.1.454.CMB.2.raw
  modified_base (418)..(418): a, c, t, g, unknown or other
  modified_base (695)..(695): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggtctaattttaaaaggtgtccagtgtgaggtgcgaggtgtcggagtcgtgggggaggtcgttggttcgacgggccccggggggtccctggagtaccttctcccgtgtgcagtctcgtggtaactttaacctttagtgtacttatgcctagtgtactcgtcgggtcccgccgacgggtcctaccggaaggggaacggggcgtgggaggttcgggtctacgaggactaaagttaaaggtgggtaggggtntatttaccgaacctaattacgttaccgcgtacgtaaccggtccgggggttacggggggtcccgttacaacccgtagtacccgaacgaacggaacgaaaccgacctacccgagggacacgaactaacttaactacgttaacctaaacaaaatcgacctacgacgtccaggacgtacgtcgggaaacgaccgtaccgggtaccgttaggttaattcgttaggcgacggtaagacgtaccgtacccgtaaggtccaccgttaacgttggtctttcgtttntacgtttcg

SEQ ID NO: 393933 - DNA, 659 bp, Homo sapiens
  misc_feature: GZ8MTXP02I5Y7A.38.28.C06.1.454.CMB.2.raw
  modified_base (260)..(260): a, c, t, g, unknown or other
  modified_base (271)..(271): a, c, t, g, unknown or other
  modified_base (330)..(330): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtggtccgccaggctccgaggggaagggctggagtgggtctcgagctaattagngggtaggggtnattcacatatacgcagacgtccggtggggggccgtcaccatcacagagacactcaggancacactatactactaacaaatcgacctacgagcctagagtacggtacgagggtaccaccggggtccgttagtaatttagtggtgacgtaggtacgacgttaccccgaaacgggttctaccccgtaccgtttgggttcgttccttttagtactttttcgtaggtacggtaccgtaaaggggtaactaaggtttccggtaccgttaccggttcttccttaccgacgcccctaccgaacccgacggacccttacgtcccgggtaccttcccccggtcgcccgtcccgtcggccctaccggaggacccggtccaacccggtccgaacggaccc

SEQ ID NO: 393934 - DNA, 579 bp, Homo sapiens
  misc_feature: GZ8MTXP02G5QBF.38.28.C06.1.454.CMB.2.raw
  modified_base (258)..(258): a, c, t, g, unknown or other
  modified_base (283)..(283): a, c, t, g, unknown or other
  modified_base (305)..(305): a, c, t, g, unknown or other
  modified_base (446)..(446): a, c, t, g, unknown or other
  modified_base (525)..(525): a, c, t, g, unknown or other
  modified_base (567)..(568): a, c, t, g, unknown or other
  modified_base (570)..(570): a, c, t, g, unknown or other
  modified_base (572)..(574): a, c, t, g, unknown or other
  modified_base (576)..(576): a, c, t, g, unknown or other
  modified_base (578)..(579): a, c, t, g, unknown or other
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggtctttttctgtggcttaattttaaaagctccggtgggggccgttcaccatcaccagagacaactccaggagcacactatatctaacaaatgacacagcctgagngtcgaggacacggctgtattattgngcgagagactacccgaacggtnaccctacgtttggtgtcttttgactttcgtggtcggaccgaagggactaaagtcggtacctacgttcctcttcgacgccctaccaaccgaacgggccctagtccggtccctcccccgtgcccgccctgcctacgacggacncccgaccgtccgagaccgcacgacggccggccgtgggctcggtccgtcggtacgaacgggtactaaccgttcgacggtnacgtcgaacgtggacggcggcgtggacgaggccgactagcgnngncnnncncnn

SEQ ID NO: 393935 - DNA, 650 bp, Homo sapiens
  misc_feature: GZ8MTXP02HRPAX.38.28.C06.1.454.CMB.2.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaagggctggagtgggtctcagcaattaagtgggtaggggtgattcaccatatacgcagactccggtgggggccgttcaccatcaccagagacaactccaggagacacactatatactaacaaatcgccacagcctaggagacggtcggacgggaccgaacgggtccgttagttaatttagttgtcgacgagacgtactacccgaaacgggttgaccctaccgtttggtcgttcgttttgtattttcgtaggttcgggacccgtaaagggggactaaaggttcggtaccgtaaccgttcttcctttacgacggtcccctaccgaacccgtaacggggccccctaggttcccgggttccctttccccccgtcgggcccgtccccctagtccctccggacggcgaccacccgtcgaacggaccg

SEQ ID NO: 393936 - DNA, 682 bp, Homo sapiens
  misc_feature: GZ8MTXP02G5FBX.38.28.C06.1.454.CMB.2.raw
  modified_base (292)..(292): a, c, t, g, unknown or other
  modified_base (338)..(338): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagccgtggggggtccctgagactctcctgtgcagtctctggtatttaacctttagtgactatgccatgatcgtgggtccgccaggctccgaggggaagggctgggagtgggtctcgagactaattagtgggtaggggtgattcacatatacgnagactcggtggggccgtcacatcaccagacgacaactccgaggacncaacataatatactaaacaaatcgacccacacgcctagagacggtacgagggaccacgggtaccgtagttaagttagtggtagacggagaacgacgtaccccgaacggtaccgaaccgtaccgtttggtcgttacgttttgtactttcgttcgtgggtaacccgaaaggggaactaaggtcggtacctaccgttcttccgttacgaccgtccctacccgaacccggtaaaccggtcccccgtacgtcccggttccccgtttccccccgcggggtacccctccccgttcgggccccttacccggaacgggacccggacccaaccccgtacccgaacggaacccgg

SEQ ID NO: 393937 - DNA, 623 bp, Homo sapiens
  misc_feature: GZ8MTXP02IRA1C.38.28.C06.1.454.CMB.2.raw
  modified_base (215)..(215): a, c, t, g, unknown or other
  modified_base (268)..(268): a, c, t, g, unknown or other
  modified_base (329)..(329): a, c, t, g, unknown or other
  modified_base (344)..(344): a, c, t, g, unknown or other
  modified_base (357)..(357): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccncaggctcgagggagggctggagtggtctcagactaattaagtgggtaggggtnattcactatatacgcagacgtcggtgggggccctcaccatcaccagacgacaactcaggancacactatatacaanaaatgacccacgngtcctagagagtcgaggacgacggtcttagttaattagtgggtcgacgagaacgtactacccgaagggtcaccctacgtttggtcgttagttttagactttcgttacggttacggaaccgtaaagggtactaaggttcggtcctaccgttctccttacgaccgtccctacgaacccgtacggccctaagtcccggttccctcccggtcgtccccgtccgtcgtaacccgtccggaacggcgacccacccggttaccggaagacccg

SEQ ID NO: 393938 - DNA, 661 bp, Homo sapiens
  misc_feature: GZ8MTXP02FQH99.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttcaggcccgggggtccctgagactctcctgtgcagtctctggtattaaccttagtgactatgccatgatcgtgggtccgccgaggcctaccggaaggggaacggggcgtaggggaggttcggggtcctcgacgactaaagtttaaagtggggtaggggtagtacttaccgaacctaattaacgttaacgcgaacggtaccggttccgggggtacggggggtcccggttacaaccgtactaccaaccgaagacgaaaccaaccgtacccgaaggacgacaacctaactaaatactacctaaacaaaatcgaccaacgacgtcgtacggagacggtcggaaacggaccgaacggtcgttagttaacttagtgtggacgaagacgtaccacccgtaagtcgaccctaccgttggtacttcgtttagtactttcgg

SEQ ID NO: 393939 - DNA, 781 bp, Homo sapiens
  misc_feature: GZ8MTXP02IWGJ3.38.28.C06.1.454.CMB.2.raw
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccgagggaaggggctggagtgggtctcagcaattaatggtaggagtgattcaccatattacgcagactcggtgggggccgttcaccatcaccagagacaactccaggagcacactatatctaacaaatgcacagcctagagagtcggagacacggccgtgtattagtgtgcgagagactaccccgaacggtcgacctaccccgtttgggtcgttcgtttttaggtattttccgtggttcgggaccgtaaagggggacctaaagtcggggtaccctaacccggttcttaccttaccgacgtcccctacccgaaacccggaaaccgggggtaccccctaacgttcccggttcccccgtttcccccccggttcggggaccccggtcccccgttcggtcccgttaccccggaacgggacccgaccccgaccccgttacccgggacggaaccggacccgaaccgtaaccggggaccccgggtcccccggttcgggggacccgttccggtaccccgggtttcgggtaacccggaaaacggggtacccctttaaacccggtttccccgaaaccgggttaacggacgtttacccggaccggttacgggtaaccggggaccggggcccgtaacggggg

SEQ ID NO: 393940 - DNA, 656 bp, Homo sapiens
  misc_feature: GZ8MTXP02JAT03.38.28.C06.1.454.CMB.2.raw
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccgtgggggccgttcaccatcacagagacaactccaggagcacactatatctacaaatgcacagcctgagagtcgaggacacggccgtgtattattgtgcgagagactaccccgaaaggtcgaaccctaccgtttggtcgtcctttttgatttttccgtggttacgggcccgaaaagggggaccaaagttcgggtacctacccgttctcctttaccagtcccctacccgaacccgaaacggggcccctaagtcccgggttcccttccccccgtgggcccgtcccctggccctaccgaggaccgccacccgtaccgagaggccacgacggcccggccgtcgggcctcggcccgtggttacccgaaagggtacccttaccgttacccgacggttcgaacgttccggaacgtacggacggccggggtccgtagggaaccg

SEQ ID NO: 393941 - DNA, 693 bp, Homo sapiens
  misc_feature: GZ8MTXP02HUW6E.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttcttgtggcttattttaaaaggtgtccagtgtgaggtgcaggtgtcggagtcgtgggggaggtcgtttggttcgacgggccccggggggtccctggacgactctcctgtcgcagtctctggtactttaaccttagtgactatcgccatgactcgtcgggtcccgccgaggtccgtccggaagggggaacggggtcgtggggtaggttcggggtctacgacggactaaagtttaaggtggggttaggggtactacgttccgaacctattaaccgttacgcgtaaggacccgttccgggggtccggggggtcccgttaccaaccgtactcccgaaaccgaggaacgaaccaaccgtccgaaaggacaccacacttatactactaaacaaatcgacacgacgcctagacgtagacggacgaacgacggtcgtagtttacttagttggacgtacggaagacgtacccgtaccggtaacggtaaccgtacccgttaccggtttggtcgtttaccgttttaggtttacgttttccgg

SEQ ID NO: 393942 - DNA, 675 bp, Homo sapiens
  misc_feature: GZ8MTXP02IPD6D.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggttgagctggtctttttcttgtggtctattttaaaaggtgtccagtgtgaggtgcaggtgtcggagtcgtgggggaggcttgggttcacgggccccggggggtccctggagactctcctgtgcagtctctggtattaacctttagtgactatgccatgatcgtcgggtccccgccaggcctccgaggggaaggggcgtgggaggtgggtctcgaggactaaagttagtggggttaggggtgtacttccacctaattacttaccgacacggtaccgttccgggggtccggggggtccccgtttaccaaccgtacgttacccgaaacccgaagaaccggaaccaaaccgtaccgaaggacgccaacaactaactactactaaacaaaagtcgaacacgacgtaccgtagaacggtgaccggaacggaacgacgggtccgtagttaatttagtaggtgacggaagacggtaccgacccgtaacggtacaacccgtaccgtttggtacctttgttttcgtactttcggtcgg

SEQ ID NO: 393943 - DNA, 623 bp, Homo sapiens
  misc_feature: GZ8MTXP02FO7WL.38.28.C06.1.454.CMB.2.raw
  modified_base (263)..(263): a, c, t, g, unknown or other
  modified_base (273)..(273): a, c, t, g, unknown or other
  modified_base (308)..(308): a, c, t, g, unknown or other
  modified_base (315)..(315): a, c, t, g, unknown or other
  modified_base (320)..(320): a, c, t, g, unknown or other
  modified_base (326)..(326): a, c, t, g, unknown or other
  modified_base (342)..(342): a, c, t, g, unknown or other
tcagtcgatcacgtcacgaccggtgctcgatttagagctcacgtattgggtttgggctgagcgtggtcgttttcttaggtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattanggtaggggtnatcacatatacgcagcgtcggtcggggcctcacancacaganacacncgaganacacatatactacaanaaatcgacccacacgtcgtagagacgtacggacggacgacggtacgtagttagttagttagtgacgagagacgtaccgtaacggtacgtaccgtaccgttcggttcgttcgtttcgttgtttcgttggtacggtacggtaacgggtaacgtaacgtacgtaccgtaccgtcttcgttcgtaccgtacctaccgaccgaccggaccgtaccgtccggttcccgttccccgtccggtcccgtcccgtccgtccgtccgacgacgaccgtaccgaccgacgacg

SEQ ID NO: 393944 - DNA, 650 bp, Homo sapiens
  misc_feature: GZ8MTXP02H29FK.38.28.C06.1.454.CMB.2.raw
  modified_base (217)..(217): a, c, t, g, unknown or other
  modified_base (292)..(292): a, c, t, g, unknown or other
  modified_base (301)..(301): a, c, t, g, unknown or other
tcagtcgatcacgtcacgaccggtgctcgatttagagctcacgtattgggtttgggctgagctggcttttttcttgtggctattttaaaaaggtgtccagtgtgaggtgcaggtgtcggagtctgggggaggcttggttcagccgtggggggtccctgagactctcctgtgcagtctctggattaacctttagtgactatgccatgatctgggtccnccaggctccgaggggaaggggctggaggtgggtctcgagactaattaagtgggtagggtgtattcacatatacgnagactcggnggggccgtcaccatcaccagacgacaacctcaggagcacactatactactaacaaatgaccacgacgccgtagaagagtacgaggggaccgacgggtcccgttagttaatttagtaggtacggacgaagacggtacctacccgtaaacgggtccgtaacccgtacccgttgggttcgttccgttttagtattttcgtagttcgggaccgtaagggaactaacggttcggtacctaccgttcttccttactaccgccctaccgaaccgacgggcccctagtcccgttcccttcccccggtgccccgtcccgtcgccgtcccggaacgccgaccgaccctaccggacgacg

SEQ ID NO: 393945 - DNA, 606 bp, Homo sapiens
  misc_feature: GZ8MTXP02GTKTA.38.28.C06.1.454.CMB.2.raw
  modified_base (215)..(215): a, c, t, g, unknown or other
  modified_base (302)..(302): a, c, t, g, unknown or other
tcagtcgatcacgtcacgaccggtgctcgatttagagctcacgtattgggtttgggggagagctctggagaagagctgctcagttaggacccagagggaaccatggaaaccccagcgcaacttctcttcctcctgctactctggctcccagattccaccggagagattgtgttgacgcagtctccaggcaccctgtctttgtctccaggggaaanacgccaccctctcctgcagggccagtcagtgtgtttcaacggtctacttagcctgtaccagacaaaactgacaggctccaggctccncatctatacggtacatccgtcacgggcctacgtcggtactcccagacgtaggttccaggtgcaggttcgggtcgtagggacagacttcgactctacacctatcagcagacgtgggaagcagaaacgttagtttagacgtaggttattacttatacggttacagacgtattaactaactaacgaaacgtaccgttaacgtacgtttacggaccccggtaaagggacccaaggtacgtaacgggaacgtaaccgaaaaccgtagtacggtaacgactacggacctaacctaactcgtaacgtttcc

SEQ ID NO: 393946 - DNA, 601 bp, Homo sapiens
  misc_feature: GZ8MTXP02HGMWO.38.28.C06.1.454.CMB.2.raw
  modified_base (295)..(295): a, c, t, g, unknown or other
  modified_base (433)..(433): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttattttaaaaggtgtccagtgtgaggtgcgaggtgtcggagtcgtgggggaggtcttggttcgacgggcccgggggtccctggagactctccgtgtcgcagtctctggtattaacctttagngtactatgccatgtatcgtcggtccgccaggctccgaggggaggcgtggaggtgggtctcgagtactaagttaaggtggtacgggtgattaccgactattatacgcgagtacgtccggggtgggggtccgtcaccacncacgagaacgacacgtccgaggacactaacacttatactacgtaaacaaatcgacacctagcctaggcgaacgtcggacgacgcggtcgtattaatacgtgtagacggagtacgacccgtacccgaggtcccgaacgtcccgttaggtcttcgttttagacgtttcgg

SEQ ID NO: 393947 - DNA, 635 bp, Homo sapiens
  misc_feature: GZ8MTXP02FH4EK.38.28.C06.1.454.CMB.2.raw
  modified_base (293)..(293): a, c, t, g, unknown or other
  modified_base (328)..(328): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtaggggtgattcacatattacgcagactcggngggggccgttcaccatcacagagacactccaggancacactatatctaacaaatgcccacagcctgagagtcgaggacacgggctgtattatgtgcgagagactacccgaaacggtcgaaccctaccgttgggtcgtctttttagactttttcgtggtacgggccaaaagggggacctaaagttggtccacccggttcttaccgtttcaacgccctacccaacccgaaaacggggccccctaagttccccgggttccctttcccccccgtcggggcccgtacccccgttcggaacccgttcccgaacgggacggcccgtaaccccgtaccccggaggaaccg

SEQ ID NO: 393948 - DNA, 552 bp, Homo sapiens
  misc_feature: GZ8MTXP02FMCY1.38.28.C06.1.454.CMB.2.raw
  modified_base (457)..(457): a, c, t, g, unknown or other
tcagtcgatcacgtcacgaccggtgctcgatttagagctcacgtattgggtttggggagagctctggagaagagctgctcagttaggacccagaaggaaccatggaaaccccagcgcagcttctcttcctcctgctactctggctcccagattccaccggagagattgtgttgacgcagtctccaggcaccctgtctttgtctccaggggaaagagccaccctctcctgcagggccagtcagagtgttttcaacggtctacttagcctggtaccagacaaaacctggccaggctcccgaggctcctcatctatggtacatccgtcgagggccacgtggtactccgagacaggttcagtggcaggtcgggtctggggacaggtacttcactctcacccatcagcagactggagctagaagtatttgctagtgtattactgtacagacagtatactaanaacgacctactacgtttgaccgtaggggacctaagcgtacgggaacgaaccgaaaacgtacgtaaggtagacgtcgacccaactactcgtttacg

SEQ ID NO: 393949 - DNA, 557 bp, Homo sapiens
  misc_feature: GZ8MTXP02GAQ6F.38.28.C06.1.454.CMB.2.raw
  modified_base (306)..(306): a, c, t, g, unknown or other
  modified_base (361)..(361): a, c, t, g, unknown or other
  modified_base (375)..(375): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggaggcttggttcaggcccggggggtccctgagactctcctgtgcagtctctggattaacctttgtgactatgccatgatcgtggtccnccaggctccgaggggaggggctggagtgggtctgagcaattaagtggtaggggtnattcacatattcgnagacgtcggtgggggccgttcaccatcacagagaacaactccgaggacgcaacactatactactaaacaaatcgacacgagcctagagagtcggaaggacacgggccgtagtacttagttggtgacggagtacgactacccgaaggcgtacctaccgttggtcgttactttgtacttttcgg

SEQ ID NO: 393950 - DNA, 754 bp, Homo sapiens
  misc_feature: GZ8MTXP02H5R5A.38.28.C06.1.454.CMB.2.raw
  modified_base (215)..(215): a, c, t, g, unknown or other
  modified_base (318)..(318): a, c, t, g, unknown or other
  modified_base (338)..(338): a, c, t, g, unknown or other
tcagtcgatcacgtcacgaccggtgctcgatttagagctcacgtattgggtttggctgagctggctttttcttgtggctattttaaaaggtgtccagtgtgaggtgcaggtgtcggagtcgtgggggaggcttggttcagccgtggggggtccctgagactctcctgtgcagtctctggatttaaccttagtgactatgccatgatctgggtccncaggctcgagggaagggctggagtgggtctacgagactaaattaaggtggggtaggggtcgtattcgacctatattacgcagaccgtcggtggggccgtcacntcacagacacactcaggacncacactatatactaaacgaaatcgaccacgagcctggaagaggtacggacgaaccgtaacggccgttagttaatttaggtgtagacgtaaggacgtaccgtacccgtaaacgggtccgtaacccgttaccgtttcgggttagtttcccgtttttgttaacgtttttaccggtgggttaaccgggaaccgggtaaaagggtaacgttaacggttaccggttaccgttaaccccgtttcgttaccgtaccgaccccgttacccccgtaacccgaaacccccgggtaaaccgggtacccccgtttacccggttccccgtttccccccgttcccccggtccgggtacccccgtcccgttccggaaccccgtaccggaaccggacccgtcccccgtaaacccggtacccggtaacggcccg

SEQ ID NO: 393951 - DNA, 672 bp, Homo sapiens
  misc_feature: GZ8MTXP02I2ECD.38.28.C06.1.454.CMB.2.raw
  modified_base (214)..(214): a, c, t, g, unknown or other
  modified_base (260)..(260): a, c, t, g, unknown or other
  modified_base (271)..(271): a, c, t, g, unknown or other
  modified_base (335)..(335): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaagggctggagtgggtctcagctaattaagngggtaggggtnattcaccatattacgcagactccggtgggggccgttcaccatcaccagagacaactccaggacncacactatatctaacaaatgaccacagcctgagacgtcgagggaccacggggtccgttagtatttaagtggtcgacgagacgtaacgtaccccgaaaggtcgaaccctacccgtttgggtcgttcgtttttgactttttcgtaggttcggacccgaaaggggtacctaaaggtcggtaccctaccggttcttcgttacaccgtaccctacccgaacccgtaaacgggggtccccctaaggttccccgggtttccctttccccccggtcgggtcccccgtccccgttcggtcccttacccgacgggtaccgccgtaccccgtaccggacggtaaccgg

SEQ ID NO: 393952 - DNA, 602 bp, Homo sapiens
  misc_feature: GZ8MTXP02IUOMF.38.28.C06.1.454.CMB.2.raw
  modified_base (263)..(263): a, c, t, g, unknown or other
  modified_base (279)..(279): a, c, t, g, unknown or other
  modified_base (282)..(283): a, c, t, g, unknown or other
  modified_base (285)..(285): a, c, t, g, unknown or other
  modified_base (298)..(298): a, c, t, g, unknown or other
  modified_base (301)..(301): a, c, t, g, unknown or other
  modified_base (316)..(316): a, c, t, g, unknown or other
  modified_base (456)..(456): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgttttctaggtggttatttaaaaggtgtcagtgtgagtgcaggtgtcggagtcgtgggggagcttggttcaggcccgggggtcctgagctctctgtgcagtctntggaattacctttagnatnncntgatcgtcggccncgngcgtacggaggaggngtggtaggtggtcgtcgagtagtaagttagtaggtaggtacgtacgtacactatacgtacgacgcgtacgtcgggtcggggtccgtccgacgacacgacgacgacgacgacgacgacgacgacactactatactactaanaactacgacgacgacgtacgtacgacgacgtacggacggaacgtacggtacgtagtagttacgttagtacggacggacgtacgtacgtaccgtacgtacgtaaccgtaccgttacggttcgttacgtttacgtttacgttacgtcg

SEQ ID NO: 393953 - DNA, 713 bp, Homo sapiens
  misc_feature: GZ8MTXP02IVAU3.38.28.C06.1.454.CMB.2.raw
  modified_base (259)..(259): a, c, t, g, unknown or other
  modified_base (269)..(269): a, c, t, g, unknown or other
  modified_base (306)..(306): a, c, t, g, unknown or other
  modified_base (318)..(318): a, c, t, g, unknown or other
  modified_base (325)..(325): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctgggggggtccctgagactctcctgtgcagtctctggattaacctttagtgactatgccatgatctgggtccgcaggctccgagggaagggctggagtgggtctcagcaattaagnggtaggggtntatcacatatacgcagcgtcgggtcggggcctcacancacagacacacncgagacncacatatactactaacaaatcgacccacgacgtccgtaggacggtacggtacgggacgggaccgaccggggtcgttagtttaatttaggtggtaggacggagaacgtaccgtaacccggtaacggtaccgtacccgttaccggtttagggttcgtttacgtttagttacgttttcggtcgggttacgggaccgggtaagggtactaacgggttaccggtacccgtaccgttccttccgttacgtaccgtaccccgtaacccgaacccggtaaccggtaccccgtacggttccccgggtttcccccttcccccgggtccggtaccccgtccccgtcggtaacccgtaccggaaccggtaccgtacccgtacccggtaccggacgtaccg

SEQ ID NO: 393954 - DNA, 670 bp, Homo sapiens
  misc_feature: GZ8MTXP02GTOEC.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttcttgtggctattttaaaaggtgtccagtgtgaggtgcaggtgtcggagtcgtgggggagtcgttggttcgacgggtcccgggggtccctgacgactctcctgtgcagtctcgtggaactttaaccttagtgaacttatcgaccatgatcgtcggtccgcaggcctacggaggggaacgggcgtgggaggtgggtctacgagactaaagttaaggtgggtacggggtagtacttaccactaatacttacgccgtagtacccggttccggggtcggggggtcccgttacgaacctacgtacccaaaccgacgaacgaacccgaactaccgaggaccacaacaacttataactacctaaacaaatacgacacgaacgtccagagtacggacggaacggacgtaccggccgtagtttacgttagtggtacggacgaacgtacgaaccgtcccgtaaacgggtcgtacccgtaaccgtttggttaccgttgttttaacggtaccttttcggg

SEQ ID NO: 393955 - DNA, 629 bp, Homo sapiens
  misc_feature: GZ8MTXP02JMZ96.38.28.C06.1.454.CMB.2.raw
  modified_base (281)..(281): a, c, t, g, unknown or other
  modified_base (304)..(304): a, c, t, g, unknown or other
  modified_base (364)..(364): a, c, t, g, unknown or other
  modified_base (387)..(387): a, c, t, g, unknown or other
  modified_base (483)..(483): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttctgtggctattttaaaaggtgtccagtgtgaggtgcgaggtgtcggagtcgtgggggaggcttggttcaggcccgggggtcctgagactctcctgtgcagtctctggattaaccttagngactatgccatgatctgggtccncaggctccgaggggaaggctgggagtgggtctcgagactaagttaagtggggtaggggtnacttcgaacctataacgttacgngtacgacgttccggggtcggggggtacccgttcaacccgacgtccaacccgagacgaacaactcccgaggacgcaacaactatactaccttaaaanaatcgacacgacgcgagagacgtacgacggaccgtacggtcgttagttaactttagtcggtacgacggtaacgacgtaaccgtaacccggtaacggtaaccgtaacccgttacggttcggttacgtttacgtttacgtacgtttcg

SEQ ID NO: 393956 - DNA, 670 bp, Homo sapiens
  misc_feature: GZ8MTXP02GJRRN.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctaattttaaaaggtgtccagtgtgaggtgcaggtgtcggagtcgtgggggaggcgtttggttcgacgggccccggggggtccctggagacctctcctgtgcagtctcgtggatttaacctttagtgactatgccatgatcgtgggtccgccaggcctccgaggggaaggggctgggaggtcggggtctcgagactaaagttaaagtgggtacggggtagtattacgacctaagttaacttacgctaacggaaccgttccgggggtcggggggtcccgttacgaccaacgtaccaaccgaagaacgaaccaaacgtacccgaaggacgacaacaactataactactaacaaaagtcgacacacggcctagaacgacggtacgaacggaccgaccgggtaccgtagtttacgttagttggtacggacgtacgaacggtacctacccgaaacggtcgacccgttacggttacggttcgttacgttttaggtaacttttccgg

SEQ ID NO: 393957 - DNA, 688 bp, Homo sapiens
  misc_feature: GZ8MTXP02IF06U.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggaggtcttggttcacgggccccgggggtccctgagactctcctgtgcagtctcgtggtactttaaccttagtgacttatgccatgatccgtcgggtcccgccgagggtcctccggaaggggaacggggtcgtaggggaggttcggggtcctacgagtacgtaaattaaaggtgggtaggggtatagttaccaactattacttacggcaacgaccgtccggggtcggggggtcccgttacacctaactccaaccgaacgtaacgaacgtaaccctacccgaggacgaccaacctaacttaactacttaacctaaaccaaagtcgactaaccgacgtacccgtagaacgtacgtacgggaacggaccgacccgggtccgttagttaacgtttagttggtacgaggacgaagtaccgtaccccgtaggtccgtaacccgtacgtttcggtcgttacgttttgtactttcg

SEQ ID NO: 393958 - DNA, 610 bp, Homo sapiens
  misc_feature: GZ8MTXP02HVIEZ.38.28.C06.1.454.CMB.2.raw
  modified_base (214)..(214): a, c, t, g, unknown or other
  modified_base (296)..(296): a, c, t, g, unknown or other
  modified_base (319)..(319): a, c, t, g, unknown or other
  modified_base (324)..(324): a, c, t, g, unknown or other
  modified_base (331)..(331): a, c, t, g, unknown or other
  modified_base (334)..(334): a, c, t, g, unknown or other
  modified_base (346)..(346): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaaggggctggagtgggtctcagcaattaagtgggtaggggtgattcaccatatacgcagactccggngggggccgttcacatcaccaganacacnccaggancanactatatctaanaaatgaccacagctagagagcgaggacacggccgttgtaatttactgtgcgaagacgtactccccgaaagggtcacccgtacgtttgggtcgttctttttgaacttttcgtggttacggacccgtaaaagggggacctaaaggttcgggtacctaacccggttcttccttcgaacgtcccctacccaaaccgtaacgggcccctagtcccggttcccttcccccgcggccctccctcgcctccgacgacgccaccctcgacacg

SEQ ID NO: 393959 - DNA, 608 bp, Homo sapiens
  misc_feature: GZ8MTXP02HJH0M.38.28.C06.1.454.CMB.2.raw
  modified_base (183)..(183): a, c, t, g, unknown or other
  modified_base (309)..(309): a, c, t, g, unknown or other
  modified_base (371)..(371): a, c, t, g, unknown or other
  modified_base (468)..(468): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttctgtggctattttaaaggtntccagtgtgaggtgcaggtgtcggagtctgggggagcttggttcaggcccggggggtcctgagactctcctgtgcagtcctctaggactttaaccttagtgactatcgccatgatcgtcgggtccnccgagggctaccgaggggaagggcgtgggagtgggtctcgagactaataagtggtaggggtntactcaactatacttacgcacgtacgtccggggtcgggggtaccgtacactacaccgacgagacgacaactcgagacacacaactatactactaaanaaacgtcgaacacgacgtacaggagacggacgaacgacgtacggacgtagttaacgttagttgtacgacggaacgacgtacgtacccgaacggtaaccgacccgttacggttcggttcgtttcgtttacgttacgtttcg

SEQ ID NO: 393960 - DNA, 728 bp, Homo sapiens
  misc_feature: GZ8MTXP02JYUEC.38.28.C06.1.454.CMB.2.raw
  modified_base (258)..(258): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcacagagacactccaggncacactatatctacaaatgcacagcctgagagtcgaggacacggccgtgtacttagttgtgcgaagacgtactccccgaaacgggttcgacccctaccgtttgggtgttccttttttgaacttttttcgcggttcgggacccgaaaagggggtaacaaacggttcgggtaccgtaacccggttctttcctttacccgaacggtaccccctacccgaaacccgaaacggggtccccctaacgttccccgggttcccctttaccccccggttgggaccccgttccccgccggtacccgttaccgtaccgggacgacccctaacccggtccgacgaaccggaccaaacccgggacgggccccggtccccggtacgggggccttcggccccgttgggtacccgaaacggttaccttaccgtacccgtacgtacgtcgtaccggaacgttggaccggcggtacgtcgggaaccgg

SEQ ID NO: 393961 - DNA, 620 bp, Homo sapiens
  misc_feature: GZ8MTXP02IZ9RM.38.28.C06.1.454.CMB.2.raw
  modified_base (214)..(214): a, c, t, g, unknown or other
  modified_base (259)..(259): a, c, t, g, unknown or other
  modified_base (270)..(270): a, c, t, g, unknown or other
  modified_base (328)..(328): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaagggctggagtgggtctcagcaattaagngggtaggggtnattcacatattacgcagaccgtccgggtggggggcccgttacaccatccaaccagganaaccaactccgaaggacacaacactatactactaacaaatcgaccacacgcctggaagacgtcggaggaccgacgggtccgtagttaattacgttgtcggacgaagacgtacgtacccgaacggtcgaccttaccgttggtcgttctttgactttcgtggttcggaccgtaaagggactaagtcgtacccgtccgttcgtcttacgacgtccctaccaaccgaacggccctagttcccggtaccctccccgtcggccgaccctgaacctcgacgacgccacctcgacgaccg

SEQ ID NO: 393962 - DNA, 649 bp, Homo sapiens
  misc_feature: GZ8MTXP02GNFVR.38.28.C06.1.454.CMB.2.raw
  modified_base (330)..(330): a, c, t, g, unknown or other
tcagtcgatcacgtcacgaccggtgctcgatttagagctcacgtattgggtttggggagctctgagagaggagcccagccctgggattttcaggtcgttttcatttggtgatcaggactgaacagagagaactcaccatggagtttgggctgagctggtctttttcttgtggcttaattttaaaaggtgtccagtgtgaggtgcaggtgtcggagtcgtgggggagtcgtttggttcgacgggcccggggggtcctggacgactctcctgtgcagtctcgtaggtactttaaccgtttagtgacttatcgcctatgatcgtcgggtcccnccgagggcctaccggaggggaacggggcgtggggtacggtgggtcctcgagtactaaagtttaaaggtggggttacggggtagacgttacaacctatacgttacgcgaacgtaccgtcggggtacgggggcccttacaactctaccacaagacgaactaaccgacgaggacacaacactataactactaaacaaacgtcacacgacgcctaggagacgtacggacggaaccgacggtaccgttagtacttagtttcgagacgaagacgacctacccgaaggtaaccaccgttaacggtgtcgttactttgtacctttgg

SEQ ID NO: 393963 - DNA, 545 bp, Homo sapiens
  misc_feature: GZ8MTXP02H1C35.38.28.C06.1.454.CMB.2.raw
  modified_base (437)..(437): a, c, t, g, unknown or other
  modified_base (458)..(458): a, c, t, g, unknown or other
  modified_base (474)..(474): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggagcttggttcaggcccgggggtccctgagactctcctgtgcagtctctggattaacttagtgactatgccatgatctgggtccgccaggctccgaggggaagggctgggagtgggtctcgagcaaattagtggtacggggtgattcacctatattacgcagactccggtgggggccgttcaacatcgaccagagacaactaccagagcaacactatanactaacaaatgacacagtccngagagtacgaggaacncggccgtagattatgtcgagagagacgtacccacgtcgaaccgtaccgttcgtggtacctttgtattttcg

SEQ ID NO: 393964 - DNA, 690 bp, Homo sapiens
  misc_feature: GZ8MTXP02GR71Q.38.28.C06.1.454.CMB.2.raw
  modified_base (393)..(393): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggaggtcgttggttcgacgggccccggggggttccctggacgacctctccgtgtgcagtctgtggtatttaaccttagtgactatcgccatgatcgtcggtccgccgaggcctaccggaggggaaggggcgtgggaggtcgggtctcgagactaaattaggtgggtaggggtnacttcacctattacgttacgcacgtaccgtccgggtgggggtcccgttacgaccgtactaccaaccgaggaacgaaccaacgtacccgaggacgacactaactatactactaaacaaagtcacgacacgtaccgtaggacgtacggtacgaacgggacctacggggtacgtttagttaaactttggttacggtaggacggaaaggtaccgtaaacccgtaccccggtaaaacgggttccgaacccctttaaccgggtttagggttaccgttttcgtttttaggtactttttccgggg

SEQ ID NO: 393965 - DNA, 578 bp, Homo sapiens
  misc_feature: GZ8MTXP02H9Q8H.38.28.C06.1.454.CMB.2.raw
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagctggctttttcttgtggctattttaaaaggtgtccagtgtgaggtgcagggtgtcggagtcgtgggggaggcttgggttcaggcctgggggggtccctggagactctcctgtgcagtctctggattaaccttagtgactatgccatgatcgtgggtcccgccgaggctccgaaggggaggggctgggaggtgggtctcagactaaagttaagtgggtaggggtgattcgacctagtattacgcagtaccgtccgggtggggggtcccggttcaacccatccaccagaacgaccaaactaccgaggacgcaacactaatactactaaacaaatgacacacgcctagagagtacgaggacgacggcgtagtattagtgtgacgagacgctacccgaaggtcaacctacgttggtcgtcttttgtacg

SEQ ID NO: 393966 - DNA, 609 bp, Homo sapiens
  misc_feature: GZ8MTXP02FHXES.38.28.C06.1.454.CMB.2.raw
  modified_base (420)..(420): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctaattttaaaaggtgtccagtgtgaggtgcaggtgtcggagtcgtgggggaggcttggttcaggcccgggggtcctgagactctcctgtgcagtctctggattaaccttagtgactatgccatgatctggtccgccaggctccgaggggaaggggctgggagtgggctcgagcaaattaatgggtaaggggtgattcacctatacttacgcagactccggtggggggccttcgaccatcacagagacacnccagagcaacactatatactaacaaaatcgacacacgacctagagagtacgacggaacgaaccgggacccggtacgtaacgttaaagttaggttcgtacggaacggtaagtaacgacccgtaaaccggttaaccggaacccgtaaacccgttaccggttacggttacgttttacggttttacgtttacg

SEQ ID NO: 393967 - DNA, 623 bp, Homo sapiens
  misc_feature: GZ8MTXP02GJ61B.38.28.C06.1.454.CMB.2.raw
  modified_base (315)..(315): a, c, t, g, unknown or other
  modified_base (518)..(518): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtctttttcttgtggcttaattttaaaaggtgtccagtgtgaggtgcaggtgtcggagtcgtgggggaggcttggttcacggcccgggggtcctgagactctcctgtgcagtctctggatttaaccttgtgactatcgcctatgatcgtcgggtcccncgaggcctccgaaggggacggcgtgggagttgggtctacgagactaaagttaagtgggtaggggtatacttaccaacctaatacgttaacgcgaacggtaccgttccgggggtcggggggtcccttaccgaaaccgtactacccgaaacccaagaacgaaccaaaccgtccgaaagggacacaaccataatactacctaaaanaactcacacacgacagagacgacggaacgacgacggtcgtagttacttgtgcgagacgacgacctaccgaacgtccgacgtcgttgtctttctttagttacttcg

SEQ ID NO: 393968 - DNA, 600 bp, Homo sapiens
  misc_feature: GZ8MTXP02IUWUT.38.28.C06.1.454.CMB.2.raw
  modified_base (310)..(310): a, c, t, g, unknown or other
  modified_base (316)..(316): a, c, t, g, unknown or other
  modified_base (342)..(342): a, c, t, g, unknown or other
  modified_base (364)..(364): a, c, t, g, unknown or other
  modified_base (424)..(424): a, c, t, g, unknown or other
  modified_base (473)..(473): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttctgtggctattttaaaaggtgtccagtgtgaggtgcaggtgtcggagtcgtgggggagcgtttgggttcgacggcccggggggtcctggagctctcctgtgcagtctcgtggactttaaccttgtgactatgccatgatgcggtccncgagcncgaagggaggctgggagtggtctagngactaagtagtgggtacgggtnattaccgactatacgttacgcgtaacgtacgtccgggtacgggggtcccgttacacctanccacagacgaacactccgagacgtacaacaatacactactaaacaaacncgacacgacgaccgtagaggacgtacggaacggaccgtaccggtcgtagttacgttagtgacgagacgtacgtacgtacccgaggtaaccgtaccgtacgttcgtcgtttacgtttcgttacgttcg

SEQ ID NO: 393969 - DNA, 678 bp, Homo sapiens
  misc_feature: GZ8MTXP02JJXNO.38.28.C06.1.454.CMB.2.raw
  modified_base (211)..(211): a, c, t, g, unknown or other
  modified_base (254)..(254): a, c, t, g, unknown or other
  modified_base (264)..(264): a, c, t, g, unknown or other
  modified_base (389)..(389): a, c, t, g, unknown or other
  modified_base (401)..(401): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctgggggtccctgagactctcctgtgcagtctctggattaacctttagtgactatgccatgatctggtccncaggctccgagggaagggctggagtgggtctcagctaattaanggtaggggtnattcaccatattacgcagactccggtgggggccgttcaccgatccaccagagacaactccgaggagtcaacactatatacgtaacaaatcgaccacagcctggagagtcgaggacacgggtcgtnttaattattggngacgagagactaccgagtcgacctacgttggtcgttcgtttagtacgtttcgtacggtacggtaacggtaacgggtaactaacggttcggttacccgtaccgttccttaccgttccgaccgtccccgtacccgaaacccggtacccgggtaccccgtacgttaccccgggttcccccgttacccccgggtaccggtacccccgtcccccgtaccggtaaccccgttaccggaaccgggtaacccgtacccgtaaccccgtacccgggaacgtaccgg

SEQ ID NO: 393970 - DNA, 570 bp, Homo sapiens
  misc_feature: GZ8MTXP02FGMBC.38.28.C06.1.454.CMB.2.raw
  modified_base (269)..(269): a, c, t, g, unknown or other
  modified_base (292)..(292): a, c, t, g, unknown or other
  modified_base (392)..(392): a, c, t, g, unknown or other
  modified_base (556)..(556): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccgccaggctccgagggaagggctggagtgggtctcagcaattaagtgggtagggtnattcacatatacgcagactcggngggggccgttacaccatccaccagagacactccaggacgcacactatatctaacaaatgaccacagctgagagtcgagaccacggctagtacttagttgngacgagagactacccgaaggtcgacccaccgttggtacgttctttgatttcgtggtggacccaaagggactaagtgtaccacgttcttcttcgacgcctaccaacgaacgggcccagttcccggtccttaccccgtcgcccgcccgtgcctaccgacgggaccnccaccgcgacgacg

SEQ ID NO: 393971 - DNA, 684 bp, Homo sapiens
  misc_feature: GZ8MTXP02JKXLM.38.28.C06.1.454.CMB.2.raw
  modified_base (216)..(216): a, c, t, g, unknown or other
  modified_base (272)..(272): a, c, t, g, unknown or other
  modified_base (294)..(294): a, c, t, g, unknown or other
  modified_base (324)..(324): a, c, t, g, unknown or other
  modified_base (340)..(340): a, c, t, g, unknown or other
  modified_base (482)..(482): a, c, t, g, unknown or other
tcagtcgatcacgtcacgaccggtgctcgatttagagctcacgtattgggtttgggctgagctggcttttttcttgtggctatttttaaaaggtgtccagtgtgaggtgcaggtgtcggagtctgggggaggcttggttcagcctggggggtccctgagactctcctgtgcagtctctggatttaacctttagtgactatgccatgatctggtccnccaggctccgagggaagggctggagtgggtctcagactaattagtgggtaggggtnattcacatatacgcagctcggnggggccgttcacatcacagagacatcagancacatatactactaanaaatgacccacacgcctagacgagtacgagggaccacgggtccgttagtactttagttggtacgacgaagacgtaccgtacccgaaacgggttaccgaaccctaccgtttggttcgtttcgtttttacggtactttttccgngggttacgggacccgtaaagggggacctaaggttccggtaccgtaccggttcttaccttaccgacgtaccctacccgaacccgtaaccggggtcccctaacggttcccggtttccccgttcccccgttacgggcccccgtacccgttcggaacccttcccggaaacggggtaccacccgtaacccgtaccggaacgaaccgg

SEQ ID NO: 393972 - DNA, 694 bp, Homo sapiens
  misc_feature: GZ8MTXP02GVMIG.38.28.C06.1.454.CMB.2.raw
  modified_base (275)..(275): a, c, t, g, unknown or other
  modified_base (337)..(337): a, c, t, g, unknown or other
tcagtcgatcacgtcacgaccggtgctcgatttagagctcacgtattgggtttgggctgagctggcttttttcttgtggctattttaaaaggtgtccagtgtgaggtgcaggtgtcggagtctgggggaggcttggttcagccgtggggggtccctgagactctcctgtgcagtctctggatttaacctttagtgactatgccatgatcgtgggtccgccaggctcgaggggagggctggagtgggtctcagctaaagttaagtgggtaggggtnattcactatatacgcagacgtcgggtggggccgttcaccatccacagacacaactcgaggancacactatactactaacaaatcgacccacacgcgtagaggacgtacgacggaccacgggtcgtagttagtttagtgtagacgaagacgtaacgtaccccggaacgggtaccgtaacccgttaccgtttgggttcgtttacgtttttagtaacttttccggttagggttaccgggaaccggtaaaggggaaccttaaggtccggtaccctaccggttccttccgttacgaccgtcccctaccgaaacccgggtaccggaccccttacggtccccggttaccccgttcccccggtcggtcccccgtcccgttcggaacccgttccggaacgggacctccgtaccccgcggaacgaaccg

SEQ ID NO: 393973 - DNA, 655 bp, Homo sapiens
  misc_feature: GZ8MTXP02GYPI5.38.28.C06.1.454.CMB.2.raw
  modified_base (264)..(264): a, c, t, g, unknown or other
  modified_base (351)..(351): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtctttttctgtggcttaattttaaaaggtgtccagtgtgaggtgcaggtgtcggagtcgtgggggcgtgttggtcgacgggcccggggtcctgacgactctcgtgnctgtctcgtgtaactttaacgttgtcgtactagtcgacctagtgtctccggtcgggtcccgacgcggtcccgacggaaggggacggngtggggaggttgggtcctagacgtaagttaaagttaggtcggggtaggggtacgtacttacctaactattaacgttaccgcgtaacggtccgggttccgggggtcgggggtcccttaccgacctctaccgacgaagacgaacctaccgaccgaggacaccaactatatactaccaagaaatcactaacgcgacgtagacggtacgacggacgacgcggtactgtttaatgttacggcgacgtacgacgtaccgtaccgtacgtaaccgtacgttcggtttcgttcgtttacgttgtttcgtcgg

SEQ ID NO: 393974 - DNA, 695 bp, Homo sapiens
  misc_feature: GZ8MTXP02JNR3P.38.28.C06.1.454.CMB.2.raw
  modified_base (198)..(198): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccagggaaggggctggagtgggtctcagcaattaatggtaggggtnattcaccatatacgcagactccggtgggggccgttcaccatcactagagacaactccaggagcacactatatctacaaatgcacagcctgagagtcgaggacacggccgtgtattattgtgcgagagactcccgaaacggtcgaaccctaccgttggtcgtcctttttagattttcgtggttacggccgaaaggggtacaaagttcgggtacctaccggtcttcttacacgtccctaccgaccgaacgggtcccacgttcccgggtcccttccccccgtgggcccgtccccgtcggcccttaccgaacgggccgtacccgtaacccgtccggaaacggaccgacccgaaccgaccggcccgggtcccccgttagggggccccttacgggccccgtttacggggacccaaaaccggggtcccttaaacccgttccccgtaacggttacgaacgttaccggaacgttcgggaaccgggtccgggtcggtacggaaccgg

SEQ ID NO: 393975 - DNA, 627 bp, Homo sapiens
  misc_feature: GZ8MTXP02I4UZ5.38.28.C06.1.454.CMB.2.raw
  modified_base (268)..(268): a, c, t, g, unknown or other
  modified_base (291)..(291): a, c, t, g, unknown or other
  modified_base (295)..(296): a, c, t, g, unknown or other
  modified_base (330)..(330): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgttttctaggtggctaattttaaaaggtgtccagtgtgaggtgcaggtgtcggagtcgtgggggagcttggttcgacggcccgggggtcctggagacctctcctgtgcngtctctggacttaaaccttggtnactnncatgtctcgtcggccgcgacgcgcggagggaggngtggtggtgtcacgagtagtaagtaggtaggtacggtagtacgtactactactacgtacgcgtacggtacggtccggggtccggggtccggtacgaccgtacgtacgacgacgacgaacacgacgacgacgacactactactactaactaactaacgacacgacgacgtacgacgaggaaggtaggaacggacgtacgtacgttacgttacgttagtacggtacgacgacgtacgtaccgtaccgtaccgtaaccgtaccgttacgttacggttcgtttacgtttacgttacgttcg

SEQ ID NO: 393976 - DNA, 640 bp, Homo sapiens
  misc_feature: GZ8MTXP02JXT2J.38.28.C06.1.454.CMB.2.raw
  modified_base (380)..(380): a, c, t, g, unknown or other
  modified_base (492)..(492): a, c, t, g, unknown or other
tcagtcgatcacgtcacgaccggtgctcgatttagagctcacgtattgggtttgggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttcagccgaggggggtccctgagactctcctgtgcagtctcgtggtactttaaccttagtgactatgccatgactcgtgggtccgccgaggtcctccgaggggaacgggcgtgggaggttgggtctcgagctaaattagtgggtaggggtntattacacctattcgttacgcaggtaccgtccggggtcgggggtccgttcaccgtactccaaccgagacgaccaacctcgacggacgaccacactaactatacctaaataancgaccaagtacgccgaggaacggacgtaccggaagggacctaccggggaccgtttaggtaaacgtttgtacggtggaaccgaggaaccgtacgtacccgaagggttccgtaaccgtacccgtttgggtacgtttcgtttacggttacg

SEQ ID NO: 393977 - DNA, 635 bp, Homo sapiens
  misc_feature: GZ8MTXP02F2MDV.38.28.C06.1.454.CMB.2.raw
  modified_base (272)..(272): a, c, t, g, unknown or other
  modified_base (336)..(336): a, c, t, g, unknown or other
  modified_base (343)..(343): a, c, t, g, unknown or other
  modified_base (346)..(346): a, c, t, g, unknown or other
  modified_base (351)..(351): a, c, t, g, unknown or other
  modified_base (368)..(368): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaagtgggtaggggtnatttcactatattacgcagacgtccggtgggggccgtcacatcaaccagagacaactccaggancacactntanctaanaaatgcacagcctaganacgtacgaggccacggggtccgtagttagttaatgtacgcgagaagacgtacccgaaacggtcgaacccacgtttcggtcgtcttttaggtacttttcgttagttcggacccgtaaagggtacaagttcggtcccgaaccgtcttactttaccgacgccttcctaacccgtaacgggtcccaaagttcccggttacccttcccccgttcggcccgtccccgttacgcccgtccgacgggaccgaccgacccgtaccgacggaaccgg

SEQ ID NO: 393978 - DNA, 576 bp, Homo sapiens
  misc_feature: GZ8MTXP02HCK7A.38.28.C06.1.454.CMB.2.raw
  modified_base (304)..(304): a, c, t, g, unknown or other
  modified_base (365)..(365): a, c, t, g, unknown or other
  modified_base (449)..(449): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagctggcttttcttgtggctattttaaaggtgtccagtgtgaggtgcaggtgtcggagtcgtgggggaggcttggttcagccgtgggggtcctgagactctcctgtgcagtctctggattaaccttagtgactatgccatgatcgtgggtccnccgaggctccgaggggaagggctgggagtggtctcgagctaagttaagtcgggtaggggtntagttcacctattagttacgctagaccgtccgggtgggggtacccgttcacccgatcacccgagacgaaccactaccgaggacncaacactataactactaaacaaatcgacacaacgccgagaggacgtacgacgggaacgtcggccggttatagttgtgtgcgagacgacgtacccgaagtcgtaccacgttgggcttcgtttagtacg

SEQ ID NO: 393979 - DNA, 589 bp, Homo sapiens
  misc_feature: GZ8MTXP02IRKS1.38.28.C06.1.454.CMB.2.raw
  modified_base (183)..(183): a, c, t, g, unknown or other
  modified_base (227)..(227): a, c, t, g, unknown or other
  modified_base (278)..(278): a, c, t, g, unknown or other
  modified_base (285)..(285): a, c, t, g, unknown or other
  modified_base (315)..(315): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgtttctaggtggctatttaaaggngtcagtgtgagtgcaggtgtcggagtcgtggggagcttggttcnggcccgggggtcctgagctctcctgtgcagtctcgtgtattaaccttggtntatatcnctatgatcgtcgcgcgcgcgcggaggaggngtggtaggtggtcgtacgagacgtaagtaggtaggtacggtagtactactactatacttacgcgtacgtacggtaccgggtcggggtccgtaccgacgtacacgacgacgaacgaacacgtacgacgacgacaactactactactaactaactaatacacacgacgacgacgacgacgacgacggacgacgtacgtagtacgttagtagtacgtagacgtacgtacgtacgacgtaacgtacgtacgttacgttcgttcgttacgttacgttcg

SEQ ID NO: 393980 - DNA, 627 bp, Homo sapiens
  misc_feature: GZ8MTXP02IH4SF.38.28.C06.1.454.CMB.2.raw
  modified_base (270)..(270): a, c, t, g, unknown or other
  modified_base (275)..(275): a, c, t, g, unknown or other
  modified_base (294)..(294): a, c, t, g, unknown or other
  modified_base (299)..(299): a, c, t, g, unknown or other
  modified_base (458)..(458): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcgtttctaggtggctaattttaaaaggtgtccagtgtgaggtgcaggtgtcggagtcgtgggggagtcgttggttcgacggcccggggggtcctgagcgtctccgtgtcgcngtctntaggatttaaaccttggtntactntcgctatcgtcgtcgccggtccgcgcgcgtacggagggtacggtgtgggtcgtcgtcgagagtaagtaagtaggtggttacggtagttactactactatacgtacgcgtacgtcggtccgggggtcggtccgtacactacacgacgacgaacaccacgngacgactactaaactataactactaacaaacgtaacacgacgacgacgacgtacgtacgtacggacgacggtacggtacgtacgtagttacgttagtagtcgacgtacgtacgtaccgtaccgtacgtaaccgtacgtacgttcgttcgtttcgtttacgttacgttcg

SEQ ID NO: 393981 - DNA, 638 bp, Homo sapiens
  misc_feature: GZ8MTXP02JOIE6.38.28.C06.1.454.CMB.2.raw
  modified_base (215)..(215): a, c, t, g, unknown or other
  modified_base (276)..(276): a, c, t, g, unknown or other
  modified_base (330)..(330): a, c, t, g, unknown or other
  modified_base (636)..(636): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccnccaggcctccgaggggaagggctggaggtgggtctcgagctaaattaagtgggtaggggtnattacacatatacgcagacgtccggtggggccgttcacatccacagacgacacncgagagcacactagtactactaaccaaatcgaccacgactcccgtaggaggacgcggacggacgacggggcccgttagttattagttgacgcgaaagtacgacctacccgaaggggtcctaaccgtccgttggtcgttactttgtactttcggtgtagacccggaagggactaagtcggttaccacggttccttctccgaactccacccgaccgtaaaccggggtccctaggttccccggtcccttcccccgtggggccccctaaccctcgccctaaccggaggaccccaccgtacccggacgacncg

SEQ ID NO: 393982 - DNA, 703 bp, Homo sapiens
  misc_feature: GZ8MTXP02IPJSV.38.28.C06.1.454.CMB.2.raw
  modified_base (269)..(269): a, c, t, g, unknown or other
  modified_base (326)..(326): a, c, t, g, unknown or other
  modified_base (342)..(342): a, c, t, g, unknown or other
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaagggctggagtgggtctcagacaattaagtgggtaggggtnattcacctatatacgcagactccggtggggccgttcacatcacagagacactcaggnacacatatatactaanaaatgaccacacgcctaggagacgtcgaggacgacggccgtagttacttatgtcgacgtagacgactacccgaacgggtccgtaacccgtaccgtttgggtacgtttccgtttttagtaacgtttttcccggtggtttaccggggaacccgtaaagggggtaaaccctaaagggttccgggttaaccgtaccccggttactttccgttaccgtaccgtccccctacccgtaaaccccggaaccggggtacccccttaaggtcccccggtttaccccgttccccccggttcgggcccccgtcccccgttcggcccctccgaacggggtaccccgacccgtaccccgtaccggacggaacccg

SEQ ID NO: 393983 - DNA, 619 bp, Homo sapiens
  misc_feature: GZ8MTXP02HYI20.38.28.C06.1.454.CMB.2.raw
  modified_base (275)..(275): a, c, t, g, unknown or other
  modified_base (290)..(290): a, c, t, g, unknown or other
  modified_base (314)..(314): a, c, t, g, unknown or other
  modified_base (333)..(333): a, c, t, g, unknown or other
  modified_base (364)..(364): a, c, t, g, unknown or other
  modified_base (423)..(423): a, c, t, g, unknown or other
  modified_base (471)..(471): a, c, t, g, unknown or other
  modified_base (482)..(482): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttctgtggcttattttaaaagtgtccagtgtgaggtgcaggtgtcggagtcgtgggggaggctttgggttcgacggcccgggggtccctggacgacctctcctgtgcagtctntggtattaaccttgngactatcgccatgatcgtggtccncgaggcacgaggggacggntggagtggtctcagctaagtagtggtaggtntatcgaactatacttacgcgacggtaccgtaccggggtcgggggtccttacaccttacnccgaacgaggaagaccaactacccgaggacgcaacatatactactaanaaatcgacacncgcctagacgagtacggagtaccgaacggtccgttagttaattgtttcgggagtcggaaactacggaacccttaacccggtaacgaaccgtacccgttaccgttgggttctttaccgtttttaggttacttttcggg

SEQ ID NO: 393984 - DNA, 582 bp, Homo sapiens
  misc_feature: GZ8MTXP02FHUNN.38.28.C06.1.454.CMB.2.raw
  modified_base (330)..(330): a, c, t, g, unknown or other
  modified_base (333)..(333): a, c, t, g, unknown or other
  modified_base (344)..(344): a, c, t, g, unknown or other
  modified_base (389)..(389): a, c, t, g, unknown or other
  modified_base (409)..(409): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctggggggtccctgagactctcctgtgcagtctctggattaacctttagtgactatgccatgatctgggtccgccaggctccgagggaaggggctggagtgggtctcagcaattatgggtaggggtgattcacatattacgcagactccggtgggggccgttcaccatcaccagacacaactccaggncanactatatcaanaaatgaccacagcctgagagtcgaggacacggccgtgtattatgngcgagagatcccgaacggtnacccaccgttggtgttcttttgtatttcgtgtacgggcctaaaggggactaaagtggtcccaccggttctccttcacgccctccgaaccgaacgggcccagttcccggtacccttcccccgtggccccgtcccctgcccgtaccgacggtcgacccgacctccggacgaacgg

SEQ ID NO: 393985 - DNA, 706 bp, Homo sapiens
  misc_feature: GZ8MTXP02H9B5Y.38.28.C06.1.454.CMB.2.raw
  modified_base (305)..(305): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtgggggaggcttggttcaggccgggggtccctgagactctcctgtgcagtctctggattaaccttagtgactatgccatgatcgtgggtccnccaggctccgaggggaaggggctgggagtggggtctcgagactaaagttaagtggggtaggggtgtagttcaccgtatactttaacgcaaacggtaccgtcccggggttacggggggcccgtttaccgaacccgtatacccgaaccgaacggacggaaacccaaaccgtacccgaaggggacgaccaaccaacttactaacttaccgtaaactaaaacttcggaccaaccacggacccttaggaaacggaggttaccggaacggggaacccgaccgggcccggttaaggttaacgtttaagtttggttaggaccggaaggtacgaaccgttaacccgaacggttaaccggacccttaacccgtttagggtcgtttaccgtttttaggttacgtttttccgg

SEQ ID NO: 393986 - DNA, 616 bp, Homo sapiens
  misc_feature: GZ8MTXP02I5LEE.38.28.C06.1.454.CMB.2.raw
  modified_base (481)..(481): a, c, t, g, unknown or other
  modified_base (497)..(497): a, c, t, g, unknown or other
  modified_base (561)..(561): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagctggctttttcttgtggctattttaaaaggtgtccagtgtgaggtgcaggtgtcggagtcgtgggggagcgttggttcaggccgtggggggtccctggagactctcctgtgcagtctctggattaaccttagtcgactatcgccatgatcgtgggtccgccgaggccgtccgaaggggacggggtcgtaggggacggtgggtcctacgagtactaaagtttagtcggggtaggggtagtatttaccacgtattaacttacgcaaggtaccgttccggggtggggggtacccgttcgaacatccgaaccagaacgacaactcgacggancacactaatatacaanaaaatcgacacacgctaggaacgacggacggacggtaacgccgggacgttagttattagttcgngacgtagacgacgtaccgaacggtacgacctacgttgtacgttcgtttagttacg

SEQ ID NO: 393987 - DNA, 704 bp, Homo sapiens
  misc_feature: GZ8MTXP02GAUQF.38.28.C06.1.454.CMB.2.raw
  modified_base (214)..(214): a, c, t, g, unknown or other
  modified_base (307)..(307): a, c, t, g, unknown or other
  modified_base (364)..(364): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcacctgtctttgtctccgagggaaagngccaccctctcctgcgacgggccagtcagtagttgttttacaacggtctacttacgctggtacagacaaaactggccaggctccgagctcctnatctatggtacacgtccgtcgacgggcctacgtggtactcccgagactacggttacnggtcggcgaggtcgggtacgtggggactacggtacttccactctacaccatcacgacagaggtaggacgtactagtaaggtttactttgactagggttaacttacgtttacgttagtacgtacgggaacttaaacgttaaaccggttaactaaaccgttaaaacggggtacccctttaaaccggtttacgtttttaacgggggaacccggttaaaacgggggaaaccgttaaacggccggttaaaccgggaaaaccgttaaaacccgaaaacgggttaaacgttcgggttaccgggaccggttaacggacccctaaaccggttaactttacggtttcccg

SEQ ID NO: 393988 - DNA, 566 bp, Homo sapiens
  misc_feature: GZ8MTXP02F1M6B.38.28.C06.1.454.CMB.2.raw
  modified_base (212)..(212): a, c, t, g, unknown or other
  modified_base (254)..(254): a, c, t, g, unknown or other
  modified_base (315)..(315): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtcttgtctccaggggaanagccacctctcctgcagggccagtcagagtgtttcaacggtntacttagctaggtaccagacaaaacctggccaggctcccgaggctcctcatctatggtacntccgtcacgggccacgtggtactcccaggacacggttcaggtgctaggtgggtctgggacagtacttcactctcacctatcacgacacgacgtgggaggctaggaagtatttgcgtaggttagtattacgtgtctagctagtatataacaacgaccgtactacgtttcggaccgtaggggaccaagcgtacggacgaaaccgaaaccgtaagtcggtacggacgtacggaccctaaactcgttcgtttacg

SEQ ID NO: 393989 - DNA, 639 bp, Homo sapiens
  misc_feature: GZ8MTXP02FZ5Q0.38.28.C06.1.454.CMB.2.raw
  modified_base (218)..(218): a, c, t, g, unknown or other
  modified_base (282)..(282): a, c, t, g, unknown or other
  modified_base (296)..(296): a, c, t, g, unknown or other
  modified_base (428)..(428): a, c, t, g, unknown or other
  modified_base (602)..(602): a, c, t, g, unknown or other
  modified_base (622)..(622): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggatttaacctttagtgactatgccatgatcgtgggtccnccaggctaccgagggggaaggggctgggaggtgggtctcagactaaattaagtgggtaggggtnattcacatatacgnagacgtcggtgggggcctcacatcacagagacaactccgaggacacacactatactacaaacaaatgacccaacacgtactaggaacgacggtacggaggaccaccgggtaccgttagttaatttagttcgngacgaagacgacctacccgtaagggtactaaccccgtaccgtttggtcgtttaccttttagtactttttcgaggttacggaaccgaaaggggtacctaaggtcggtacccacgttctacttcgaccgccctaccaacggaaccggtcccctagtcccgtcccttcccgcggccnccctcgccgtacgacggacnccgtaccgcgaagaccg

SEQ ID NO: 393990 - DNA, 607 bp, Homo sapiens
  misc_feature: GZ8MTXP02F7OWN.38.28.C06.1.454.CMB.2.raw
  modified_base (297)..(297): a, c, t, g, unknown or other
  modified_base (321)..(321): a, c, t, g, unknown or other
  modified_base (379)..(379): a, c, t, g, unknown or other
  modified_base (398)..(398): a, c, t, g, unknown or other
  modified_base (456)..(456): a, c, t, g, unknown or other
  modified_base (466)..(466): a, c, t, g, unknown or other
  modified_base (476)..(476): a, c, t, g, unknown or other
  modified_base (490)..(490): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggagtcgttggttccgacggcccggggggtccctggacgacctctcctgtgctagtctctggtacttaacctttagngactatgccatgatcgtgggtccnccaggctccggaggggagggctgggaggtgggctgagcaaagttagtgggtaggggtntagttcactattacttacncgagacgttccggggtcgggggtccttacacctatacccaaccgaagacgaactaacncccgaggacnccaacactanactactaaacaaancacacacgacagaggacgacggaacggacgacggtcgttagttatttgtgcgacgagtacgtaccgtaccgtaacgtccgtaccgttacggttcggtactttcgtttagtctttcgg

SEQ ID NO: 393991 - DNA, 641 bp, Homo sapiens
  misc_feature: GZ8MTXP02HVRW2.38.28.C06.1.454.CMB.2.raw
  modified_base (302)..(302): a, c, t, g, unknown or other
  modified_base (331)..(331): a, c, t, g, unknown or other
  modified_base (468)..(468): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcaggtgtcggagtcgtgggggaggtcttgggttcgacgggccccggggggttccctggagacctctccgtgtgcagtctctggtaactttaacctttagngactatcgaccatgactcgtcgggtcccnccgaggcctccgagggaaggggcgtgggaggtgggtctcgagactaaagttaagtgggtaggggtgtacgttcaacgtattagttacgcagaccgtcgggtcgggggccgttcacctactcaccgagacaaccaacnccgaggacgacacaactataactactaacaaagtcgacaacacgccgtagagaacggtacggacgggaaccacgggtaccgttagttaacgttagtttggacgcgtaaaggacgtaccgtacccgaacggtaaccgaccgttaccgttggtacgtttctttgttactttccgg

SEQ ID NO: 393992 - DNA, 600 bp, Homo sapiens
  misc_feature: GZ8MTXP02F3X86.38.28.C06.1.454.CMB.2.raw
  modified_base (263)..(263): a, c, t, g, unknown or other
  modified_base (324)..(324): a, c, t, g, unknown or other
  modified_base (468)..(468): a, c, t, g, unknown or other
  modified_base (492)..(492): a, c, t, g, unknown or other
  modified_base (515)..(515): a, c, t, g, unknown or other
  modified_base (533)..(533): a, c, t, g, unknown or other
  modified_base (564)..(564): a, c, t, g, unknown or other
  modified_base (589)..(589): a, c, t, g, unknown or other
tcagtcgatcacgtcacgaccggtgctcgatttagagctcacgtattgggtttgggggaggcttggttcagcctggggggtccccgagactctcctgtgcagtctctggattaacctttagtgactatgccatgatctgggtccgccaggctccaggggaagggctggagtgggtctcagcaattaagtggtagggtgattcaccatattacgcagacgtccggtgggggccgttcaccatcaccagagacaactccgaggancacactatatctaacaaatgacacagcctagagagtcgaaggacacggcgtgtattattgngcgaagagactcccgaaaggtcaccctacgttggtactcttttgactttctggtcggaccctaggggacctaaagtcgggtccaccgttctccttacacgccctacccaaccgaacgggccctaacgtccggtccttcccccgnggtccgccctgccctcgaggaccnccacccgtcgacgacgccgaacncggtcccggcctgggctnaccggttgaccgacggtactacgtcccgagngactccggagtacggacgcggtacncggacgaacgg

SEQ ID NO: 393993 - DNA, 562 bp, Homo sapiens
  misc_feature: GZ8MTXP02F2AXJ.38.28.C06.1.454.CMB.2.raw
  modified_base (213)..(213): a, c, t, g, unknown or other
  modified_base (264)..(264): a, c, t, g, unknown or other
  modified_base (324)..(324): a, c, t, g, unknown or other
  modified_base (525)..(525): a, c, t, g, unknown or other
  modified_base (533)..(533): a, c, t, g, unknown or other
  modified_base (548)..(548): a, c, t, g, unknown or other
  modified_base (555)..(555): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggtccctgagactctcctgtgcagtctctggattaacctttagtgactatgccatgatctgggtccncaggctccagggagggctggagtgggtctcagcaattagtgggtaggggtnattcacatattacgcagactcgtgggggccgttcacatcaccagagacaactccaggacncacactatactctaacgaaatgacccagacgcctgagagtcgagggacacggggccttagtattagttcgtgaccgagagactaccccgaaggtcgaccctaccgttggtcgtctttggatttctggtcgaccgaagggacaagtggtaccacgtcttactcagccctacaaccgtaggcccctatccggtccttccccgnggtccccncctcgcctcgacgcnccgaccncgacgcg

SEQ ID NO: 393994 - DNA, 531 bp, Homo sapiens
  misc_feature: GZ8MTXP02HJBLH.38.28.C06.1.454.CMB.2.raw
  modified_base (268)..(268): a, c, t, g, unknown or other
  modified_base (284)..(284): a, c, t, g, unknown or other
  modified_base (341)..(341): a, c, t, g, unknown or other
  modified_base (358)..(358): a, c, t, g, unknown or other
  modified_base (371)..(371): a, c, t, g, unknown or other
  modified_base (382)..(382): a, c, t, g, unknown or other
  modified_base (391)..(391): a, c, t, g, unknown or other
  modified_base (396)..(396): a, c, t, g, unknown or other
  modified_base (434)..(434): a, c, t, g, unknown or other
  modified_base (438)..(438): a, c, t, g, unknown or other
  modified_base (440)..(440): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggatgagctggctttttcttgtggctattttaaaaggtgtccagtgtgaggtgcaggtgtcggagtctgggggaggcttggttcaggcccggggggtccctgagactctcctgtgcagtctntggattaaaccttagngactatgccatgatctggtccgccaggctccaggggaagggctggatgggtctcagnaataaatggaggggtanatacacatatacngagacgtcggnggggccgtnaccancacagagacactcgaggacacaacaatatatactaaanaaananacacacacagagagacgacgacgacgacgtagtacttagttgtgacgagacgacaccgacgaacgacacgtcgtcgtctttacttacttcg

SEQ ID NO: 393995 - DNA, 616 bp, Homo sapiens
  misc_feature: GZ8MTXP02FG12V.38.28.C06.1.454.CMB.2.raw
  modified_base (215)..(215): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccgaggggaaanagcccaccctctcctgcagggccagtcagagtgttttcaacggctacttagcctggtaccagacaaaaacctggaccaggcctccccgaggcctcctcatctatggtacactccgtcgacgggcccacgtggtactcccagacacggttcagtggactaggtgggtcgtgggacagtacttcactctcaccatcagcagacgtggagctagaagtgtttagctagtgtattacgtgtacagactaagtaacttaactaacgaacgaacccgttaactaccgttttacgggacccggtaaagggggacccaaaacggtcgttaacggaaaccggtaaacccgaaaaccggtaacgtaacggttacggaccgttacggaccctaacctaacgttctttaaccg

SEQ ID NO: 393996 - DNA, 728 bp, Homo sapiens
  misc_feature: GZ8MTXP02IIISL.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggtcttaattttaaaaggtgtccagtgtgaggtgcaggtgtcggagtcgtgggggagtcgttggttcgacgggcccgggggtccctggacgtacctctccgtgtgctagtctcgtggtaactttaacctttagtgtaactatcgacctatgactcgtcggtccgccgaggtcctaccggaggggaagggtcgtagggacggttgggtctacgaagtactaaagttaagtggggttacggggtagtacttcaacctaagttacgttacgcgtaacgtaccggttcccgggggtacgggggtaccccgtttcgaacctacgtaccaaccgaaggacgaaccaaccgtccgaaggacgaccaaacgtactaaatacgtactaaacaaagtcgaccacgacgacctaggaacgacgtacggaacggaaccgaccgggtaccgttagtttaagttacggtttaggacgtaacggaacgtaacgtaacccgttaaccccgaaacgggttaaccgtaaccccgttaccgtttgggtactttaccgtttttagtacgttttaccggg

SEQ ID NO: 393997 - DNA, 599 bp, Homo sapiens
  misc_feature: GZ8MTXP02JBNLA.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggaggcttgggttcaggccccggggggtccctgacgactctcctgtgcagtctctggtattaaccttagtgactatcgccatgatcgtggtccgcaggcctccgaggggagggctgggaggtgggtctcgagactaattagtgggtaggggtgattcactatattacgcagacgtccgggtcgggggccgttcaccatccaccgagacgacaactccgagacgcaacactatactactaacaaatcgacacacgcctagagcgacggagaccgacggcgtagttacttaagttggtacgtacggaacgacggtaacctacccgaaacggttcgaaccccgttacggtttcggtagtttcccgttttagtacgttttcgg

SEQ ID NO: 393998 - DNA, 604 bp, Homo sapiens
  misc_feature: GZ8MTXP02GF9JP.38.28.C06.1.454.CMB.2.raw
  modified_base (373)..(373): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttgggttcaggcccggggggtccctggagactctcctgtgcagtctctggattaacctttagtgactatgccatgatcgtgggtccgccaggctccgaggggaaggggctgggagtggggtctcgagctaagttaagtgggtaggggtnattcacctatacttacgcagacgtccgggtgggggccgttcacctatccaccagacgacaactccgaggacgcacactatactactaacaaatcgacacacgacctagagacggtcggaacggaccgacgggccgtagttaacgtttattggcggcggtaagacgtaccgtacccgtaaacgggaaccgtaacccgtaccgttgggtcgttcgttttaggtactttttcgg

SEQ ID NO: 393999 - DNA, 556 bp, Homo sapiens
  misc_feature: GZ8MTXP02IE2DQ.38.28.C06.1.454.CMB.2.raw
  modified_base (217)..(217): a, c, t, g, unknown or other
  modified_base (322)..(322): a, c, t, g, unknown or other
  modified_base (407)..(407): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggccaccctctctttgtctccgaggggaaagngcccaccctctcctgcagggccagtcagagttgtttcaacggctaacttagcctggtaccagacaaaacctggccaggctccccaggctcctcatctatggtacntccgtcgacgggccactggtactcccagacaggtcagtggcagtggcgtgggacagacttcgactctacacccatcagcagacgnggagctagaagtatttgcagttgtaatttacgtgtcgaagctaggtactaacgtacaacgtacccgtatacgtttcggacctaagggggccaaggactagggaacgaaccgaaaacgtaacgtcggtgacgtcgacaccagtctttacg

SEQ ID NO: 394000 - DNA, 664 bp, Homo sapiens
  misc_feature: GZ8MTXP02GLSY0.38.28.C06.1.454.CMB.2.raw
  modified_base (321)..(321): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctaattttaaaaggtgtccagtgtgaggtgcaggtgtcggagtcgtgggggaggcttggttcgacgggccccggggggtccctggacgactctcctgtgcagtctctggtacttaaccttagtgactatcgcctatgatcgtcgggtccnccgacggctccggaggggaaggggctgggaggtgggtctcgagactaaagtttaaggtggggtaggggtgactttaccaacctagttaacttaccgcgtacggtacccgtccgggggttaccggggggtcccgttaccaacccgtactacccgaacccgaaacggacgaacctaaacccgtacccgaagggaccgacaaccgtaacttaactaactactaaaccaaatcgactaacgacgacctagagagtacggacgacgacggcgttagtattagtgtgacgagtacgacgtacccgaacggtcgtaccctacgttcggtacgttcgtttagtacgtttcg

SEQ ID NO: 394001 - DNA, 711 bp, Homo sapiens
  misc_feature: GZ8MTXP02GS436.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggtcttaattttaaaaggtgtccagtgtgaggtgcaggtgtcggagtcgtgggggaggtcgttggttcgacgggtcccgggggtccctggacgacctctcctgtgcagtctcgtaggtacttaaccttagtgactatcgccatgactccgtcgggtcccgccgacggtccgtaccggaaggggaaacggtcgtagggaggtcgggtcctacgacgtactaaagttaaggtagggtaggggtactacgttccaaacctaagttaacgttaccgcgtaacggtaccggttccgggggtcgggggttccccgtaccaaccgtacgtacccaaccgaagaacgaaacctaaccgacccgaaagggacaaccaacctaactactaactaacctaaacaaagtcgacaactaccgacgtagaacggacgtaccggaacggacgtaccgggtaccgttagttaacgtttcgtaggtacgagtaacggacgtaccgtacccgtaacggtaaccgtaccgtacgttcggtatttaccgtttgtactttcgg

SEQ ID NO: 394002 - DNA, 572 bp, Homo sapiens
  misc_feature: GZ8MTXP02I6IAS.38.28.C06.1.454.CMB.2.raw
  modified_base (359)..(359): a, c, t, g, unknown or other
tcagtcgatcacgtcacgaccggtgctcgatttagagctcacgtattgggtttgggggaagaggaagactgacggtcctgccacaggtggtgctgggcacggtgggcactcgacacaacatttgcgctcaactgtcttgtccaccttgctgagcgtgcgttttctagtggctattttaaaaggtgtccagtgtgaggtgcaggtgtcggagtctgggggaggcttggttcagcctggggggtccctgagactctcctgtgctagtctctggattaaccttagtgactatgccatggatcgtggtccgccaggctcgagggagggctggagtgggtctcagcaaattagtggtaggggtnatacactatagtcgcacgtacgtcgggtcgggggtccgtacacactcaccgagaacgaccaactcgagacacactactatatactaacaatcgacacacgacgtagagacggacggacggacgacggtcgtacgttagttagttacgtacggacgtacgacgtacgtaccgtaaccgtacgtaccgtaccgtcggtcgttacgtttacgttcg

SEQ ID NO: 394003 - DNA, 642 bp, Homo sapiens
  misc_feature: GZ8MTXP02INGEH.38.28.C06.1.454.CMB.2.raw
  modified_base (291)..(291): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtgtcttttctggtggcttaagtttaaaggtgtccagtgtgaggtgcgaggtgtcggagtcgtgggggagtcttgggttcacgggtccccgggggtcctggacgacctctccctgtgcagtctcgtgattaacttgngactatgccatgatcgtcggtcccacgacggtcctaccggaggggaagggctggggagtcgggtctcgagacgtaattaagtggttaggggtatacttcgacctattacttacgctaacggtacgtccggggtaccgggggtccgttacgaacctacgtaccaacgaacgacgaaccaacgtacccgagacgacaacaacctatactactaacaaactcgacacgacgaccgtgagacggtcgaacggacgacgtccgttagttaattagtggtcgaacggagacgtaccgtaccgaacgggtaaccgtaaccgttccgttacgggttgtttccgtttagtacgttttcgg

SEQ ID NO: 394004 - DNA, 639 bp, Homo sapiens
  misc_feature: GZ8MTXP02HTLV3.38.28.C06.1.454.CMB.2.raw
  modified_base (216)..(216): a, c, t, g, unknown or other
  modified_base (271)..(271): a, c, t, g, unknown or other
  modified_base (288)..(288): a, c, t, g, unknown or other
  modified_base (315)..(315): a, c, t, g, unknown or other
  modified_base (324)..(324): a, c, t, g, unknown or other
  modified_base (340)..(340): a, c, t, g, unknown or other
  modified_base (343)..(343): a, c, t, g, unknown or other
  modified_base (369)..(369): a, c, t, g, unknown or other
  modified_base (530)..(530): a, c, t, g, unknown or other
  modified_base (540)..(540): a, c, t, g, unknown or other
  modified_base (599)..(599): a, c, t, g, unknown or other
  modified_base (619)..(619): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatcgtgggtccncaggctcgaggggaagggctggagtgggtctcagctaaattagtgggtaggggtnattcacctatattacgnagaccgtcggtgggggccttacaccancaaccaganacaactccgaaggacncanactatactactaacaaatcgacaacngcctaggacggacgtcgacgggaacgaccggtccgttaggttatttagtttggacggacgtagaacgtactaccccgaaggtaccgaccctccgtttaggtcgttccttttagtactttgtggtacggacgtaaacgggtataagtcggtaactcccgttntccttcgacncccgtaccgaaccgaacggtcccagtcccgttccgttcccccgtcggccctaccccgtnaaccccggtacaacggtccnccgtacccaccggagaaccg

SEQ ID NO: 394005 - DNA, 552 bp, Homo sapiens
  misc_feature: GZ8MTXP02FF6DU.38.28.C06.1.454.CMB.2.raw
  modified_base (282)..(282): a, c, t, g, unknown or other
  modified_base (306)..(306): a, c, t, g, unknown or other
  modified_base (371)..(371): a, c, t, g, unknown or other
  modified_base (413)..(413): a, c, t, g, unknown or other
  modified_base (426)..(426): a, c, t, g, unknown or other
  modified_base (452)..(452): a, c, t, g, unknown or other
  modified_base (454)..(454): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtcgtgggggagcttggttcaggcccggggggtcctgagactctcctgtgcagtctctggattaacctttagngactatgccatgatctggggtccnccaggcctccgaggggaagggctgggagtggggctcgagacaagtttaagtggggtaaggggttntactcactatacttacgcagcgtcggggtcgggggcctcacnacacagacacacncgagcacacatatactactaacaaananacacacgacgagagagacggacgacgacggcgtagtagttagtgtcgacgacgacgacgaccgacgtaacgacgtacgtcgttcgtcttcgtacttcg

SEQ ID NO: 394006 - DNA, 617 bp, Homo sapiens
  misc_feature: GZ8MTXP02FT6JA.38.28.C06.1.454.CMB.2.raw
  modified_base (336)..(336): a, c, t, g, unknown or other
  modified_base (462)..(462): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctggggggtccctgagactctcctgtgcagtctctggattaacctttagtgactatgccatgatctgggtccgccaggctccgaggggaaggggctgggagtgggtctcagcaattaagtgggtaggggtgattcacatattacgcagacgtccggtgggggccgttcaccatcaccagacgacaactcaggancacactatatctaacaaatgaccacacgcctagagagtcgaggaccacggtccgtagtatttagtgtgacgagagactacccgaacggtcgacctaccgttgggtcgttctttttagacttttcgnggtacggaccgaaaggggactaagttggtccaccgttcttcttcacgaccctcccaaccgaacgggcccctagttcccggtcccttccccccggtggcccgtccccgttgcccgtaccgaacggacgacccgtaacccgtaccggaacggaaccg

SEQ ID NO: 394007 - DNA, 645 bp, Homo sapiens
  misc_feature: GZ8MTXP02FJKOA.38.28.C06.1.454.CMB.2.raw
  modified_base (202)..(202): a, c, t, g, unknown or other
  modified_base (248)..(248): a, c, t, g, unknown or other
  modified_base (260)..(260): a, c, t, g, unknown or other
tcagtcgatcacgtcacgaccggtgctcgatttagagctcacgtattgggtttgggggaggcttggttcagcctgggggggtccctgagactctcctgtgcagtctctggattaacctttagtgactatgccatgatctgggtccgccaggctccaggggaaggggctgggagtgggtctcagcaattaatgggtaggggtnattcacatatacgcagactccggtgggggccgttcacatcacaganacaactcaggancacactatatctaacaaatgcacagcctagagagtcgagacacgggccgtagtattatgtgcgagagactacccgaaggtcaccctaccgttgggtacgttctttttagactttttcgtggttcgggaccgaaagggggaactaaaggttcgggtaccctaccggttcttccttcacgtcccctacccgaaccgaaccggggccctacgtcccggttcccttcccccgtggccccgtcccgtcgcccgtaccgacggacgcccaccgtccgacgacgcacgacggccggaccgtcgggctcggcgtcggtacgaacggtaccttaccgttaccgacggttacgaacgtccggtacgtcgggacgggccgggtacggcggaaacgg

SEQ ID NO: 394008 - DNA, 662 bp, Homo sapiens
  misc_feature: GZ8MTXP02GLM28.38.28.C06.1.454.CMB.2.raw
  modified_base (459)..(459): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccgccaggctccgaggggaaggggctgggagtgggtctcagacaattaagtgggtaggggtgattcaccatattacgcagactccggtgggggccgttcaccatcaccagagacaactccaggagcacactatatctaacaaatcgaccacagcctagagagtcgaggacacggtccgtgtattatgtgcgagagactacccgaacggtcgaaccctaccgttggtcgttcttttagtacttttcgnggttcgggtaccgaaaggggactaaaggttcgggtaccctaccggttccttcgttaccgacggtacccctacccgaaccgaaacgggtcccccgtagttcccgggtttccccttcccccggcgggtcccccgtaccccggttcgccccgttaccccggaacggggaacccgtccccgaacccgttcccgggaaacgtacccgg

SEQ ID NO: 394009 - DNA, 573 bp, Homo sapiens
  misc_feature: GZ8MTXP02JKZIO.38.28.C06.1.454.CMB.2.raw
  modified_base (272)..(272): a, c, t, g, unknown or other
  modified_base (286)..(286): a, c, t, g, unknown or other
  modified_base (314)..(314): a, c, t, g, unknown or other
  modified_base (462)..(462): a, c, t, g, unknown or other
  modified_base (536)..(536): a, c, t, g, unknown or other
  modified_base (542)..(542): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaagggctggaggtgggtctcgagctaattagtgggtaggggtnattcacatatacgnagctcggtggggccgtcacatcacaganacactcgaggcgcacactatatactaacaaatcgaccacagcctaggagacggtcgagggaccacgggccgttagtaatttgttggtggacgagaacgtactaccccgaaaggtcgaccctaccgttggttcgttctttgactttcgngttcggaccaagggactaagtcgactcgtctcttcacgcctacgaccgaacggcccagtccggtccttccccgnggcccnccctgcctcgacgacgtcaccgtcgacgccg

SEQ ID NO: 394010 - DNA, 551 bp, Homo sapiens
  misc_feature: GZ8MTXP02FF2NF.38.28.C06.1.454.CMB.2.raw
  modified_base (213)..(213): a, c, t, g, unknown or other
  modified_base (291)..(291): a, c, t, g, unknown or other
  modified_base (334)..(334): a, c, t, g, unknown or other
  modified_base (363)..(363): a, c, t, g, unknown or other
  modified_base (393)..(393): a, c, t, g, unknown or other
  modified_base (398)..(398): a, c, t, g, unknown or other
  modified_base (517)..(517): a, c, t, g, unknown or other
  modified_base (541)..(542): a, c, t, g, unknown or other
  modified_base (544)..(551): a, c, t, g, unknown or other
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggtctttttctgtggcttaattttaaaagactccggtgggggccgttcaccatcaccaganacaactccaggagcacactatatctaacaaatgcaacagcctgagagtcgaaggacacggccgtgtattatgtgcganagactcccaaaggtcgaaccaccttggtgcttttgattttcgngtcggccaagggacaagtgtcacgctctnagcctcaccagggcccatcggtctcccccnggccnccctgcctcgaggcgcacctcgacgcgacacgagaccggcccgtgggcctcgcccgtgggttaccaaagggtacctacccttaccgacgtcgactccgaacgtgaacggccggggtacngggaccaaagggccacgtaagagnngnnnnnnnn

SEQ ID NO: 394011 - DNA, 655 bp, Homo sapiens
  misc_feature: GZ8MTXP02H5PSB.38.28.C06.1.454.CMB.2.raw
  modified_base (311)..(311): a, c, t, g, unknown or other
tcagtcgatcacgtcacgaccggtgctcgatttagagctcacgtattgggtttggggagctctgagagaggagcccagccctgggatttttcaggcgttttcatttggtgatcaggactgaacagagagaactcaccatggagtttgggctgagctggtctttttcttgtggtcttaatttttaaaaggtgtccagttggtgaggtgcagggtgtcggagtcgtgggggagtcgttggttcgacgggcccgggggtatcccgtagacgtaccttctccgtgtgcagttctcgtaggtactttaacttagtnactatcgacctatgactcgtcgggtcccgaccgacggcctaccggaagggggacggggtcgtaggggtagggtcgggtctagaacgtacgtaaagttaaggtcggggtagggtatacttcactagttacttcgacaggtaccgtccggggtacggggtcccgttacaccgactccacgagacaacactacgaggacacaactataatctaactaaagaagtcacaacgtcgactggaagtacggtacgaacggacgtaccggtcgttagttaacgtttagtcgaggacgtacgacgttaccgaccgtaacggtcaaccgttcgtttggtctttcgtttacgtcg

SEQ ID NO: 394012 - DNA, 676 bp, Homo sapiens
  misc_feature: GZ8MTXP02JYW6B.38.28.C06.1.454.CMB.2.raw
  modified_base (294)..(294): a, c, t, g, unknown or other
  modified_base (389)..(389): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttctgtggctaattttaaaaggtgtccagtgtgaggtgcaggtgtcggagtcgtgggggaggtcgttggttcgacggccccgggggtcctggacgactctcctgtgcagtctcgtggtactttaaccttagngactatgccatgatcgtcggtccgccgaggccgtccggaaggggacggggcgtgggacggtgggtctacgagactaaagtaggtgggtaggggtntagtcactatactacgcgacgtaccggtccggggtcgggggtcccgttaccaccgtactacccgaaccgaaggaacgaacctaaaccgtacccgaaggacgaccaacctacttaactacttaacgtaaacaaacgtcgaccaacacggtacctaaggacggtaacggacggaacggaccgtaccgggtccgttagtttactttagttggacgtacggagacgtacccgtaacccgaacgggtccgtacccgtacgtttcggtcgtttcgttttacgtacttttcggg

SEQ ID NO: 394013 - DNA, 629 bp, Homo sapiens
  misc_feature: GZ8MTXP02F16M1.38.28.C06.1.454.CMB.2.raw
  modified_base (184)..(184): a, c, t, g, unknown or other
  modified_base (312)..(312): a, c, t, g, unknown or other
  modified_base (344)..(344): a, c, t, g, unknown or other
  modified_base (373)..(373): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctaattttaaaggngtccagtgtgaggtgcgaggtgtcggagtcgtgggggagcgtttggttcgaggcccgggggtcctgagactctcctgtgcagtctcgtggtactttaaccttgtgactatcgccatgatcgtggtccncgagcacggagggaagggctgggagtgggtcncgaagactaaagttaggtggggtagggtntacttcgacctaagttacttaacgcgtaacgaccgttccgggggtcgggggtcccgttacgaacctactacgaacccgagaacgaaccaaacgtccgaggactacaacctaataactacttaaccaaaacaaagtacgacacacgacgtacgacgacggacgaacggacgacgaccgtagtacgttagttagtacgagagacgacgtaccgacgaacgtaccgtaccgttacgtacgttcgtttcgttacgtttcg

SEQ ID NO: 394014 - DNA, 692 bp, Homo sapiens
  misc_feature: GZ8MTXP02IR7DP.38.28.C06.1.454.CMB.2.raw
  modified_base (279)..(279): a, c, t, g, unknown or other
  modified_base (354)..(354): a, c, t, g, unknown or other
tcagtcgatcacgtcacgaccggtgctcgatttagagctcacgtattgggtttgggctgagctggcttttttcttgtggctattttaaaaggtgtccagtgtgaggtgcaggtgtcggagtctgggggaggcttggttcagcctggggggtccctgagactctcctgtgcagtctctggtattaacctttagtgactatgccatgatcgtgggtccgccaggctccgaggggaaggggctgggaggtgggtctcgagactaattaagtgggtaggggtnattcactatattacgcagacgtccgggtcgggggtccgttcaaccatcaccgagaacgacaaccgtccgaggacnccaacacttatactactaacaaatcgaccaacgacgccagggaacgacggtcgaggggacccaaccggggtccgttagtttagtatttgggcggtacggaagacggtacctaccccgggaaacgggtcgaaccccttaacccgggtttgggttacgtttcgttttagtacgttttcgtacgggttccgggaaccgtaaaggggactaaggttccgggtacctaccggttcttaccttcgacgtacccctaccgaccggtaacggccctacgttcccgtccctccccgtcggacccctccgttcgccgtccggaacgcgacccgtaccgtcggaacgcg

SEQ ID NO: 394015 - DNA, 793 bp, Homo sapiens
  misc_feature: GZ8MTXP02G5TEF.38.28.C06.1.454.CMB.2.raw
  modified_base (297)..(297): a, c, t, g, unknown or other
  modified_base (322)..(322): a, c, t, g, unknown or other
  modified_base (373)..(373): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactctcttgtccaccttgctgagctggctttttcttgtggctattttaaaaggtgtccagtgtgaggtgcaggtgtcggagtcgtggggggaggtcgttggttcaggtcccggtgggggggtccctgacgactctccgtgtgcagtctcgtggtattacctttagngactatgccatgatcgtgggtcccncgaggctccggaggggaagggcgtggaggtggtctcagtactaaagttagnggggtaggggtatacttacgacctaattacgttacggacgtacggtaaccggttcccggggggttccgggggggtacccgtttacccggaaccctaaaccgttcccgaaaacccgtaagggaaccggaaacccgtaaaacccgtacccggaagggggaaacgacccaaaccgtaaaccttaacggttaaaactaacccgttaaaactaaacgtccggaaaccaaccgaacggacccgttagggaacggttaacggacggggaaacggaacccggaacgggggtacccggttaagttaacgtttaggttacgggttaccggaagggttaaacggaacgtacccgtaaaccccgggtaaaaccggggttcaaaccccgttaaccggtttgggttaaccgttttcggttttacgtttaaacgg

SEQ ID NO: 394016 - DNA, 553 bp, Homo sapiens
  misc_feature: GZ8MTXP02I0WEC.38.28.C06.1.454.CMB.2.raw
  modified_base (216)..(216): a, c, t, g, unknown or other
  modified_base (329)..(329): a, c, t, g, unknown or other
  modified_base (423)..(423): a, c, t, g, unknown or other
  modified_base (428)..(428): a, c, t, g, unknown or other
  modified_base (434)..(434): a, c, t, g, unknown or other
tcagtcgatcacgtcacgaccggtgctcgatttagagctcacgtattggggtttggggagagctctggagaagagctgctcagttaggacccagagggaaccatggaaaccccagcgcagcttctcttcctcctgctactctggctcccagattccaccggagagattgtgttgacgcagtctccaggcaccctgtctttgtctccgaggggaaangccaccctctcctgcagggccagtcagagttgtttcaacggtctacttagcctggtaccagacaaaaacctggaccaggcctcccaggcctcctcatctatggtacatccgtnacgggccactggtactccaagacgtaggtcagtgctagtcgggtctggggacaggacttcactctacaccatcagcagactggagctagaagtntttgntaggtntatactgtacagcatatactaacaaggtacctaactacgtttcggaccgaggggaacccagaccgtaggacgaaaaccaaacgaactaaggtcgacgtacgaccaactactacgtttcg

SEQ ID NO: 394017 - DNA, 703 bp, Homo sapiens
  misc_feature: GZ8MTXP02G2FFD.38.28.C06.1.454.CMB.2.raw
  modified_base (271)..(271): a, c, t, g, unknown or other
  modified_base (284)..(284): a, c, t, g, unknown or other
  modified_base (305)..(305): a, c, t, g, unknown or other
  modified_base (313)..(313): a, c, t, g, unknown or other
  modified_base (326)..(326): a, c, t, g, unknown or other
  modified_base (649)..(649): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatcgtgggtccgccaggctccgaggggaagggctggagtgggtctcagctaattagtgggtagggtnatcacatatacgnagactcggtggggcctcaccntcacaganacactcgaggacncacactatatactaacaaagtgacccacagtcctagaggacgtacgggacggtaccgaacgggtccgttagttaactttaggttggtacggacgaagtaacgtaacgtaaccccgtaaacgggttaccgacccgttaccgtttgggttacgttaccgtttttagtacgttttccgtagggttacgggaacccgtaaaggggtaacctaaaggttccgggtaccgtaccgttccttccgttaccgacgtacccctaacccgaaacccgtaaccggggtacccctacgttaccccgggttcccctacccccgtcggggtcccccncccgttacgaacccgtacccggaggacccaccgtacccgaccggaacgacccgg

SEQ ID NO: 394018 - DNA, 572 bp, Homo sapiens
  misc_feature: GZ8MTXP02I05OT.38.28.C06.1.454.CMB.2.raw
  modified_base (309)..(309): a, c, t, g, unknown or other
  modified_base (368)..(368): a, c, t, g, unknown or other
  modified_base (419)..(419): a, c, t, g, unknown or other
  modified_base (429)..(429): a, c, t, g, unknown or other
  modified_base (434)..(434): a, c, t, g, unknown or other
  modified_base (438)..(438): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggctttttctgtggctattttaaaaggtgtccagtgtgaggtgcaggtgtcggagtcgtggggggagcttggttcagccgtggggggtccctgagctctcctgtgcagtctctggtattaaccttagtgactatgaccatgatcgtgggtccnccgaggcctccgaggggaggggctgggagtgggtctcagcaaattagtgggtaggggtnattcacattactcgcacgaccgtccgggtgggggtccgtcacatcacaganacactcgagngacanactntatctaaacaaatgaccacgacgaccgtaggagacgtacggagacgacggtccgtagttactttagtgtaggtaccgagacgaccgtacccgaaggtccgtaacctaccgttggttcgttcgttttagtttacg

SEQ ID NO: 394019 - DNA, 643 bp, Homo sapiens
  misc_feature: GZ8MTXP02FLYO7.38.28.C06.1.454.CMB.2.raw
  modified_base (279)..(279): a, c, t, g, unknown or other
  modified_base (294)..(294): a, c, t, g, unknown or other
  modified_base (303)..(303): a, c, t, g, unknown or other
  modified_base (314)..(314): a, c, t, g, unknown or other
  modified_base (319)..(319): a, c, t, g, unknown or other
  modified_base (327)..(327): a, c, t, g, unknown or other
  modified_base (332)..(332): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtggggggaggcttggttcagccgtggggggtccctgagactctcctgtgcagtctctggtaatttaacctttagtgactatgccatgatcgtgggtccgcaggcctccgaggggagggctggaggtgggtctcagactaaattagtgggtaggggtntatcactatatacgnagcgtcggnggggcctcacntcacngacacacncgagncaactactatactactaacaaatcgaccccaacgtacgccgtaggaacgtaacggacgggacggaccgacgggtccgttagttattagtggtagacgaagtacgacctaacccggaacggtcgtaacccgtcgttggttcgtttacgtttgtactttacggtcgggtacgaccggtaaaaggtactaaggtccgtaccctcgtctacgtcacgtcccactaccggaccggtccctagtcccggttcccctcccggtcggtcctccccgtgaaccccgtacggacgtaccgccctaccgaccggaagtcccg

SEQ ID NO: 394020 - DNA, 579 bp, Homo sapiens
  misc_feature: GZ8MTXP02F0M0U.38.28.C06.1.454.CMB.2.raw
  modified_base (278)..(278): a, c, t, g, unknown or other
  modified_base (347)..(347): a, c, t, g, unknown or other
  modified_base (409)..(409): a, c, t, g, unknown or other
  modified_base (467)..(467): a, c, t, g, unknown or other
  modified_base (474)..(474): a, c, t, g, unknown or other
  modified_base (512)..(512): a, c, t, g, unknown or other
  modified_base (566)..(566): a, c, t, g, unknown or other
tcagtcgatcacgtcacgaccggtgctcgatttagagctcacgtattgggtttgggcctgagctggctttttcttgtggctattttaaaaggtggtccagtgtgaggtgcaggtgtcggagtctgggggaggcttggttcagcctgggggggtcccctgagactctcctgtgcagtctctggattaacctttagtgactatgccatgatcgtgggtccgccaggctaccgaggggaaggggctgggagtgggtctcgagctaatagtgggtaggggtnattcaccatattacgcaggacctcggtgggggccgttcgaccatccaccagacgaacactccgaggacncgactactatactcctaaacaaactgaccacacgacctgagtagtcgagggacacggccgtntaactttagtgtgcgagagactaccccgaaggtcgaccctacgttggtactctttagntttcggngttcgaccgaaggactaagtcggccacgtctcgttacncgtcctacgacgacgcctcgtcccgtccctccgcgccgcgtcgctccgacgccnctaccgtcgagcg

SEQ ID NO: 394021 - DNA, 852 bp, Homo sapiens
  misc_feature: GZ8MTXP02G8HYN.38.28.C06.1.454.CMB.2.raw
  modified_base (311)..(311): a, c, t, g, unknown or other
  modified_base (346)..(346): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggctttttcttgtggctattttaaaaggtgtccagtgtgaggtgcaggtgtcggagtcgtgggggagcttggttcagccgtgggggtccctgagactctcctgtgcagtctctggtattaaccttagtagactatgccatgatcgtcgggtcccnccgacggctaccggaaggggaacggggcgtagggngggtggtctacgagtactaaagttaagtggggtaggggtactacgtttacaacctaagttaacgttaccggaccaacgggtacccgttcccgggggttacgggggggtaccccgtttacccgaaacccgtaaccgttaccgaaaccccgtaaaggaaccgaaacccaaaaccccgttacccggaaacggggtaacgaccccgtaaaaccgtaaacttaaacgttaaacccgttaaccttaaaaaccgaaaacggtttacgaaacccgtaaaccgaaaccggtacccgttaagggaaacggtaacgggtaaccgggaaacggggaaacccggtaccgggtacccgggtttaatttaaaaccgttttggtttacggggtacggtaacccgggtaaaggaaccggtaaacccggttaacccccgtaaaaaccggggttccggtaaaacccccgtttaaccgggttttaacgggtttaccgtttcccggtttttttaaggtttaacccgg

SEQ ID NO: 394022 - DNA, 595 bp, Homo sapiens
  misc_feature: GZ8MTXP02IZ5HS.38.28.C06.1.454.CMB.2.raw
  modified_base (303)..(303): a, c, t, g, unknown or other
  modified_base (358)..(358): a, c, t, g, unknown or other
  modified_base (405)..(405): a, c, t, g, unknown or other
  modified_base (427)..(427): a, c, t, g, unknown or other
  modified_base (449)..(449): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttcaggcccgggggtcctgagactctcctgtgcagtctctggattaaccttgtgactatgccatgatctggtccnccaggctccgagggaggctggagtgggtctcgaggcaagttagtgggtaggggtntagttcaaccgtataattcgctagacgttccggtgggggccttcacntcacagacgacacctcaggacncacactatactactaaactaancgactaacacgggtaccctggaacgtaggtacccggaagggaccgtaacggcccgttaggtactttaagtggtgacgaggacgtacgttaccccgaaacggggttcaaacccgtccgtttagggctttcgtttagtacttttccgg

SEQ ID NO: 394023 - DNA, 709 bp, Homo sapiens
  misc_feature: GZ8MTXP02GN17K.38.28.C06.1.454.CMB.2.raw
  modified_base (263)..(263): a, c, t, g, unknown or other
tcagtcgatcacgtcacgaccggtgctcgatttagagctcacgtattgggtttgggggaggcttggttcagcctggggggtccctgagactctcctgtgcagtctctggattaacctttagtgactatgccatgatctgggtccgccaggctccaggggaaggggctggagtgggtctcgagcaattaagtggtaggggtgattcaccatattacgcagactcggtgggggccgttcaccatcaccagagacaactccaggancacactatatcgtaacaaatgcacagcctgagacgtcgaggacacggtccgtagtacttatgtgcgagagactacccgaaacggtcaaccgtaccttggggtctccgtttttagacgtttctcggttcggacccggtaaagggtaactaaacgttcggttaccctaaccccggtttctttaccctttccgaacccgtacccttacccgaaacccgtaaccggggtaccccctacggtaccccggtttccctaccccccggtggccccgtcccctcggaccccttcgaccgggaacgccccgaacccgtccggaacgaacgaccgacgacggtaccgtccccgggtgggcctcggtacccgtaggtaaccgaaacggtaaccgttcccgtaccgtaaccggtcgtaacgtcgtaacggtcgaccggacggggccgttacggaaccgg

SEQ ID NO: 394024 - DNA, 532 bp, Homo sapiens
  misc_feature: GZ8MTXP02FG1SK.38.28.C06.1.454.CMB.2.raw
  modified_base (406)..(406): a, c, t, g, unknown or other
  modified_base (411)..(411): a, c, t, g, unknown or other
  modified_base (453)..(453): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtcgtgggggaggcttggttcagcccgggggtcctgagactctcctgtgcagtctcgtggattaaccttagtgactatgccatgatctggtccgcagctccgaggggaaggggctgggagtggggtctcgagcaattaagtggtaggggtgatcaccatatacgcagactcggtgggggccgttcaccatcacaganacacncagagcaacactatatactaacaaatgacacacgcctgaagngtaacgaggacacggccgtgtattatgtgcgagacgacaccaacggtcgaccctaaccgttggtctctttgtactttcg

SEQ ID NO: 394025 - DNA, 776 bp, Homo sapiens
  misc_feature: GZ8MTXP02GEVP7.38.28.C06.1.454.CMB.2.raw
  modified_base (310)..(310): a, c, t, g, unknown or other
  modified_base (753)..(753): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcgaggtgtcggagtcggtgggggaggtcgtttggttcgacgggccccggggggttccctggacgtactccgtccgtgtgcagtctcgtaggtactttaaccgtttagngtactatcgacctaagtgacgtcgtcgggtccccgacgacggtccgtaccggaaggggaacggggtcgtaggggtacggttcgggtcctacgtaacggacgttaaaagttaggttagggggttaaggggttactaacgtttaccaaccgtaagttaacgttaccggcgtaacggtaccggttcccgggggtcggggggtacccgttaccgaaccgtacgtacccgaccgtaaaggacgaaaacccgtaaccgtcccgaaacgggcaccctaaaccttagtataacctttaacaaacgaaacgtcgaccaaacgtcggacccttaaggaacgtcggtaccgggaaacgtaccggtacccgggtgtttaaggttaaacctttgttcggacgaaccggagttaccgaccgtacccgaaggttaaccgtacccgtcgtttaccggtnttttacgtttgagtttttcccgg

SEQ ID NO: 394026 - DNA, 656 bp, Homo sapiens
  misc_feature: GZ8MTXP02GY8M4.38.28.C06.1.454.CMB.2.raw
  modified_base (215)..(215): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggccaccctgtctttgtctccgaggggaangccaccctctcctgcgagggccagtcaggagtgttttcaacggtctacttagcctggtaccagacaaaaccgtggaccacggcctcccgaggcctcctcatctatcggtacacgtcccgtagacgggcccacgtcggtactcccgaagacgtacggttcaggtcggactaggtgggttcgtggggacaggtacttccactctcaccatcagacacgacgtgggacgcgtaggtaagtattttcgacgtaaggttagttaactttacgtagtacgtacgacgtaagttaactacctaaacgtaacgtacccggttaattaccgtttacgggacccggtaacggggaacccaagggtaccgttaacgggaaaccgaaaaccggtaaacggtaaccgttgggtacggaaccttacggaaccctaccgtaacgttaccgtttccg

SEQ ID NO: 394027 - DNA, 628 bp, Homo sapiens
  misc_feature: GZ8MTXP02IC8R5.38.28.C06.1.454.CMB.2.raw
  modified_base (291)..(291): a, c, t, g, unknown or other
  modified_base (298)..(298): a, c, t, g, unknown or other
  modified_base (320)..(320): a, c, t, g, unknown or other
  modified_base (408)..(408): a, c, t, g, unknown or other
tcagtcgatcacgtcacgaccggtgctcgatttagagctcacgtattgggtttggggagttctgagagaggagcccagccctgggattttcaggcgttttcatttggtgatcaggactgaacagagagaactcaccatggagtttgggctgagcgtgtcgttttctaggtggctattttaaaggtgtcagtgtgaggtgcaggtgtcggagtcgtgggggagcttggttcaggtcccggggggtccctgacgactctccgtgtagcagtctcgtggattaaacccttttgngacttancgcagtgactcgtcggccgcgngtccgtacggaggggtacgggcgtggtaggtcggtctacgagtactaaagttaggtgggtaggtctacttaccactattacgtacgcncggtaccggttccggggtcgggggtcccttacaccgtactaccgacgacgaactaccaccgtaccgacgacgactaactaacttatactaactaaacaaagtacgacacgtacgtacgtacgagacgtacgacgacgaccgtacgtagttagttagttgtgacgagacgacgtaccgacgtacgtaaccgtcgtcgttcgttcgtttcgttcgttcgtcg

SEQ ID NO: 394028 - DNA, 539 bp, Homo sapiens
  misc_feature: GZ8MTXP02HUA3Q.38.28.C06.1.454.CMB.2.raw
  modified_base (210)..(210): a, c, t, g, unknown or other
  modified_base (219)..(219): a, c, t, g, unknown or other
  modified_base (299)..(299): a, c, t, g, unknown or other
  modified_base (306)..(306): a, c, t, g, unknown or other
  modified_base (315)..(315): a, c, t, g, unknown or other
  modified_base (364)..(364): a, c, t, g, unknown or other
  modified_base (370)..(370): a, c, t, g, unknown or other
  modified_base (375)..(375): a, c, t, g, unknown or other
  modified_base (380)..(380): a, c, t, g, unknown or other
  modified_base (425)..(425): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcacctgtctttgctcagggaaangccaccctntcctgcagggccagtcagagttgtttcaacggtctacttagcctggtaccagacaaaaacctggaccaggctccagctcncatctangtacatctnaggcatgatccagacagtcagtgcagtggctggggacagcttacactcncaccancaganagagngagactagtaatagttagtagtagtagttattagttagtagaganaagtaataactaacaacgtaacgtacgtacgttacgtacggacggaacgaacgtacgtaacgaacgaaaccgaaacgtaacgtaacgtacgtacgtacgacactaactacgtcg

SEQ ID NO: 394029 - DNA, 864 bp, Homo sapiens
  misc_feature: GZ8MTXP02GUEE5.38.28.C06.1.454.CMB.2.raw
  modified_base (297)..(297): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggtcttaattttaaaaggtgtccagtgtgaggtgcaggtgtcggagtcgtgggggaggtcgttggttcgacgggccccgggggtccctgacgactctccgtgtgcagtctcgtggtacttaaccttgngtactatgccatgattcgtcgggtccgaccgagggtccgtaccggaagggggaacggggtcgtaggggtagggttcggggtcctacgaacggtaccttaaaagtttaagggttagggggttaacggggggttataacgtttacccgtaaaacccgttagtttaaacgtttaaccgggccgtaaccggtaacccgggttcccccggggggttacgggggggtacccccgtttaccgaaacccgtacgttaacccgaaccgaaacggaaacgaaacccgaaacccgttacccgaaggggaaccacccgaaactaaacccttaattaaacgttaacccctaaaataaaacgttcggaaaccacctaaccggtacccgtaggaaacggttacggtaaccgggaacgggaacccggtacccggggttacccggttaagggtttaacttttaacgggtttggtacgggaccgtaaaggttaaccggaacccttaacccggggtaaccggtaacgtaccccgttaaccggttttgggttaccggtttaccttttaaggtttacgttttcccggg

SEQ ID NO: 394030 - DNA, 543 bp, Homo sapiens
  misc_feature: GZ8MTXP02I2KZX.38.28.C06.1.454.CMB.2.raw
  modified_base (350)..(350): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggcttttctgtggctatttaaaaggtgtccagtgtgaggtgcaggtgtcggagtctgggggagcttggttcagcccgggggtcctgagactctcctgtgcagtctctggattaaccttagtgactatgccatgatctggtccgcaggctccgagggaagggctggagtgggtctcagcaataagtggtaggggtnattcaccatattacgcagactccggtgggggccgttcaccgatcaccagagacaactccgaggacgcacactatatactaacaaatgacacagccctgaagagtcgaaggccaacggcgtgtattagttgtcgacgagacgaacgtccccgaaaggtcgaccctaaccgtttggcgtccgttttgaattttcg

SEQ ID NO: 394031 - DNA, 528 bp, Homo sapiens
  misc_feature: GZ8MTXP02FRM3F.38.28.C06.1.454.CMB.2.raw
  modified_base (213)..(213): a, c, t, g, unknown or other
  modified_base (267)..(267): a, c, t, g, unknown or other
  modified_base (315)..(315): a, c, t, g, unknown or other
  modified_base (344)..(344): a, c, t, g, unknown or other
  modified_base (463)..(463): a, c, t, g, unknown or other
  modified_base (499)..(499): a, c, t, g, unknown or other
  modified_base (518)..(518): a, c, t, g, unknown or other
  modified_base (523)..(523): a, c, t, g, unknown or other
  modified_base (526)..(526): a, c, t, g, unknown or other
tcagtcgatcacgtcacgaccggtgctcgatttagagctcacgtattgggttgggctgagctggctttttcttgtggctattttaaaaggtgtccagtgtgaggtgcaggtgtcggagtctgggggaggcttggttcagcctggggggtcccctgagactctcctgtgcagtctctggattaacctttagtgactatgccatgatctggtccnccaggctccgagggaggggctggagtgggtctcagcaattaatgggtaggggtnattcaccatattacgcagactccggtgggggccgttcaccgatcaccngagacaactccaggagcacactatatcanaaatgcccacagcctgagagtcgagaccacggcgtagtattatgtgcgagagactcccaaggtcgacccaccgttggtcgtctttgtatttctgtgccaagggacaagtgtccaccgtntacttcagcctcacgacggcccagtcgtcttccccngccgcctgcctcaggaccncaccncgncg

SEQ ID NO: 394032 - DNA, 628 bp, Homo sapiens
  misc_feature: GZ8MTXP02H7W9W.38.28.C06.1.454.CMB.2.raw
  modified_base (217)..(217): a, c, t, g, unknown or other
  modified_base (352)..(352): a, c, t, g, unknown or other
  modified_base (371)..(371): a, c, t, g, unknown or other
  modified_base (414)..(414): a, c, t, g, unknown or other
tcagtcgatcacgtcacgaccggtgctcgatttagagctcacgtattgggtttgggctgagctggcttttttcttgtggatattttaaaaggtgtccagtgtgaggtgcaggtgtcggagtctgggggaggcttggttcagcctggggggtccctgagactctcctgtgcagtctctggatttaacctttagtgactatgccatgatcgtgggtccnccagggctccgaggggaagggctggagtgggtctcagcaaatttaagtgggtaggggtgtattcaccatattacgcagacgtccggtgggggccgttcaccactcaccaagagacaactcgagagcaacatatanctaacaaatcgccaacgcncgtagagtgtacggagtacgacggtcctagtatttagtggtanacgagagacttcccgaacgggactacccgtaccgttggttctgtttttgactttgtagttcggaccgttaaagggaccagtttacgggacctacggttccttactacaccggttccctaccgaaccgaacgggccccctaagttcccggtcccttcccccgcggtcccgtcccctcgccgttccgaaacgcgtaccgacccgtccgaacgccgg

SEQ ID NO: 394033 - DNA, 631 bp, Homo sapiens
  misc_feature: GZ8MTXP02GRRL5.38.28.C06.1.454.CMB.2.raw
  modified_base (281)..(281): a, c, t, g, unknown or other
  modified_base (303)..(303): a, c, t, g, unknown or other
  modified_base (315)..(315): a, c, t, g, unknown or other
  modified_base (336)..(336): a, c, t, g, unknown or other
  modified_base (352)..(352): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggtaatttaacctttagtgactatgccatgatcgtcgggtccgccaggctccgaggggaagggctggagtgggtctcgagactaagttagtggggtaggggtnatcacatatacgcagcgtcggnggggcctcacancacagacgacactccgaggcncacatatatacctaanaaagtcacccacacgtacctaggacggacggtacgggacggaccgtaccgggtcggttagttaagtttagtcgggtaggacgaaacgagtaaccctacccggaacggtcgacccttacggttgggttctttcgtttggtactttcggtggtacggaccgtaagggactagtcggtcctacgttctactccacgtccctaccaccgaacggtccctcgtcccggttcccttccccgcggaccctccctacgccgtacggacgacctccaccgtcgaggcc

SEQ ID NO: 394034 - DNA, 707 bp, Homo sapiens
  misc_feature: GZ8MTXP02GH5CP.38.28.C06.1.454.CMB.2.raw
  modified_base (674)..(674): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggcaccctgtcttgctcgagggaagcgccacctctcctgcagggccagtcagtagttcgttttacgaacggtctacgttacgccttaggtaccaggaacctaaaaaccgtggacccgacggtcctaccccgaacggctcctcatcgtagtcggtacactccgtcgaggggccacgtcggtactcccgaagtacgtacgttccgaggtcggtcgaggttcgggttcgtacggggacaggtaccttaccaccgttcctacgaaccctatacgacgtaccaacggtaacgttggggacgtacgttaaggaaacgttgttttaggcgttaaagggtttattacgtttaacccgtggttacccaagggtaccttaaaggttaactttaaaccgaaccggtaaaacggtaccgttaaacgttacggttttacggggaccgtaacggggaacccgtaaacggcgttaaacggggactaaaaccgaacggttaacgnggttacgcgtacgacccagtcctacgtttaccg

SEQ ID NO: 394035 - DNA, 576 bp, Homo sapiens
  misc_feature: GZ8MTXP02FGRYT.38.28.C06.1.454.CMB.2.raw
  modified_base (370)..(370): a, c, t, g, unknown or other
  modified_base (421)..(421): a, c, t, g, unknown or other
  modified_base (517)..(517): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggttgagctggctttttcttgtggtctattttaaaaggtgtccagtgtgaggtgcaggtgtcggagtcgtgggggaggcttgggttcaggcccggggggttccctgagactctcctgtgcagtctctggatttaaccttagtgactatcgccatgatctgggtccgccaggctcgaggggagggctggagtgggtctcgagactaaattaagtgggtaggggtnattcacatatacgcagaccgtcggtgggggaccgttcaacagtcaacaganaacaactccaggagactacaactatatactaaacaaatcgacacacggacctaggaacgaggtccggaaggaccgaacggccgtagtattagttgngtcgagagacgtacccgaggtcgaaccctaccgttggcttacgttttgactttctaggg

SEQ ID NO: 394036 - DNA, 626 bp, Homo sapiens
  misc_feature: GZ8MTXP02F3XGH.38.28.C06.1.454.CMB.2.raw
  modified_base (304)..(304): a, c, t, g, unknown or other
  modified_base (377)..(377): a, c, t, g, unknown or other
tcagtcgatcacgtcacgaccggtgctcgattagagctcacgtattgggtttgggagagctctggagaagagctgctcagttaggacccagagggaaccatggaaccccagcgcagctctcttcctcctgctactctggctccccagattccaccggagagattgtgttgacgcagtctccaggcaccctgtctttgtctccagggaaacgagccaccctcctcctgccagggccagtcagagtgttttcaacggctacttagcctggtaccagcaaaacctggccaggctcccaggctcctcntctatggtacatccgtcacgggccactggtactcccagacaggttcagtcgcaggtggctggacagcttaccnctcacaccatcgacgcagacgtggacgcgtaagtaagttacgtttcgactaggttacgttacttacgttcgtaccgtacggacgtaacgttaacttaaccgtaaaccgtaaaccgtaaacccgttaaccgtaccggttttaccgggaccggtaaacggggaaaccaacggtaccggtaacggaaaccgtaaaccccgaaaacggttacgaacggtcggtaccgtacggacctaccgtacttccgttacg

SEQ ID NO: 394037 - DNA, 716 bp, Homo sapiens
  misc_feature: GZ8MTXP02GZUP4.38.28.C06.1.454.CMB.2.raw
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtcttttctgtggcttaattttaaaaggtgtccagtgtgaggtgcgaggtgtcggagtcgtgggggaggtcttgggttcgacgggtccccgggggtccctggacgtactcctcctgtgcagtctcgtaggtactttaaccttagtgtactatcgcctatgtactcgtcggtcccgcgaggcctaccggaggggaacgggtcgtaggggaggttgggtcctagacggtaacgtaaagttaaaggttggggtaaggggtataacgttccaaccgttattaacgttacgcgtaacggtaaccggttcccgggggtcggggggttccccgttacgaaccgtacgtaccgaaccgaagaacgaaccgtaaacgtcccgaaggaccgaccaacctaactaacttactaaccgtaaacctaaagtcgacgactacgccgtagaagtaccggtaggaacggtacgaccgggttcgtacgtttaacgttgttaggacgtcggaaggacgtaccttaacccggacggtcgaacccgtacggtttacgtcgtttctttaacggttctttcg

SEQ ID NO: 394038 - DNA, 683 bp, Homo sapiens
  misc_feature: GZ8MTXP02GXCPC.38.28.C06.1.454.CMB.2.raw
  modified_base (183)..(183): a, c, t, g, unknown or other
  modified_base (284)..(284): a, c, t, g, unknown or other
  modified_base (466)..(466): a, c, t, g, unknown or other
  modified_base (477)..(477): a, c, t, g, unknown or other
  modified_base (486)..(486): a, c, t, g, unknown or other
  modified_base (494)..(494): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctaatttaaaggngtccagtgtgaggtgcaggtgtcggagtcgtgggggaggcttggtcgacggcccgggggtcctgagactctcctgtgcagtctcgtaggtattaccttagngactatcgcctagtgatcgttcgggccaccgacggtccgtaccggaaggggaaggggtcgtagggtaggtcgggtcttacgagaactaagttaaaggtgggtaggggtactaacgtttccaaaccgtatacgttaccgcgtaacgtacccggtccggggtcgggggtccgttacacccgtanaccaccgaganaaccgaccncgaggacncaactactatactactaaacaaagtcgacaacgtacgccgaggaagaccgtacgggaacggacccaacggggtccgttagttaaacgttgtttaaccgggacgtacggaacgtaaccgtaacccgacccgtaaacggttccgacccgttaccggtttcggttacgtttacgttttacgtacggtttcgg

SEQ ID NO: 394039 - DNA, 718 bp, Homo sapiens
  misc_feature: GZ8MTXP02HFAA5.38.28.C06.1.454.CMB.2.raw
  modified_base (277)..(277): a, c, t, g, unknown or other
  modified_base (321)..(321): a, c, t, g, unknown or other
  modified_base (378)..(378): a, c, t, g, unknown or other
  modified_base (655)..(655): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggatttaacctttagtgactatgccatgatcgtgggtccgccaggctccgaggggaaggggctggaggtgggtctcgagacaattaagtgggtaggggtnattcaccatatacgcgagacgtccggtggggggcccgttcaccngtcaccagagacaactccaggacgcactactatactacgtaacaaatcgacccaacncgtccctaggaaggtacgttcggaacggggccacggggtcccgttaggtatttaacgtgtcggacgagacggactacccgaacggtacgacccgtacgttggttgttccgtttagtacgttttacgtcgggttggaccggtaaaggggtccaaaagttccggtaccgtaaccccggttcttacccgtttacgaacccggtcccttaaccccgaaccggtaaacccgggggccccttaaacggttcccgttccccggttacccccgtcgggtcccccncccggttccgaacccttcccggaaacggggccccaccggaccccttccggggaacgtaacccg

SEQ ID NO: 394040 - DNA, 695 bp, Homo sapiens
  misc_feature: GZ8MTXP02IS6T5.38.28.C06.1.454.CMB.2.raw
  modified_base (254)..(254): a, c, t, g, unknown or other
  modified_base (280)..(280): a, c, t, g, unknown or other
  modified_base (353)..(353): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggttgagctggctttttctgtggctattttaaaaggtgtccagtgtgaggtgcaggtgtcggagtcgtgggggagcttggtcaggccccgggggtcctgagctctccngtgcagtctctaggacttacttagtntactatgccatgactcgtcgggtacccgcgacggcctaccggaggggaacggggtcgtgggaggttcgggtcncgagactaaagttaagtggggttaggggtgtattaccgaacctattacgttacgcaggtacccggttcgggtcggggggtacccttccaaccgatacccgacccgtaagaccgaaccaacgtccgaaaggacaccgactaactaatacactaaacaaatacgacaacgacgaccgtagacggaccgtaggagaaccgtccgggtacgtacgtttagtttagttacggtaggaccgggtaaagtaacggtacccgttaacccccgtaaacggggtcgtaaaaccccgttaccggtttcggggttactttacgttttccggtttaagttttccttaaccggggg

SEQ ID NO: 394041 - DNA, 704 bp, Homo sapiens
  misc_feature: GZ8MTXP02F8ZFH.38.28.C06.1.454.CMB.2.raw
  modified_base (217)..(217): a, c, t, g, unknown or other
tcagtcgatcacgtcacgaccggtgctcgatttagagctcacgtattgggtttggggagagctctggagaagagctgctcagttaggacccagagggaaccatggaaaccccagcgcagcttctcttcctcctgctactctggctcccagattccaccggagagattgtgttgacgcagtctccaggccaccctgtctttgtctccgaaggggaaancgccaccctctcctgcacgggccagtcagtagttgtttacaacggtctacgttacgccgtggtaaccagaacaaaaccgtggaccaggcctccgaggcctcctcatctatcggtacactccgtacgacgggcctacgttaggtacctaccgaagtacgtacggttacgaggttggacgtagggtcggttacggtcggggaaccgtacgtaccgtttaccaccgttacctacccgtaacctactaccgaacgaccggtaaacggtaccggttaggggaaccggtcgttaaggtaaaacggttgttttacgacgttaaggttagttacgtttaacgtcgtacgtagtacgtaagttacgtaaactaacgtaacgttaccgttaattaccggtttagggacccggtaaacgggggaaccctaagggtacgtaacgggaaacgtaaccgaaaacgtacgtcggacgtacgtacgacactaacgtcgttacg

SEQ ID NO: 394042 - DNA, 619 bp, Homo sapiens
  misc_feature: GZ8MTXP02IOMTS.38.28.C06.1.454.CMB.2.raw
  modified_base (268)..(268): a, c, t, g, unknown or other
  modified_base (296)..(296): a, c, t, g, unknown or other
  modified_base (377)..(377): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggctttttctgtggcttatttaaaaggtgtccagtgtgaggtgcaggtgtcggagtcgtgggggagcttggttcagccgtggggggtccctgagactctcctgtgcagtctntggtattaaccttgtgactatcgcagtnatcgtcgggtccgccgaggtctaccgaaggggacgggcgtggaggtgggtctcagactaaagttagtaggggtaggggttnacttacactatctcgcgtacgtccggtcggggtcgggggtacgtcaccataccacgacgaacgacaaccgaccgacggacgacaactactactaactactaacaaactcgaccgacgacgtaccgtaggaacggtacggtacggacggaaccgacggtacgttagttagttagtggtacgacgacgtacgaccgtaacccgaacggtcccgtaccgtcggttcggtcgtttcgtttagttcg

SEQ ID NO: 394043 - DNA, 690 bp, Homo sapiens
  misc_feature: GZ8MTXP02FWFHO.38.28.C06.1.454.CMB.2.raw
tcagtcgatcacgtcacgaccggtgctcgatttagagctcacgtattgggtttggggggaagaggaagactgacggtcctgccacaggtggtgctgggcacggtgggcactcgacacaacatttgtgctcaactgtcttgtccaccttgctgagctggtctttttcttgtggctaatttaaaaggtgtccagtgtgaggtgcgaggtgtcggagtcgtgggggagtcttggtcagtccgtgggggtccctgagtactctcctgtgctagtctcgtaggtaacttaaccttagtagtactatcgcctatgtactcggtcgggtcccgccgtacggaccgtccggaaggggtaacggggtcgtaggggtaacggtcggtccgtacgaacgtactaaagttaaggtggggtaggtagtactacaaccaattacgttaccgacgtacgtaccggtccggggtcgggggtccgtacgacccataccgaccgtaagacgaacaaccgtcgaagacgacaactacaattacctacaaacctaaagtcgaccaacgtacgaccgtaggaacgtaaggtaccggacggaccgtaacccgggtcggttaagtttaccttggtttacgagggtaccgagtaccgactaaaccgggtaacgaaccgtaccgttacggttgtacgtttacgtttcgtttacgg

SEQ ID NO: 394044 - DNA, 588 bp, Homo sapiens
  misc_feature: GZ8MTXP02JESLM.38.28.C06.1.454.CMB.2.raw
  modified_base (185)..(185): a, c, t, g, unknown or other
  modified_base (289)..(289): a, c, t, g, unknown or other
  modified_base (307)..(307): a, c, t, g, unknown or other
  modified_base (314)..(314): a, c, t, g, unknown or other
  modified_base (332)..(332): a, c, t, g, unknown or other
  modified_base (335)..(335): a, c, t, g, unknown or other
  modified_base (340)..(340): a, c, t, g, unknown or other
  modified_base (362)..(362): a, c, t, g, unknown or other
  modified_base (408)..(408): a, c, t, g, unknown or other
  modified_base (458)..(458): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagcgtggtcttttctgtggctaattttaaaaggngtccagtgtgaggtgcaggtgtcggagtcgtgggggagcgtttggtcacggcccgggggtacctggacgctctcctgtgcagtctcgtggattaaaccgtttgnacgtatcgcatcgatcgngggtccncaggctacgaggagggtnggngtgcngagataagttagtggtacggtnactcactatacgtacgcgacgtcgtccggggcggggtcctacaccntacacgaagacgacaccgacgagacactacgtactagactaacaacgaanagacacacgacgtacgacgacggtacggacggacgacgtacgtacgtacgttagtagtacgacgacgacgtacgtacccgtaacggtaacgtaccgtacgttacgttacgtttacgttacgttacgttcg

SEQ ID NO: 394045 - DNA, 613 bp, Homo sapiens
  misc_feature: GZ8MTXP02IHSSR.38.28.C06.1.454.CMB.2.raw
  modified_base (192)..(192): a, c, t, g, unknown or other
  modified_base (214)..(214): a, c, t, g, unknown or other
  modified_base (270)..(270): a, c, t, g, unknown or other
  modified_base (304)..(304): a, c, t, g, unknown or other
  modified_base (331)..(331): a, c, t, g, unknown or other
  modified_base (563)..(563): a, c, t, g, unknown or other
  modified_base (582)..(582): a, c, t, g, unknown or other
tcagtcgatcacgtcacgaccggtgctcgatttagagctcacgtattgggtttgggctgatctggcttttttcttgtggctattttaaaaggtgtccagtgtgaggtgcgggtgtcggagtctgggggaggcttggttcagcctggggggtccctgagactctcctgtgcagtctctggattaacctttagngactatgccatgatctggtccnccaggctccagggaagggctgggagtgggtctcagcaaattaagtgggtaggggtnattcaccatatacgcagctccggtgggggccttnaccgatcaccagagacaactccaggancacactaatatctaacaaatgacaccagcctgagagtcgagaccacgggctagttaattactgtagcgaagacgacttacccgaacggtcgaacccgtaccgtttggtcgtcttttggtatttccgtggttacggccgtaaaaggggtacaaagttcgggtacctaccgtcttaccgtcacgtccctacccaccgaaaacggggtccccaacgtccggtacctttcccccgngtcccgccctcgtaccccnccgacgaccgaccaccgtccgaacgaccgcg

SEQ ID NO: 394046 - DNA, 616 bp, Homo sapiens
  misc_feature: GZ8MTXP02GRESW.38.28.C06.1.454.CMB.2.raw
  modified_base (275)..(275): a, c, t, g, unknown or other
  modified_base (290)..(290): a, c, t, g, unknown or other
  modified_base (313)..(313): a, c, t, g, unknown or other
  modified_base (321)..(321): a, c, t, g, unknown or other
  modified_base (332)..(332): a, c, t, g, unknown or other
  modified_base (340)..(340): a, c, t, g, unknown or other
  modified_base (382)..(382): a, c, t, g, unknown or other
  modified_base (518)..(518): a, c, t, g, unknown or other
  modified_base (597)..(597): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggtatttaacctttagtgatatgccatgatcgtggtccgccaggctcgaggggagggctgggagtgggtctcagacaagttaagtggggtaggggtnattcactatatacgnagccgtcgggtggggccgtcacntcacaganacactcgagcncacatatnacaataatcaccacacgtccgtagaaggcgtacgagggaccncggtaccgttgttagttagttggtcgacgagactaccaccgtacgggataccctaccggttgttcgttcttttagtactttggtcggtacggaaccggtaaaggactaaagttcgtacccgtacgttctcgttacncgtacccaccgaaccggaccggtacccgtcgtcccgttccccctcgcccggccgttcccgagcccgtaccggacggacncccgtaccgacgccgaacg

SEQ ID NO: 394047 - DNA, 605 bp, Homo sapiens
  misc_feature: GZ8MTXP02GKELQ.38.28.C06.1.454.CMB.2.raw
  modified_base (312)..(312): a, c, t, g, unknown or other
  modified_base (369)..(369): a, c, t, g, unknown or other
  modified_base (393)..(393): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttccgaggcccggggggtccctggagacctctcctgtgcagtctctggtatttaaccgttgtgactatcgccatgatctggccncaggctccgaggggaggctgggagtgggtctcgagactaattaagtgggtaggggtntacgttcaaccgtatacgttacgnacggtaccgtccggggtgggggcccttacacctatccaccagacaccaactccgaaggcgcaacacctatactaactaacaaagtcgacaacagcctaggagacgtacggaacgacgacggccgtagtattacttggtcgacgaggacaccgtacccgtaaacggtcgtaaacccgtccggtttaggtcgttaccttttagtacgttttcgg

SEQ ID NO: 394048 - DNA, 692 bp, Homo sapiens
  misc_feature: GZ8MTXP02GNH7L.38.28.C06.1.454.CMB.2.raw
  modified_base (385)..(385): a, c, t, g, unknown or other
  modified_base (397)..(397): a, c, t, g, unknown or other
tcagtcgatcacgtcacgaccggtgctcgatttagagctcacgtattgggttggggggaagaggaagactgacggtcctgccacaggtggtgctgggcacggtgggcactcgacacaacatttgcgctcaactgtcttgtccaccttgctgagctggtctttttctgtggtctaattttaaaaggtgtccagtgtgaggtgcgaggtgtcggaggtcgtgggggaggtcttggttcaggtccggtggggggtcccctggacgtactctcctgtgctagtctctggtaattaaccttagtgactatcgccaatgatcgtcgggtcccgcgaggcctaccggaggggaaggggctgggagtcgggtctacgagactaaagttaaggnggggtaggggtntaacttccgaacctattaacgttacgacgaggtaccgtcccgggggtcggggggtcccgttacacctacgtaccaacccgaagtaacgaaccaaactaccggagggaacaccaactaacctaatacctaacgtaaacaaagtcgacaaccgacggaccctggaaggacgtacggaaggaccgaacgggtccttagttaagttgttacggtcgacggaaacgtacgaccctaaaccccggaacgggtcccgaaaccccgttacggtttcggtacgtttaccgttttaggttaaccg

SEQ ID NO: 394049 - DNA, 762 bp, Homo sapiens
  misc_feature: GZ8MTXP02GUYOB.38.28.C06.1.454.CMB.2.raw
  modified_base (600)..(600): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggtcttttcttgtggctaattttaaaaggtgtccagtgtgaggtgcagggtgtcgggaggtcgtgggggtaggtcgtttaggttcgaggtcccggtcggggggtccctggagtacttcctccgtgtcgctagtctcgtgtaactttaaccgttagtcgtaactagtcgcctatgtacgtcgtcgggccgtccgacggccgtacccggaaggggacggggtcggtaggggtaggttcgggtcacgtacgtaactaaaggtttaaggtaggggttaggggtatacgttaccgaaccgtatttaacgtaccgtacgtacggtaccccggttccgggggtcgggggtacccggttacccaacccgtacgtaacccgaacccggtaagaaacggaaccctaaacccgtacggaaggtaccacaactacgtatactactaaacatccganaaccgagtcgtaaggacgtaggtaaccgacgtacccggtacggccgtttaaggtacgtttaggttagaccggtaggtaaacgtacgtaaccccggttaacccggtaacggggtacccttacggttaccgtttaggggttccctttagggtttactttaccgg

SEQ ID NO: 394050 - DNA, 691 bp, Homo sapiens
  misc_feature: GZ8MTXP02JCM6K.38.28.C06.1.454.CMB.2.raw
  modified_base (216)..(216): a, c, t, g, unknown or other
  modified_base (275)..(275): a, c, t, g, unknown or other
  modified_base (342)..(342): a, c, t, g, unknown or other
  modified_base (370)..(370): a, c, t, g, unknown or other
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatcgtgggtccncaggcctccgagggagggctggagtgggtctcgagactaaagttagtggggtaggggtnacttcaacatactacgacagacctcgggtcggggccgttacaccagtccacgagagacactcaggcncacactatactctaacaaatcgacccanacgcctagagacgtacgaggaccacgggaccgttgtaacgttagtttgcgtacgagtacgactacccgaacggtacgtacccgtaccggtttggtacgtttccgttttgttacgttttcgtagggttcgggaaccgtaaaggggaacttacggggttaccgtacgtaacccggtttcttaccggtttccaacggttccccacccggtaaaccgtaaccgggcccctaccggtttcccggttaccccgtttcccccggtcgcccggtcccgttccgaaccgttacccgacggtaaccgcccgtaacccgtcgggaacaccgg

SEQ ID NO: 394051 - DNA, 714 bp, Homo sapiens
  misc_feature: GZ8MTXP02IYNPA.38.28.C06.1.454.CMB.2.raw
  modified_base (290)..(290): a, c, t, g, unknown or other
  modified_base (315)..(315): a, c, t, g, unknown or other
tcagtcgatcacgtcacgaccggtgctcgatttagagctcacgtattgggtttggggagctctgagagaggagcccagccctgggattttcaggcgttttcatttggtgatcaggactgaacagagagaactcaccatggagtttgggctgagctggtctttttcttgtggctattttaaaaggtgtccagtgtgaggtgcaggtgtcggagtcgtgggggagcgttggttcgacggcccggggggtccctggagactctccgtgtgcagtctctggtattaaccttagngactatcgccagtgatcgtggtccncgaggcctccggaaggggaggggctgggaggtcgggtctacgagactaaagttaaaggtggggtacggggtatcttaccgaacctattaacgtttaccgacgtaggtaacccgttcccgggggtacgggggggtcccggtttaccaacccgttacgtacccaaacccgaaggaacgaaaccgtaaaccgtaccccgaagggaacgacctaaaccaacttaactaacttaccttaaacaaaattcggaacaaccgacgtaccctagggaagtacggtacggaacgtaccgaacgggtcccgttaagtaactttagttcgtgaccggtaagacgtaccgtaccccgaaacggtcgaacccctaaccggtttggtacgtttccgtttagtacgttttaccgg

SEQ ID NO: 394052 - DNA, 616 bp, Homo sapiens
  misc_feature: GZ8MTXP02HTAUO.38.28.C06.1.454.CMB.2.raw
  modified_base (386)..(386): a, c, t, g, unknown or other
  modified_base (404)..(404): a, c, t, g, unknown or other
  modified_base (446)..(446): a, c, t, g, unknown or other
  modified_base (460)..(460): a, c, t, g, unknown or other
  modified_base (466)..(466): a, c, t, g, unknown or other
  modified_base (476)..(476): a, c, t, g, unknown or other
tcagtcgatcacgtcacgaccggtgctcgatttagagctcacgtattgggtttggggggaagaggaagactgacggtcctgccacaggtggtgctgggcacggtgggcactcgacacaacatttgcgctcaactgtcttgtccaccttgctgagctggtctttttctgtggcttaagttttaaaaggtgtccagtgtgaggtgcgaggtgtcggagtcgtgggggagtcgttggttcaggccggtgggggtcctgagactctccgtgtgcagttctgtaggtacttaaccgttagtcgtactatcgcatgatcgtggtcccacgagctacggaggggacgggcgtggaggttcggtactcgaagtataagttagtggggtagggtntatacactatacgtcganagaccgtcgggtcggggtcctacacatacacgagacacaacncgagactacaactntaatanactaacaaancgaacacgcgtacgagagaccggaggaaccgtaccgacggtaccgttaggttaacttaggtagaccggggaattaacggaccgttaaccgtaccccggtaagtacccgaccgtacggttagtccgtttactttaggtacg

SEQ ID NO: 394053 - DNA, 605 bp, Homo sapiens
  misc_feature: GZ8MTXP02IARIO.38.28.C06.1.454.CMB.2.raw
  modified_base (218)..(218): a, c, t, g, unknown or other
  modified_base (243)..(243): a, c, t, g, unknown or other
  modified_base (303)..(303): a, c, t, g, unknown or other
  modified_base (317)..(317): a, c, t, g, unknown or other
  modified_base (324)..(324): a, c, t, g, unknown or other
  modified_base (329)..(329): a, c, t, g, unknown or other
  modified_base (353)..(353): a, c, t, g, unknown or other
  modified_base (366)..(366): a, c, t, g, unknown or other
  modified_base (470)..(470): a, c, t, g, unknown or other
  modified_base (509)..(509): a, c, t, g, unknown or other
  modified_base (536)..(536): a, c, t, g, unknown or other
tcagtcgatcacgtcacgaccggtgctcgatttagagctcacgtattgggtttgggctgagctggctttttcttgtggctattttaaaaaggtgtccagtgtgaggtgcaggtgtcggagtctgggggaggcttggttcagcctgggggggtccctgagactctcctgtgcagtctctggatttaacctttagtgactatgccatgatcgtgggtccncaggctccgaggggaagggctgggngtgggtctcagactaaattaagtggggtaggggtgattcactatattacgcagctcgggngggggccgtcacancacaganacacncgagacgcacatatactactaaanaaatgacccaacncgcctaggagtacggtcgacgggaccgaccgggtccgttagttaatttagtgtgcgaagtcgactaccccgaaggtcgacctacgtttgggtacttgtttagtntttcgtggtcggacgaagggtactagtcggtactacgtntctcacgcctacgaccgtaacggtccncgttccggttccctcccgtcggccctaccgttccgccgtccgacggtaccaccgaccgtacgacgccgg

SEQ ID NO: 394054 - DNA, 464 bp, Homo sapiens
  misc_feature: GZ8MTXP02ILWEV.38.28.C06.1.454.CMB.2.raw
  modified_base (222)..(222): a, c, t, g, unknown or other
  modified_base (236)..(236): a, c, t, g, unknown or other
  modified_base (334)..(334): a, c, t, g, unknown or other
  modified_base (445)..(445): a, c, t, g, unknown or other
  modified_base (448)..(448): a, c, t, g, unknown or other
  modified_base (450)..(464): a, c, t, g, unknown or other
tcagtcgatcacgtcacgaccggtgctcgatttagagctcacgtattgggtttgggctgagctggcttttttcttgtggctattttaaaagctccgtggggggccggttcaccatcaccagagacaactccaggagcacactatatctacaaatgcacagcctgagagtcgaggacacggccgtgtattatgtgcgagagatcccaaggtgaccacttggtntcttttgattttcngtggaccaagggacaagtggtccaccgttctcttcagccctacaccgaacggccctagtccggtccttcccccgtggcccgccctgcctccgaggacnccacctcgagagcctacgcgcccggccctgggcctcgccccgtggtacaaacggtaccttacttacccgacgtgaactcggaactgacggcgggactggacgaggccgtanagngnnnnnnnnnnnnnnn

SEQ ID NO: 394055 - DNA, 643 bp, Homo sapiens
  misc_feature: GZ8MTXP02HVULD.38.28.C06.1.454.CMB.2.raw
  modified_base (213)..(213): a, c, t, g, unknown or other
  modified_base (268)..(268): a, c, t, g, unknown or other
  modified_base (295)..(295): a, c, t, g, unknown or other
  modified_base (307)..(307): a, c, t, g, unknown or other
  modified_base (315)..(315): a, c, t, g, unknown or other
  modified_base (320)..(320): a, c, t, g, unknown or other
  modified_base (326)..(326): a, c, t, g, unknown or other
  modified_base (357)..(357): a, c, t, g, unknown or other
tcagtcgatcacgtcacgaccggtgctcgatttagagctcacgtattgggtttgggctgagctggcttttttcttgtggctattttaaaaggtgtccagtgtgaggtgcaggtgtcggagtctgggggaggcttggttcagcctggggggtccctgagactctcctgtgcagtctctggattaacctttagtgactatgcatgatctggtccncaggctcgagggaagggctggagtgggtctcgagcaattaagtgggtaggggtgnttaaacaccatatacgcagactccggnggggcctcaccntcacaganacacncaggancacactaatactactaacaaatcgacccaanacgtcctagaggtacgtacgacgggacaacgggtccgttagttaattagttggtacgacgagaagtacaccccgtaaacgggtcaccctacgttggtacgtcgtttttagtatttcggttggtacggacgtaaaacgggaagtaacgtcggtaccaaccgttctcttacgaccgtccctaccgaaaccgaccgggaccctacgtccggtccccttcccccgtggtcccccgtcccgtcgaacccgaccggaaacggtccgaaccccgcccgtacccgaagaaccgg

SEQ ID NO: 394056 - DNA, 546 bp, Homo sapiens
  misc_feature: GZ8MTXP01D3EEU.39.30.C08.1.454.CMB.2.raw
  modified_base (525)..(546): a, c, t, g, unknown or other
tcagtcgcactagtcacgaccggtgctcgatttagtctgacgtcaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggaccacggaaccctggtcacccgtctcctcacgccctaccaccgaacgggccccaagttcccggtcccttccccccgtcggcccacccccttccctacccaagacgcccacccgtcggtcggggggccaaccgacgcccgggacccccgtcgggggtcctcggacccgttcgggtaaaccgaaacgggtaacccttaccgtttcccaaacgttacgtcggcggtacgttacgacgggcggggcgtgggccgaaagggccggacagagnnnnnnnnnnnnnnnnnnnnnn

SEQ ID NO: 394057 - DNA, 422 bp, Homo sapiens
  misc_feature: GZ8MTXP02FMYVH.39.30.C08.1.454.CMB.2.raw
  modified_base (421)..(422): a, c, t, g, unknown or other
tcagtcgcactagtcacgaccggtgctcgatttagtctgacgtcaaagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctctgggggcacagcggccccctgggctgcctggtcaaggctacttccactagtgcgactgagcgggctggcaaggcgcatagnn

SEQ ID NO: 394058 - DNA, 466 bp, Homo sapiens
  misc_feature: GZ8MTXP02JYQ60.39.30.C08.1.454.CMB.2.raw
  modified_base (442)..(466): a, c, t, g, unknown or other
tcagtcgcactagtcacgaccggtgctcgatttagtctgacgtcaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagccctccaccaagggcccatcggtcctccccctggccacccctcctccaagacgcaccctcgtgggggccacgacgccggccccctgggctgcctggtcaaggtcctacttccacgtagtgcgacctgacggcgggcgtggcgaaggcgacagtagnnnnnnnnnnnnnnnnnnnnnnnnn

SEQ ID NO: 394059 - DNA, 521 bp, Homo sapiens
  misc_feature: GZ8MTXP01DS4K9.45.57.F02.1.454.CMB.2.raw
  modified_base (254)..(254): a, c, t, g, unknown or other
  modified_base (364)..(364): a, c, t, g, unknown or other
  modified_base (427)..(427): a, c, t, g, unknown or other
  modified_base (494)..(494): a, c, t, g, unknown or other
  modified_base (513)..(513): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaacnggtaccaacagaaagccgggacaggcccctctacttgtcatgtttaggtaaaaacgaccggccctccgggatcccagaccgattctctcggctcacctcaggaaaacacngcttccttgaccatcactgggactcaggcgaagatgaggctgactattatgcagcatccgganaccaataatggttatgtttcgcgccgggacaaggtcaccgttctggttcagcccaaggcccaacccnctgtcactcttcgttcccncccttccc

SEQ ID NO: 394060 - DNA, 521 bp, Homo sapiens
  misc_feature: GZ8MTXP01DXW8L.45.57.F02.1.454.CMB.2.raw
  modified_base (481)..(481): a, c, t, g, unknown or other
tcagacgcgatcgacacgaccggtgctcgatttagctcgatatagttgggtttggggctcagaagcagagttctgggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctctacttgtcatgtttaggtaaaaacgaccggccctccgggatcccagacccgattctctggctccacctccaggaaacacagcttaccttgcccatcactgggactcaggcgaagatgagctgactattatgcagcatccggacaccaataatggttaatgtttcgcgccggacaaggtcaccgtctggtcagcccaagccaaacccncttcgttcactctcgtccccgcctccttctcgaactcccg

SEQ ID NO: 394061 - DNA, 501 bp, Homo sapiens
  misc_feature: GZ8MTXP01DDLB4.45.57.F02.1.454.CMB.2.raw
  modified_base (286)..(286): a, c, t, g, unknown or other
  modified_base (338)..(338): a, c, t, g, unknown or other
  modified_base (358)..(358): a, c, t, g, unknown or other
  modified_base (391)..(391): a, c, t, g, unknown or other
  modified_base (437)..(437): a, c, t, g, unknown or other
  modified_base (477)..(477): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaaccaacagaaagccgggacaggcccctntacttgtcatgtttaggtaaaacgccggccctccgggatcccagaccgatcnctcgctcactcagaaacacngctcctgaccatcactgggactcgaggcgaagntgaggctgactattatgcagcatcggacacataatggttatgttcncgccggacaggtcacgttctcggcacgccaagccaacccntgtcactcttcgtcccgccttccc

SEQ ID NO: 394062 - DNA, 507 bp, Homo sapiens
  misc_feature: GZ8MTXP01CJ5QZ.45.57.F02.1.454.CMB.2.raw
  modified_base (274)..(274): a, c, t, g, unknown or other
  modified_base (346)..(346): a, c, t, g, unknown or other
  modified_base (456)..(456): a, c, t, g, unknown or other
  modified_base (472)..(472): a, c, t, g, unknown or other
  modified_base (503)..(503): a, c, t, g, unknown or other
tcagacgcgatcgacacgaccggtgctcgatttagctcgatatagttgggtttggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccggacaggcccctntactgtcatgtttaggaaaaaccgccggccctccgggatcccagaccgatctctgctccactccaggaaacncagctccttgaaccatcactgggactcgaggcgaagatgaggctgactattatgcagcatcggacacaataatggttatgtttcgcgaccggacaggtcacgtctggtcngcccaaggccaacccnttcgttcactctcgtcccacctccttctcgntccg

SEQ ID NO: 394063 - DNA, 696 bp, Homo sapiens
  misc_feature: GZ8MTXP01CU71V.45.57.F02.1.454.CMB.2.raw
  modified_base (325)..(325): a, c, t, g, unknown or other
  modified_base (330)..(330): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtgccttggacagacagtcaagatcacatgccacggagacagcctcgagagggcactatgacaaactggtaccaaacagaaacgccgggaacacggcccctctactgtcatgttaggaaaaacgccgccctcggatcccagaccgntctcncgctccacctaccaggaaacacacgcttaccttgaaccatcacgtggactcgagcgaagatgagctgactattatgcagacacgtaccgggaacaaccgtaaataacgttaggttaagttcggtttaccgaccggtaccccgggtaaacccgtaaacggggttacccctaaacccgggttcccgtttacggggtaacccgtaaaccgggcccccggtaaaaccggggacccccctaaaaccccccgtacgttaacccggggttaccccgttaaaccccttcccgggtttaacccccgtttcccccccgtaaaccccccgttaccccttcccggttaaccccggttaaccggtttaacccccggggg

SEQ ID NO: 394064 - DNA, 514 bp, Homo sapiens
  misc_feature: GZ8MTXP01DIJNH.45.57.F02.1.454.CMB.2.raw
  modified_base (286)..(286): a, c, t, g, unknown or other
  modified_base (338)..(338): a, c, t, g, unknown or other
  modified_base (489)..(490): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaaccaacagaaagccgggacaggcccctntacttgtcatgtttaggtaaaaacgccggcctcgggatcccagaccgattcnctcggctcactcagaaaacacaagctcctgaccatcactgggactcgaggcggaagatgaaggctgactattatgcagcatccgggacaaccaataatggttatagtttcgcgtccggacaggtcacgttctgcacgccaacgccaacccnncgtcacgtcttcgtcccgccctcc

SEQ ID NO: 394065 - DNA, 535 bp, Homo sapiens
  misc_feature: GZ8MTXP01EMAMS.45.57.F02.1.454.CMB.2.raw
  modified_base (255)..(255): a, c, t, g, unknown or other
  modified_base (360)..(360): a, c, t, g, unknown or other
  modified_base (514)..(514): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaacnggtaaccaacagaagccgggacaggcccctctactgtcatgttacggaaaaacgaccggccctccgggatcccagaccgatctctcgctcacctcacggaaaacncaagcttcctcgacctagtcactgggactcgaggcgaagatgaagctagactatattgacagcataccgggaacaccaaataagtggttaatcgtttcgcgtcccggaccaaggtccacgttctggttcgacgcccaacggcccacccaacgtnccactcttctcccaaccctcc

SEQ ID NO: 394066 - DNA, 508 bp, Homo sapiens
  misc_feature: GZ8MTXP01BTPL6.45.57.F02.1.454.CMB.2.raw
  modified_base (362)..(362): a, c, t, g, unknown or other
  modified_base (501)..(501): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcaggagggcactatgacaaactggtaccaacagaacgccgggacacggcccctctacttgtcatgttaggaaaaacgccggcctccgggatcccagaccgattctctcggctcacctcagaaaacacngctcctcgaccatcacgtggactcgaggcgaagatgaggctgactatatgcagcacgtcggacacaataagtgttatgttcgcgccggacaagtcacgttctgcgacgccaacgccacccaatcgcactcttcgtcccncccttcc

SEQ ID NO: 394067 - DNA, 537 bp, Homo sapiens
  misc_feature: GZ8MTXP01AVM0Q.45.57.F02.1.454.CMB.2.raw
  modified_base (387)..(387): a, c, t, g, unknown or other
  modified_base (528)..(528): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctctactgtcatgttaggtaaaacgccggccctccgggatcccagacccgattctctggctccacctccaggaaacacagcttaccttgccatcactgggactcgaggcgaagntgaggctagactattattgacagcacgtaccgggacaaccgtaaataagttggttacttgtttccgcgtcccgggaacaggtccaccgtcctggtcacgcccaaaggcccaacccgcttcgcactctcgttcccgcctccnctcgctccg

SEQ ID NO: 394068 - DNA, 518 bp, Homo sapiens
  misc_feature: GZ8MTXP01AVKP7.45.57.F02.1.454.CMB.2.raw
  modified_base (287)..(287): a, c, t, g, unknown or other
  modified_base (359)..(359): a, c, t, g, unknown or other
  modified_base (361)..(361): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaaccaacagaagccgggacacggcccctntacttgtcatgtttaggtaaaaacgccggccctcgggatcccagaccgatctctcggctcactcagaaaacncngctcctgaccatcactgggactcaggcggaagatgaggctgactatatgcagcacgtcggacacaatatgtatgttcgcgccggacaaggtcacgttctcggcacgcccaacggcccaacccgaactcgtccacctcttcgttccccgcccttcccg

SEQ ID NO: 394069 - DNA, 651 bp, Homo sapiens
  misc_feature: GZ8MTXP01C5C30.45.57.F02.1.454.CMB.2.raw
  modified_base (278)..(278): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctggtggccttgggacagacagtcaagatcacatgccacggagacagcctcaggagggcactatgacaaactggaaccaacagaacgccggacacgccctntactgtcattgttaacggaaaaccgccggcccgtacggactacccagaccgtatctctagctccactaccgaacggaaacacgacgtccttaccttacgaacctactacacgtacgggacctacgacggacggaagagtgaggtctagaacttaagttattacgacagacacgtaccggaactaacgtaaagttaagttggtttaacgttcgtttccggaccggtaccccgggaaccgtaacggtccgtaacccgttccgttggtccaaccgaccccgaaaccggacccctaaaccccgtaccttccgttaccttaccgttcccgtaccgtttaaccccaccccttcccttaccgtccgttaaccgttcccgg

SEQ ID NO: 394070 - DNA, 527 bp, Homo sapiens
  misc_feature: GZ8MTXP01EB3EO.45.57.F02.1.454.CMB.2.raw
  modified_base (363)..(363): a, c, t, g, unknown or other
  modified_base (494)..(494): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaaccaaacagaagccgggacacggcccctctacttgtcatgtttaggtaaaaacgccggccctccgggatcccagacccgattctctgctccacctcaggaaacacagctcctnccatcactggactcaggcgagatgaggctgactattatgcagacataccgggacaaccgaaattaagtgttatgtttcgccgtccggacctaaggtccaccgtctggtcacgcccaaaggcccaacccacncgttcactctcgtcccacctcttcctcgctccg

SEQ ID NO: 394071 - DNA, 602 bp, Homo sapiens
  misc_feature: GZ8MTXP01CFQA4.45.57.F02.1.454.CMB.2.raw
  modified_base (358)..(358): a, c, t, g, unknown or other
  modified_base (393)..(393): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaaccaacagaagccgggacacggcccctctacttgtcatgtttacggtaaaaaccgcccggccctccgggactccccagaccgattctctgctccactccaggaaacncagcttacctgccatcactgggactcgaggcgaanatgaggcagacttaattactgcagacaacgtaccgggaacaaccggaaattaagtgttaacgttcgttttccgccggtaccccgggaaccgaacggtccgtaacccgttccgttcggtaaccgacgaccccgaaacggccccaaaaccccgtcttccggttcacccgttcctccggttccccgcccctccttccgtccttaacgtcccg

SEQ ID NO: 394072 - DNA, 662 bp, Homo sapiens
  misc_feature: GZ8MTXP01D8EHG.45.57.F02.1.454.CMB.2.raw
  modified_base (277)..(277): a, c, t, g, unknown or other
  modified_base (387)..(387): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttggggacagacagtcaagatcacatgccacggagacagcctcagagggcactatgcaaactggtaccaacagaagccgggacaggcccctntacttgtcatgtttaggtaaaaacgccggccctcgggatcccagacccgattctctggctccacctcaggaaacacagctaccttgccatcactggactcgaggcgaagntgaggctgaactattatgcagtcacgtaccgggaacaccggtaaaattaagttcgggtttaaattcggttttacccgaccggtaccccggggtaaaccctaaacgggttcccgtaaacccggttcccgtttcggggttaacccaacgggttacccccgtaaacggggttacccccaaaacccccggtaccttacggttcccttaaacccggttccctttacccggttcccccctacccccgttccccttaccgttcccggaacctttccccgggg

SEQ ID NO: 394073 - DNA, 548 bp, Homo sapiens
  misc_feature: GZ8MTXP01AYU32.45.57.F02.1.454.CMB.2.raw
  modified_base (353)..(353): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctctactgtcatgtttaggtaaaaacgccggccctccgggatccccgagaccgattctctggctccacctccaggaaacncagcttacccttgaaccatcacgtgggactcgaggcgaagatggaggctgactattatgcaagcactccgggacacaataatgttaatgtttcgcgtccggacaaggtccaccgtctcggtcacgcccgaacggcccaaaccccgtcttacgttccaccttctcgttccccgccctccgttctccgaacgtcccg

SEQ ID NO: 394074 - DNA, 513 bp, Homo sapiens
  misc_feature: GZ8MTXP01BFBVY.45.57.F02.1.454.CMB.2.raw
  modified_base (254)..(254): a, c, t, g, unknown or other
  modified_base (284)..(284): a, c, t, g, unknown or other
  modified_base (338)..(338): a, c, t, g, unknown or other
  modified_base (364)..(364): a, c, t, g, unknown or other
  modified_base (366)..(366): a, c, t, g, unknown or other
  modified_base (401)..(401): a, c, t, g, unknown or other
  modified_base (464)..(464): a, c, t, g, unknown or other
  modified_base (488)..(488): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaacnggtaccaacagaagccgggacaggcccctntacttgtcatgtttaggtaaaaacgccggccctccgggatcccagaccgattcnctcggcctccacctcacggaaaaacncngcttcctgaccatcacgtgggactcgaggcggaanagtgagctgactattatgacagcatccggacacaataatgttatgttcgcgccggacaggtcncgttctgcacgccacggccacccnctcgtcactcttcgtcccgcctccc

SEQ ID NO: 394075 - DNA, 531 bp, Homo sapiens
  misc_feature: GZ8MTXP01EUR3S.45.57.F02.1.454.CMB.2.raw
  modified_base (481)..(481): a, c, t, g, unknown or other
  modified_base (496)..(496): a, c, t, g, unknown or other
  modified_base (517)..(517): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaaccaacagaagccgggacacggcccctctacttgtcatgttaggtaaaaacgccggccctccgggatccccagacccgtattctctcggctccacctccaggaaacacagccttaccttgaaccatcactgggacctgagggcgaagatggaggctgacttaattattgcagcataccgggacaaccgaataagtgttaatgtttcgcgtccggacagtccacgtcttgcncgccacgccaacccnttcgttcactctcgttccccncctcttctcgctcg

SEQ ID NO: 394076 - DNA, 524 bp, Homo sapiens
  misc_feature: GZ8MTXP01C6LDB.45.57.F02.1.454.CMB.2.raw
  modified_base (278)..(278): a, c, t, g, unknown or other
  modified_base (322)..(322): a, c, t, g, unknown or other
  modified_base (339)..(339): a, c, t, g, unknown or other
  modified_base (342)..(342): a, c, t, g, unknown or other
  modified_base (373)..(373): a, c, t, g, unknown or other
  modified_base (487)..(487): a, c, t, g, unknown or other
  modified_base (506)..(506): a, c, t, g, unknown or other
  modified_base (519)..(519): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaaccaacagaagccgggacacggcccctntactgtcatgttagaaaacgccggcctcggatccagaccgatcnctgctccactcagaacncancttctgccatcactgggactcgagacggaanatgaggctagactagttattgactagcagtaccggaacaacgtaataacttgttaatgtttcgcgtacccggactaacgtcaaccgttcctggtcacgccaacggcccaacccncttcgcacctctcgtcccnccctcttctccgngtccg

SEQ ID NO: 394077 - DNA, 524 bp, Homo sapiens
  misc_feature: GZ8MTXP01DK2R2.45.57.F02.1.454.CMB.2.raw
  modified_base (254)..(254): a, c, t, g, unknown or other
  modified_base (336)..(336): a, c, t, g, unknown or other
  modified_base (360)..(360): a, c, t, g, unknown or other
  modified_base (362)..(362): a, c, t, g, unknown or other
  modified_base (426)..(426): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaacnggtaaccaacagaagccgggacacggcccctctactgtcatgttaggtaaaaacgccggcctcgggatcccagaccgattcnctcggcctcacctcaaggaaaacncngcttcctgaccatcactgggactcgaggcgaagatgaggctgactatatgcagcatccgggaanaccaatatgttatgtttcgcgacccggacaaggtcaccgttctggcacgcccaacggcccaaccccaatcgtccactccttacgttccccaacctccc

SEQ ID NO: 394078 - DNA, 542 bp, Homo sapiens
  misc_feature: GZ8MTXP01EKVJT.45.57.F02.1.454.CMB.2.raw
  modified_base (212)..(212): a, c, t, g, unknown or other
  modified_base (253)..(253): a, c, t, g, unknown or other
  modified_base (361)..(362): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagntcacatgccaggagacagcctcagagggcactatgcaaacnggtaccaacagaaagccgggacaggcccctctacttgtcatgtttaggtaaaaaacgccggccctccgggatcccgagaccgattctctcggctcactcaggaaaacnngcttcctgaccatcactgggactgaggcggaagactgaggctagactattattgacagcgatccgggacaccgaataagtgttatcgtttcgcgtcccggacaaggtcctaaccgttccttaggttccgacgcccaacggcccaacccgtctcgtcactcttcgttccccgcccttcccg

SEQ ID NO: 394079 - DNA, 517 bp, Homo sapiens
  misc_feature: GZ8MTXP01A3EQ8.45.57.F02.1.454.CMB.2.raw
  modified_base (276)..(276): a, c, t, g, unknown or other
  modified_base (327)..(327): a, c, t, g, unknown or other
  modified_base (347)..(347): a, c, t, g, unknown or other
  modified_base (402)..(402): a, c, t, g, unknown or other
  modified_base (492)..(492): a, c, t, g, unknown or other
tcagacgcgatcgacacgaccggtgctcgatttagctcgatatagttgggtttggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaaacagaagccgggacaggcccctntactgtcatgttggtaaaaacgccggccctccgggatcccagaccgattcnctgctccacctcaggaaacncagcttcctgaaccatcacgtgggactcaggcgaagatgaggctgactatattgnagcatccgggacaccaataatggttaactgtttccgcgtcccgggacagtcaccgtcctggcagccaaggcctacgccccttcgcactcncgtcccaccctcttcctcgcgtccg

SEQ ID NO: 394080 - DNA, 544 bp, Homo sapiens
  misc_feature: GZ8MTXP01D9FTM.45.57.F02.1.454.CMB.2.raw
  modified_base (506)..(506): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaaccaaacagaagccgggacacggcccctctactgtcatagttaggtaaaaaccgccggccctaccgggactcccagacccgattctctcggctccgacctccaacggaaacacaacgtccttacccttacgaaccatcactgggactcgaggacgagatgaggctagactattatgcagcagtacggacaacgtaatagtgtatgttcgcgaccggacacgtccaccgtctggtcacgcccaacggcccaacccncttcgcactctccgtcccgccctccgttctcgcgtccg

SEQ ID NO: 394081 - DNA, 627 bp, Homo sapiens
  misc_feature: GZ8MTXP01ASECR.45.57.F02.1.454.CMB.2.raw
  modified_base (226)..(226): a, c, t, g, unknown or other
  modified_base (381)..(381): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccagganacagcctcgaggaggcactatgacaaactcggtaaccaacagaacgccgggaacacggcccctactacttgtctagtcggtttacggaaaaaccgccggtcccgtccgggactccgagaccgattctcgtcggcctcacctcaacggaaaacacncgcttccctagaccatccacgtcgggactcgaagggacggaagtactggaacggtctagacttaattattcgacagaccgacgtacccgggacaaacctaaagtaagttcggttaattcggtttcgaccgggtaccccgggtaacgtaacggtcccgtaaccgttccgttggttcccgtaacgccccgttaaacgccccaacccgtaactcgaacctaccgtccttcccgtcccgaacccttcccg

SEQ ID NO: 394082 - DNA, 599 bp, Homo sapiens
  misc_feature: GZ8MTXP01BXOC6.45.57.F02.1.454.CMB.2.raw
  modified_base (225)..(225): a, c, t, g, unknown or other
  modified_base (234)..(234): a, c, t, g, unknown or other
  modified_base (254)..(254): a, c, t, g, unknown or other
  modified_base (364)..(364): a, c, t, g, unknown or other
  modified_base (366)..(366): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggngacagcctnagagggcactatgacaaacnggtaccaacagaagccgggacacggcccctctacttgtcatagtttaggaaaaaccgccggccccgtccgggactcccagaccgatctctcggctcacctcacgaaaacncngcttctgaccatcactgggactcgaggcgaagacgtgagctagacttatatgactagcgacgtaccgggaacacctaaataagtggttattcgttttcgccggtaccccgggtaacacgggtcctaacccggttccttacgggttccaacggtaccccgaaaccgggccccaaaccccgtaaccttcggtcctaacccgttccgttccggttccccccgttcccgtttccccg

SEQ ID NO: 394083 - DNA, 559 bp, Homo sapiens
  misc_feature: GZ8MTXP01DM7L8.45.57.F02.1.454.CMB.2.raw
  modified_base (220)..(220): a, c, t, g, unknown or other
  modified_base (283)..(283): a, c, t, g, unknown or other
  modified_base (412)..(412): a, c, t, g, unknown or other
  modified_base (521)..(521): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttggggacagacagtcaagatcacatgccacgganacagcctcaggagggcactatgacaaactcggtaaccaaacagaagccgggacacggcccctntacttgtcatgttagaaaacgaccggccctcggactcccagaccgattctctcggctccacctaccgaacggaaacacgacgtccttaacccttcgaaccatccaacgtcgggactcgagggacggaanagtgaggctgaacttattatgcagcacgtaccggaacaacgtaaattaacgtgttaacttgttccgcgaccggaacagtccaccgtctggtcacgccaacgccaacccnttcgttcactctccgtccccgccctcttctcgcgtccg

SEQ ID NO: 394084 - DNA, 606 bp, Homo sapiens
  misc_feature: GZ8MTXP01BW1HQ.45.57.F02.1.454.CMB.2.raw
  modified_base (228)..(228): a, c, t, g, unknown or other
  modified_base (256)..(256): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcaacatgaccagganacagcctgaggaggcactatgacaaacnggtaacaacagaacgccgggacacggcccctctactgtctatgtttacggtaaaaacgccggccctaccgggactaccgagaccgtactctctcggccttccacctcgaaggaaaaccacaagccttacttacgactactcacgtgggactcgaggacggagagtgacggctagacttattattgactacgcgaagtcccgggaacaacctaaattaagtggttattcgtttcgccggtacccggtacaacggtcctaaccgttccgttacggttccaacgccccaaacggttccccaacccgtaactccggtaactaccctcgttcccgttccccgttccccgttcccg

SEQ ID NO: 394085 - DNA, 571 bp, Homo sapiens
  misc_feature: GZ8MTXP01AJV5G.45.57.F02.1.454.CMB.2.raw
  modified_base (282)..(282): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaacggagacagcctcaggacgggcactatgacaaactggtaaccaacagaagccgggacacggcccctntactgtctatgttacggtaaaacgccggccctcgggactcccagaccgattctctgcctccacctcgaggaaacacagcttacctgccatcactgggactcgaggacgaagatgaggctagactattatgacagacacgtaccggaacaacgtaataacgttaggttaattcgtttccgccggtacccgggaactaacggtcctaccgtccgttacggtcaacgcccgaaacggccccaaacccctacttcgttcaccgttcctcgtccccaccctccttctcgctccg

SEQ ID NO: 394086 - DNA, 651 bp, Homo sapiens
  misc_feature: GZ8MTXP01CX3OA.45.57.F02.1.454.CMB.2.raw
  modified_base (226)..(226): a, c, t, g, unknown or other
  modified_base (253)..(253): a, c, t, g, unknown or other
  modified_base (284)..(284): a, c, t, g, unknown or other
  modified_base (338)..(338): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcatatgccagganacagcctcagagggcactatgcaaacnggtaaccaacagaagccggacacggcccctntactgtcatgttacggtaaaaacgccggccctccgggatcccgagaccgattcnctcggcctcacctcagaaaacacaagcttctagaccatcactggactcgaggacggagatgaggctgactattatgactagcgaacgtaccgggaaccaaccgtaaagtaagttcggtttagttacggttttaccgcccgggtaccccgggtaccgaaacgggttccctaacccggttcccgtttacggttaccgtaaaccggacccccgttaaaaccgggcccccttaaacccccctaaccgttaccgggtcccgttaaaccccgttccctttacccggtttaaccccccgttaaccccccgttttcccccg

SEQ ID NO: 394087 - DNA, 636 bp, Homo sapiens
  misc_feature: GZ8MTXP01DAR97.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaaacagaagccgggacacggcccctctacttgtcatgtttaggtaaaaacgccggcccctaccgggatccccagacccgattctctcggctccacctccaggaaacacagcttcccttgaaccatccactgggactcgagggcgaagagtgagggctgtaactaatttattgacagcaagtaccgggacaaccgaaattaagttaggttacttacggttttccggacccgtaccccggggtaacccaacgggttcctaacccggttccgttgggtaaccacgccccgaaaccgggccccgtaaaccccctacttccggttccaacccttccgttacccgttccccctacccccttcccttaccttcccgttaacgttccccggg

SEQ ID NO: 394088 - DNA, 720 bp, Homo sapiens
  misc_feature: GZ8MTXP01BPQTR.45.57.F02.1.454.CMB.2.raw
  modified_base (281)..(281): a, c, t, g, unknown or other
  modified_base (319)..(319): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcagagggcactatgcaaactggtaaccaaacgagaacggccgggacacggcccctntacttgacagttaggtaaacgaaccgcccgtccggacnccacgaccgacttctcgtcgctccacctacaaccgaaacaacgacgcttcctcgaaccaactcacgtacgggaccgtacgacgggacgggtaaacgagtagacggtaccgtagtaaccttaagttacgttagaccgaacgtacgaacgtacccgggaaactaaacccgtaaagtaaagtttagggtttaacgtttacggttttaccggccccggtaaccccggggaacccgttaaaaccgggttccgtaaaccccgggtttcccgttaccgggttacgaacccggtaacccgaaacccgggtaaccccgaaacccccgtaacgtcccgttaccgacccttcccgttcccgttcccccgtcccctttccccgtacgttcccgttaaccgttccggttcccgg

SEQ ID NO: 394089 - DNA, 702 bp, Homo sapiens
  misc_feature: GZ8MTXP01DF1GF.45.57.F02.1.454.CMB.2.raw
  modified_base (359)..(359): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcaaggagggcaactatgacaaactggtaccaaacagaagccgggacacggcccctctactgtcatgttaggtaaaaaccgccggccctaccgggactcccagacccgattctctcgctcacctccaggaaacncagcttaccttacgaaccatccacgtcggggacctacgagggacggtaaagataggaggctaggaactaatttacttcgacagaccgaacgtacccggggaaccctaaaccggtaaaattaaaggtttagggtttaaacttcggtttttacccggcccgggtaccccgggtaaacccgtaaacgggttcccgtaacccggttccccgtttgggttaacccaacgggacccccgtaaaccgggaccccaaaacccccgtacgttaccgttcccttaacccgttcccgttcccggtttcccccggtcccccttcccgttcccgttcccggaaccgtttccccggg

SEQ ID NO: 394090 - DNA, 527 bp, Homo sapiens
  misc_feature: GZ8MTXP01A4AYH.45.57.F02.1.454.CMB.2.raw
  modified_base (284)..(284): a, c, t, g, unknown or other
  modified_base (336)..(336): a, c, t, g, unknown or other
  modified_base (359)..(359): a, c, t, g, unknown or other
  modified_base (499)..(499): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctntacttgtcatgtttagtaaaaacgccggcctccgggatcccagaccgattcnctcggcctcacctcaggaaaacncaagcttcctgaccatcactgggactcaggcgaagatgaggctgactattattgcagcgatccgggacaaccgaaataagtggttatgtttcgcgccggaccaaggtcaccgttctcgttcgacgcccacggccaacccnctcgtcactcttcgtccccaaccctccc

SEQ ID NO: 394091 - DNA, 590 bp, Homo sapiens
  misc_feature: GZ8MTXP01BVN8X.45.57.F02.1.454.CMB.2.raw
  modified_base (278)..(278): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcgagaggcactatgacaaactggtaaccaacagaacgccggacacggccctntactgtcatgttagaaaaccgccgccctcggactcccagaccattctctcgcctccacctcgaacgaaacacacgtccttacctgaaccatcacgtcgggactcgagggacgaagagtgaggctagtacttaattattgcagccacgtaccgggacaaccgtaaattaagttacggttacgttcgtttaccgccggacccgggtaaccgacggtcccgtaaccgttccgttcggtccacgcccgaaacggccccaaccccgtacttccgcttaccgtcctccgtcccctaccctccttcctccgaacgtccg

SEQ ID NO: 394092 - DNA, 746 bp, Homo sapiens
  misc_feature: GZ8MTXP01ASEAB.45.57.F02.1.454.CMB.2.raw
  modified_base (228)..(228): a, c, t, g, unknown or other
  modified_base (290)..(290): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggganacagcctcaggagggcactatgacaaactcggtaaccaacagaagccgggacacggcccctntactgtcatgttagaaaacgccgcctcgggactccacgaccgattctcgtcggcctaccacctcgaacggaaaaaccacgaacgtccttacccttacgaaccctacgtaccacgttacgggacctacggagggaccggaaaggtacgtaggaacggtcgttacggtaaccttaagttacgttcgaccgtaacgtccgaacggggttacccggggaaaccaaaccgttaaaagttaaaccgtttgggtttaaactttaccggggttttacccggaccccggggtacccccggggtaaaccgtaaccgggttaaccccgtaaccccgggttcccggttacgggttaccgaaccccggtaaccccgaaacccggggttccccttaaaacccccgtaacgttcccggtaacctaaccccgtttcccggttaccccgttcccccggttccccctttccccg

SEQ ID NO: 394093 - DNA, 671 bp, Homo sapiens
  misc_feature: GZ8MTXP01BXQ4I.45.57.F02.1.454.CMB.2.raw
  modified_base (281)..(281): a, c, t, g, unknown or other
  modified_base (375)..(375): a, c, t, g, unknown or other
  modified_base (377)..(377): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcgaggaggcactatcgacaaactggaaccaacgagaacgccgggacacggcccctntacttgctacgtttaggtaaaaccgaccggcccgtcggacgccacgacgtacttctcgtgcctccacctacgaacgaacacacgtctctacacncncgtacgtacggcgtacgacgggacggaacgagtacgacggtacgtagtaactagtttacgttgacgacgtcgacgtaccgggaactaacctaaagtttagttacggtttacgtttcggtttaccggacccggaccccgggtaacgtaaaccgggttccgtacccggttaccgttacgggtccgaacccgaccccgaaaccgggaccccttaaccccgtacgttacggttcccgttaccttcccgttcccgtccccgtccccttccggttcttaccggtaacgttcccggtccgg

SEQ ID NO: 394094 - DNA, 612 bp, Homo sapiens
  misc_feature: GZ8MTXP01CX0LF.45.57.F02.1.454.CMB.2.raw
  modified_base (540)..(540): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagaggcactatagacaaactcggaaccaacacgaaacgccggaacacggcccctctacttgtctattaggttaacggtaaaaccgcccggacccctaccgggactcccgagaccgtactctaccgtcgcctaccacctcgaacggaaacactacgtcttaaccttcgaacctactcacgtgggactacgaggacggaagacgtggagctagaacgttaattacgttgacacgacacgtacccgggaacaacgtaaattagttagttattcgtttccggcgtacccggtacaacggtccaccgtccgttgaacncgaccgaaccgccgaaacccctgttacgccacccttcgtcccgtcccctcccgtccttccgtcgttcgtccg

SEQ ID NO: 394095 - DNA, 614 bp, Homo sapiens
  misc_feature: GZ8MTXP01DJCQR.45.57.F02.1.454.CMB.2.raw
  modified_base (330)..(330): a, c, t, g, unknown or other
  modified_base (367)..(367): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggcctttggacagacagtcaagatcacatgccacggagacagcctcgagagggcactatgacaaactggtaaccaacagaacgccgggacacggcccctctactgtcatagtttacggaaaaacgccggccctccgggacncccagaccgattctctcgcctccacctcaagaaaacncaacgcttcctgaccatcacgtgggactcgaggacgaagagtgaggctagtaactattattgcacgcgacgtaccgggaacaaccaaagtaagttcggtttaagttcgttttccgaccgggtacccgggaacccgtaagggtccctaccggttccgttcgggttaccgaacggccccgaaacgggttaccccaaaccccgtaacgtacgtccaccttccgttccgtttcccccgccccgtttccccg

SEQ ID NO: 394096 - DNA, 632 bp, Homo sapiens
  misc_feature: GZ8MTXP01CYJAV.45.57.F02.1.454.CMB.2.raw
tcagacgcgatcgacacgaccggtgctcgatttagctcgatatagttgggtttgggggaggtgtgtcacaagatttggagatggttttctcgatgggggctgggagggctttgttggagaccttgcacttgtactccttgccgttcagccagtcctggtgcaggacggtgaggacgctgaccacacggaacgtgctgttgtactgcctcctcccgcggtctttgcttggcattatgccacctccacgccgtccacgtaccacttgaactggacctcgggtcttcgtggctcacgtccaccaccacgcacgtcgacctcgagggtccggaaatcagtaagggtattccggtttggggtttagggggaagaggaagacgtgaaccgtagttacggcggaacaacgtaaccaacaacactagtttaccgagaactaagtagggtaattagaaactccgacgacaccggccgtactactactgcgcgtacgtcggtcccgtacccgacgtcctcgcagtcggaccgcctacgagtacgtcggtcggggacgaacgggtaacccgttggtacagttcgtccacccgttccgcttcccgaacgaaccgggtcccagttcccggtcccttccccgtcgg

SEQ ID NO: 394097 - DNA, 619 bp, Homo sapiens
  misc_feature: GZ8MTXP01A95WS.45.57.F02.1.454.CMB.2.raw
  modified_base (214)..(214): a, c, t, g, unknown or other
  modified_base (234)..(234): a, c, t, g, unknown or other
  modified_base (338)..(338): a, c, t, g, unknown or other
  modified_base (547)..(547): a, c, t, g, unknown or other
tcagacgcgatcgacacgaccggtgctcgatttagctcgatatagttgggtttgggggaggtgtgtcacaagatttggagatggttttctcgatgggggctgggagggctttgttggagaccttgcacttgtactccttgccgttcagccagtcctggtgcaggacggtgaggacgctgaccacacggaacgtgctgttgtactgctcctccgnggtctttgtcttggcattangcacctccacgccgtccacgtaccattgaactggacctcgggtcttcgtggctcacgtccaccaccacgcacgtgacctcgaggggtccggaatcagtagggtntccgttgggtttgggggataggagactgaccgatacgcgacacgtaccaacaacactagtttccgagactaagtgggtaaatttgaaatccgagacacggtcctactactactgtgcgtacggtcggtcccgtaccccgagtccgtcgacctagtcggacgcccgttacgagtacgtcggtgggggccaagggtaaccccttggtaccngttcggtccttacccgttccgccttcccgaccgaacgggtccccacgttcccggtccctttcccccgtcggg

SEQ ID NO: 394098 - DNA, 713 bp, Homo sapiens
  misc_feature: GZ8MTXP01B0DWC.45.57.F02.1.454.CMB.2.raw
  modified_base (257)..(257): a, c, t, g, unknown or other
  modified_base (373)..(373): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggatctgctgtgtctggtggccttgggacagacagtcaagatcacatgccaggagacagcctcgaggacgggcactatgacaaacnggtaacaacagaagccgggacacggcccctctactgtcattgttacggtaaaaccgaccggacccgtccgggactccgagaccgtatctctcggcctcacctcgaaggaaaacacncgtcttcctacgaccactacacgtacgggactcgacgggacggaacgagtggacgactaggtacttattatgacaacgcgtaacggtacccgggaaccaaccgtaaagttaaacgttggtttaacgttcgggttttacccggccccggggtaccccgggggtaaaccgtaaacgggttaacccggtaaccccggtttacccggttacgggttaccggtaaacccgtaacccccggttaaacccgggacccccttaaaccccccgtaaccgttacccggttaacccgttaaccccttcccgtttaccccggttaacccccctttaaccccgtttcccccgg

SEQ ID NO: 394099 - DNA, 501 bp, Homo sapiens
  misc_feature: GZ8MTXP01AHRUD.45.57.F02.1.454.CMB.2.raw
  modified_base (283)..(283): a, c, t, g, unknown or other
  modified_base (358)..(358): a, c, t, g, unknown or other
  modified_base (481)..(481): a, c, t, g, unknown or other
  modified_base (489)..(489): a, c, t, g, unknown or other
tcagacgcgatcgacacgaccggtgctcgatttagctcgatatagttgggtttgggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctntactgtcatgtttaggtaaaaacgccggccctcgggatcccagaccgattctctcggctccacctcaggaaaacncaagcttcctgaccatcactgggactcaggcgaagatgagctgactattatgctagcatccgggacaaccaataatgttatcgtttcgcgccggacaggcacgttctgttcagccagccaccntgcactcncgtcccgcctcc

SEQ ID NO: 394100 - DNA, 716 bp, Homo sapiens
  misc_feature: GZ8MTXP01BKZJI.45.57.F02.1.454.CMB.2.raw
tcagacgcgatcgacacgaccggtgctcgatttagctcgatatagttgggtttggggagctgtgggctcagaagcagagttctggggtatctccaccatggcctggacccctctctggctcactctcctcactctttgcatagggtctgttactttcttctgggctgactcaggagtctgctgtgtctgtgccttgggacagacagtcaagatcacatgccagggagacacgcctcgaggaggggcactatagacaaactacggtaaccaacgaggaaacggccgggacacggcccctactacttgtcagttacgtttaacggaaaaaccgcccggcccgtccgggactaccccgagaccgtattctcgtccggacctaccgaccctcgaaacggaaaaccacgaacgtcctttacccgttacgaacctatccaacgtcgggtactcgacgggacggaagagtggaacggcttagtacttattagttcgacgtacgacaacgtaaccggggaaccaaaccgtaaagttaacggttaggtttaacgtttccggttttaccggacccgggtaaccccgggtaaccgtaaacggggttccgtaacccggtttcccggttcgggttccgtaaaccggaccccgaacccgggttaccccaaacccccgtcttaccgtaaccgtacccttccgttccccggttcccccgttccccgttcccg

SEQ ID NO: 394101 - DNA, 638 bp, Homo sapiens
  misc_feature: GZ8MTXP01ASEUB.45.57.F02.1.454.CMB.2.raw
  modified_base (275)..(275): a, c, t, g, unknown or other
  modified_base (332)..(332): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcagaggcactatgcaaactggtaccaacagaagccgggacacggcccctntacttgtcatgtttggtaaaaaccgccggcccctcgggactccccagacccattccnctcggcctccacctccaggaaacacgagcttaccttcgaaccatccacgttcgggactcgagggacggaagagtaggagctagtacttaattattgcagcaacgtaccgggaacaaccgtaaataacgttaggtttacttaggttttcccgccgggtaccccgggaaccgtaaacgggttcccgtaacccggttccgttccgggttccaaccggacccgtaaaccggccccaaaccccgtacttcggttcccttaccttcccttccgttcccctacccgtcccttccgtccgttaacgttcccggg

SEQ ID NO: 394102 - DNA, 687 bp, Homo sapiens
  misc_feature: GZ8MTXP01ASLIP.45.57.F02.1.454.CMB.2.raw
  modified_base (256)..(256): a, c, t, g, unknown or other
  modified_base (655)..(655): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcagagggcactatgacaaactggtaaccaanagaacgccggacacggccctctactgcagtgttacggtaaaaccgccggccctccggactcccgagaccgattcctctggcctccacctaccaacggaaacaccgtaacgccctttaccctacgtaacccatacccgaacgtcggggaactcggaagggaccggaagagtagggacggcctaggaactttaagttattcggcaagccgaacgtacccgggaaccaaaccgtaaagttaaagttggttaacgttcggttttcccgacccgggtaccccgggtaaaccgtacggtacccgtaacccgttccgttcgggtaacccaaccggaccccgaaacccgggttaccccgaaacccctaccttacggttcccacccgttcccgtccccggttcccccnccccgttccccttacgtcccgttcggtcccgg

SEQ ID NO: 394103 - DNA, 764 bp, Homo sapiens
  misc_feature: GZ8MTXP01BS245.45.57.F02.1.454.CMB.2.raw
  modified_base (218)..(218): a, c, t, g, unknown or other
tcagacgcgatcgacacgaccggtgctcgatttagctcgatatagttgggtttgggggaggtgtgtcacaagatttggagatggtttttctcgatgggggctgggagggctttgttggagaccttgcacttgtactccttgccgttcagccagtcctggtgcagggacggtgaggacgctgaccacacggaacgtgcttgttgtactgctcctcccgnggtctttgtcttggctattatgccacctccacgccgtccacgtaccacttgaactcggaccgtcgggtcttcgtggctcaccgtccaccaccacgcacgtgaccctcgacggggtaccggaaatcaagtaagggttactccggtttgggggtttagggggaagaggaagacgtgaccgacgttaccgacggacaacgtacccaaacaacgacgtacgtttccgagtaacgaagttagggttaaatttacgaaacgttacccggaacgaaccgtaccgggtaccctacttaaccgttacgtcggtcgtaccggtaacggttcgggttacccccgttaaccccgagggtcccttaccggacgtacggtcgggacccgtccccgttacgggaacgtaccgggttccggtacggggggtacccaaacgggggtaaccccttggggttaccttacgttttccgcccttacccgttcccggttaccctttaacccgaacccgaaccggggtcccctaccgggttcccggttcccccgtttccccggtccggg

SEQ ID NO: 394104 - DNA, 611 bp, Homo sapiens
  misc_feature: GZ8MTXP01AQ7JV.45.57.F02.1.454.CMB.2.raw
  modified_base (256)..(256): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcaacatgccaggagacagcctcaggagggcactatgacaaacnggtaccaacagaacgccggacacggcccctactacttgtcattgttacggtaaaaaacgccggccctcccgggataccccagaccgattctctcggcctccaacctcaggaaaaaccacaacgtctcctacgaccatcacgtcgggactcgaacgggcggaaagatgaggctgactattatgacacgcgaatccgggacaaccgtaaataagtggtttaattcggttttcgcccggtacccgggaaccgtaacggtccgtaaccccgttccgttcggttaccgaccggaccccaaacgggccccaaacccgaacctcgtaacctctcccttacgttcccccaaccccgttccccg

SEQ ID NO: 394105 - DNA, 764 bp, Homo sapiens
  misc_feature: GZ8MTXP01A9OBN.45.57.F02.1.454.CMB.2.raw
  modified_base (220)..(220): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtacttttcttctgggctgactcaggagtctgctgtgtctgtggccttgggacagacagtcaagatcacatcgccagganaccagcctcgaaggaggcaactatacgacaaactcggaaccaacgagaacggccggacaccggcccctatactgtactagttaggttaacggaaaaccgccggtccccgtaccgggactaccccgagacccgtacttcctcgtcggcctaccgacctaccgaacggaaacacgtacgtccttaccttacgaaccctatccgacgtacgggtacctacgggaacgggtacggaaacgtagtacggacggtctaggtaacttaagttacgtcgacgtacgacgtacgtaccgggaaccaaacgtaagttaacgtttaggtttacgttccgggtttccgacccgggtacccgggtaaacccgtacgggtaccgtaccccggtttaccggtcgggttaacccgaacccgggttaccccgtaaacccggaacccccgttaaaccccgtaaccgttcccggttacccttaccccgtttaacccgttacccccggtttaacccccctaccccgttccccgtttaccggtaacccgttccggttccccgggg

SEQ ID NO: 394106 - DNA, 712 bp, Homo sapiens
  misc_feature: GZ8MTXP01EG7ZS.45.57.F02.1.454.CMB.2.raw
  modified_base (690)..(690): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctggtggccttgggacagacagtcaagatcacatcgcccaaggagacagcctcgaggagggcaactatgacaaacgtggtaaccaacgagaacggccgggacacggcccctctacttgtcattaggttaacggtaaaaaccgcccggccccgtaccgggactccccgagaccctattcctcgtcggcctccacctaccgaacggaaacacacgtcccttaacccgttacgaaccctataccgacgtacggggaacctacggacgggacggaaagagtacggacggactacggtaactttaagttagttacgacgacgacctaacggtaccccgggaactaaacccggttaaaattaaacggttaggtttaaacgttcggttttaccggaccccggtacccgggtaaccgtaaacggttcccgtaacccggttcccgtttacgggaacctacccgacccgaaaccggaccccaaacccctacgttccgttccttaccttccgtccgttcccccnccctccgttctccgcgttcccg

SEQ ID NO: 394107 - DNA, 805 bp, Homo sapiens
  misc_feature: GZ8MTXP01D7QEU.45.57.F02.1.454.CMB.2.raw
  modified_base (258)..(258): a, c, t, g, unknown or other
  modified_base (292)..(292): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgaccaggagacagcctagaggagggcactatgacaaacncggaaccaacgagaacgccgggacacggcccctntactgtctagttacgtttaacggtaaaaaccgcccggtaccccgtaccgggaactccccgaacgtacccgtaacttccgtccgtccggccctaccgtaacccgtaccgaaacggaaaaaacccactaacggtccctttacccgttacggaacccctaactaccgacggttacgggggaaccctacggaacggggtaccggaaagtacggttacgggaaacggtccgttaaggtaaccttaagttacgttacgacgaacgtaaccggtaaccggttacccggggaaaccctaaaccgtaaaagtttaaagtttacgggtttaaacgtttccgggttttacccggacccgggttaaccccggggtaaccgttaaaccgggttaacccgtaaccccggtttccgttaccgggttaccgaaccggtaaccccgaaaccgggaccccttaaaccccgtcgttacggtaaccctaaccggttcccttacccggttccccccgttaaccccgtttccccg

SEQ ID NO: 394108 - DNA, 556 bp, Homo sapiens
  misc_feature: GZ8MTXP01D8QB4.45.57.F02.1.454.CMB.2.raw
  modified_base (281)..(281): a, c, t, g, unknown or other
  modified_base (514)..(514): a, c, t, g, unknown or other
  modified_base (535)..(535): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaaagatcacatgccacggagacagcctcagagggcactatgacaaactggtaaccaaacagaagccgggacacggcccctntactgcatgttaggaaaacgccggccctaccggatcccgagaccctattctctcggctccacctccaacggaaacacgacgtccttcctagaaccatcacgtggactcgaggacgaagatgagctagacttattagtgcagcacgtaccggaacaacgtaaattagtagttactcgtttccgcgacccggacaacggtcctaccgtctggtccacgcccaacgcccaaacccncttcgcacctcctccgtcccnccctccttcgtcgttcgtccg

SEQ ID NO: 394109 - DNA, 855 bp, Homo sapiens
  misc_feature: GZ8MTXP01D88NX.45.57.F02.1.454.CMB.2.raw
  modified_base (218)..(218): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtgccttgggacagacagtcaagatcacatgccacgganacagcctcgaggaggcactatagacaaacgtcggtaaccaaacgaggaacggccgggacacggcccctcgtacttgtactagttacggtttaacggtaaaaaaccgcccggaccccgtaccggggaactaccccgaacggtacccggtaactttccgtccgtacggtcctacccgaaccctaccgaaacgggaaaaccacgtacgtccctttaacccgttcgaaccctacgtacctaacggttacgggaaccttacgggaaggggaaccgggaagtaagtacgggtaacgggtcttaacggaacctttaaagtttagttacgaccgtaagacccgaacgttaacccggggaaaccctaaaccggtaaaatttaaaggtttacgggtttaaacgtttcgggtttacccgggaaccccgggtaccccgggggttaaaaccgtaaccggggttaccccgtaccccgggtttacccggtttcgggaaccccgtaacccgggaaacccccggaaaccgggttaaaccccccgtaaaaccccttacccgttaccgggttaccccgttaaccctttcccggtttaccccgggttaacccccctccccggttacccttaccgttccccggttaacgttccccggg

SEQ ID NO: 394110 - DNA, 704 bp, Homo sapiens
  misc_feature: GZ8MTXP01AW795.45.57.F02.1.454.CMB.2.raw
  modified_base (683)..(683): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcgaaggacgggcaactatacgacaaacgtcggtaaccaacgagaacggccgggacacggcccctatactgtctagttaggttaacggaaaaccgcccggtcccgtacgggactcccgacgtacccgtacttccgtactcggacctaccacctaccgaacggaaacacgtaacgtccttaacccttagaaccctagtaccgtaccgtacgggtaacctcgggaacgggaccgggaaaagtacgtacgggacggtcctaagtaacttaagtttaagttcgacgacgaccgtaaccgtaaccgggaacccaaacgtaaagttaaacggttggtttaactttccgggttacccgcccgggaccccgggaaaccgtacgggttaacccaccggttccgtcgggtaaccaccggaacccgaacgccccaaaccgtcttcgaccttctaacgtccctaaccccnctcccgttctaaccgcgtccg

SEQ ID NO: 394111 - DNA, 615 bp, Homo sapiens
  misc_feature: GZ8MTXP01D6O5O.45.57.F02.1.454.CMB.2.raw
  modified_base (280)..(280): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaaccaacagaacgccgggacacggcccctntacttgtcatgttaggaaaaccgccggccctccggactccccgagacccgattctctcggcctcccacctaccgaacggaaacacacgtccttacccttagaacccatcacgtgggactacgagggtacgaagactggaggctagtacttattattgacagacacgtaccgggacaaccaaattaagttagtttaacgttcgtttcccgaccggtacccggaacctaacggtccctacccgtccgttcggtaaccacgacccgaaacggaccccaaaccccgtacttcgttccaccttccgtaccttccccaccctccttactccgaacgtcccg

SEQ ID NO: 394112 - DNA, 531 bp, Homo sapiens
  misc_feature: GZ8MTXP01ACS19.45.57.F02.1.454.CMB.2.raw
  modified_base (407)..(407): a, c, t, g, unknown or other
  modified_base (409)..(409): a, c, t, g, unknown or other
  modified_base (416)..(416): a, c, t, g, unknown or other
  modified_base (465)..(465): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccggacaggcccctctacttgtcatagtttaggaaaaaccgccggccctccgggatcccgagaccgtatctctggcctcacctacacggaaacacacgcttaccttgaaccatcactggactcgaggacgagatgagctagactatntncagcacncggacacgaatatgttatgttcgcgtccggacacgtcaccgtcgtgtcngcccgaacggcccaacccgcttcgttcacgtcctcgttccccgaccctccttcctcgttcgtcccg

SEQ ID NO: 394113 - DNA, 680 bp, Homo sapiens
  misc_feature: GZ8MTXP01C613D.45.57.F02.1.454.CMB.2.raw
  modified_base (312)..(312): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaaagatcacatgccacggagacagcctcaggagggcaactatgacaaaactggtaaccaaacaagaagccgggacacggcccctctactgtcattagttaaggtaaaaaccnccggccctaccgggaactaccccgaagtacccgtatcctacgtcgacctccaaccgtacccaaggaaacacgacgtcccgttaacccttacgaaccctacgtacctaaacgtacggggaacctacggaacgggaccgggtaaagatggaacggcttagaactaattagtgacgtacgacgaacggttaccgggaaacctaaacctaaagttaaacgtttaggttagttaccgtttccggccggtaccccggaaacgtaccggtcctaccgtccgttacgtaaccgacgacccgtaacgaccctaaacccccgtagccgttcacccttgtaccccgtcccgtcccctaccgttctccgaacgttcccgg

SEQ ID NO: 394114 - DNA, 639 bp, Homo sapiens
  misc_feature: GZ8MTXP01AQ1EJ.45.57.F02.1.454.CMB.2.raw
  modified_base (229)..(229): a, c, t, g, unknown or other
  modified_base (423)..(423): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtacaagatcacatcgccacgganacacgcctgaggaggcactatgacaaactggtaaccaacagaaggccggacacggcccctactacttgtcattcgtttaaggtaaaaaccgccggcccgtaccgggactcccgagaccgtattctctcggcctcacctcaaggaaaacacaagtccttcttcgacctatcacgtcggactacgacggacggaanacgtgagtctagaacttattaagtgacgacgacgtacgtcccggggtaacaaccgtaaattagttacggttaatttcgggttttaccgcccgggtaccccgggtaacgaacgggttccaaccgggtttccgttacgttccgaacggtaccccaaccgggttacccaacccctaacgtcgtaaccacgtccttccggtccccgttaaccccttcccg

SEQ ID NO: 394115 - DNA, 672 bp, Homo sapiens
  misc_feature: GZ8MTXP01AOEZK.45.57.F02.1.454.CMB.2.raw
  modified_base (212)..(212): a, c, t, g, unknown or other
  modified_base (227)..(227): a, c, t, g, unknown or other
  modified_base (289)..(289): a, c, t, g, unknown or other
  modified_base (394)..(394): a, c, t, g, unknown or other
  modified_base (396)..(396): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagntcacatgccacgganacagcctcgagacggcactatgacaaactggtaaccaagagaacgccgggacacggcccctntacttgtactagttacggtttacggaaaaaaccgcccggtaccccgtaccgggaactcccgagtaccgtattctctccggcctaccacctacaacggtaaaaccncncgtccttcctagacctatcacgtacgggacctacgacggacggaagagtaggacggctacggtaacttagtttaagtcgaccgtagaccgtaacgtacccgggaaacaaaccgtaaagttaacgttgttaacgttcggtttaccgccggtacccggtacgtaacggtcctaccggttccgttcggaccgtaaccggacccccgaaacggcccccttaaaccccgtaacgtccgtaaccctaccgttccgttcccgttcccccgttccctttccccg

SEQ ID NO: 394116 - DNA, 519 bp, Homo sapiens
  misc_feature: GZ8MTXP01CKF51.45.57.F02.1.454.CMB.2.raw
  modified_base (251)..(251): a, c, t, g, unknown or other
  modified_base (261)..(261): a, c, t, g, unknown or other
  modified_base (283)..(283): a, c, t, g, unknown or other
  modified_base (327)..(327): a, c, t, g, unknown or other
  modified_base (351)..(351): a, c, t, g, unknown or other
  modified_base (387)..(387): a, c, t, g, unknown or other
  modified_base (491)..(491): a, c, t, g, unknown or other
  modified_base (493)..(493): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttctctgggctgactcaggagtctgctgtgtctgtggccttgggacagacagtcaagatcacatgccaggagacagcctgagaggcactatgcaaacnggtaaccaanagaacgccgggacacggccctntactgcatgttagtaaacgccgcctcgggactccgagcgattcnctcggctcactcgaggaaaacacncgcttcctagaccatcacgtggactgaggacggaangtgaggtctagtactacttatgcagcgacgtacggacactaatagtgttatcgttcgcgtaccggactaaggcctaccgttcgtcgcaccgccacgcccaaccncncgtccactcgttcctcccgccgtccc

SEQ ID NO: 394117 - DNA, 548 bp, Homo sapiens
  misc_feature: GZ8MTXP01DGFVN.45.57.F02.1.454.CMB.2.raw
  modified_base (338)..(338): a, c, t, g, unknown or other
  modified_base (366)..(366): a, c, t, g, unknown or other
  modified_base (434)..(434): a, c, t, g, unknown or other
  modified_base (524)..(524): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctacgagagggcactatgacaaactggtaaccaacagaaagccgggacacggcccctatactgtcatgttagtaaaacgccggcctcgggactccagaccgattcnctcggcctccgacctcaaggaaaacacngtaccttccttacgaccatacacttagggactcgaggacggaagaatgaaggctagtactattatganagcgagtaccggaacaaccgaaataatggttaattcgtttcgcggcccggtaacagggtcacgttcttcggcacgccaacggccaacccnctatcactcttctcccaaccctcc

SEQ ID NO: 394118 - DNA, 749 bp, Homo sapiens
  misc_feature: GZ8MTXP01B4UUY.45.57.F02.1.454.CMB.2.raw
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtacaagatcaacatcgaccaacggagacagccctgaaggacgggcactatacgacaaaacgtcggaaaccaacgacgaaacggccggggaacaccggccccctacgttaacgttcgtaccgtaagttacgtttaaacggtaaaaaacccggcccggtccccgtacccggggaactaccccgaagtaacccgtattccgtccgtccggtccttaccgaccctacgaaacggaaaacctaacaacggtcctttacctacggaaccctacgtaccgacgtacgggactcgaacgggtacggaaaggtacttagggacgggtcctaggtaacttaagttagttcgactacgacgaacgttaccgggaacaaccgtaaattaacgttggtttaactttaccggtttaccggaccgggtacccgggttaacctaacggggtaacccgttaacccggttcccggttaaaggttcccgaaaccgtccccgaaacgttcccgaaaacccctcgtactaacgaccctcgttaccctccccttaacccttcccg

SEQ ID NO: 394119 - DNA, 693 bp, Homo sapiens
  misc_feature: GZ8MTXP01AF0KI.45.57.F02.1.454.CMB.2.raw
  modified_base (285)..(285): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtacttttcttctgggctgactcaggagtctgctgtgtcggtggccttgggacagacagtcaagatcacatgccaacggagacagcctcagagggcaactatgacaaactggtaaccaaagagaacggccgggacacggcccctntaacttgtctaattaggtttaaacggtaaaaaccggacccggccccgtacccggggactaccccgaacgtacccgtaatttcctacgttcggacctacccaccgtacaacggaaaaccacgtacgtccttaccttaacgaaccctaatcaacgtgggactcgaacgggacggaaagatggacggactgtaacttattacttagacagaccgacgtacccgggaacaaccgtaaagttaagttaggtttaacttcgggttttaccgacccggtaccccgggaaccgtaaaccgggtcctaccggttacctttacgggaccaacggccccgaaacggaccccaaaccccgtactacgttccgaccttctccggttccccctaacctcccgtcaccgtaacgttccgaacg

SEQ ID NO: 394120 - DNA, 620 bp, Homo sapiens
  misc_feature: GZ8MTXP01EMFG9.45.57.F02.1.454.CMB.2.raw
  modified_base (468)..(468): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgaccacggagacagcctcgaggaggcactatcgacaaactcggtaaccaaacgagaacgccgggacacggcccctctacttgtctagttagtttaacggtaaaaaccgcccggccccgtaccgggactaccccgagacccgtattccgtcgtcggcctacccacctaccgaacggaaaccacgacgtccttacccttacgaacctatccgacgtcgggacctcgagggacgaagagtggagctagaacttattagtnacgacgacacgtaccgggaactaacgtaattaagtgttacgttcggttccgccggtaccggaacacgtccaccgtcgtggaacacgacccgaacgacccacctacttcgttccttactcctccgtcccctccgtccttctccgttcgtccgg

SEQ ID NO: 394121 - DNA, 518 bp, Homo sapiens
  misc_feature: GZ8MTXP01CFV09.45.57.F02.1.454.CMB.2.raw
  modified_base (284)..(284): a, c, t, g, unknown or other
  modified_base (368)..(368): a, c, t, g, unknown or other
  modified_base (451)..(451): a, c, t, g, unknown or other
  modified_base (490)..(490): a, c, t, g, unknown or other
  modified_base (510)..(510): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctntacttgtcatgtttaggtaaaacgccggcccctccggggatccccgagacccgattctctcggcctccacctcaggaaaacacngcttcctgaccatcactgggctcgaggcggaagatgaggctgactattatgcagcgatccgggacaccataatgtatgtttcncgccggacagtcaccgttctgcgacgccaggcccacccnctcgtcactcttcgtccccnccctcccg

SEQ ID NO: 394122 - DNA, 676 bp, Homo sapiens
  misc_feature: GZ8MTXP01AX91B.45.57.F02.1.454.CMB.2.raw
  modified_base (416)..(416): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaaccaacagaagccgggacacggcccctctaacttgtactatggtttaggtaaaaccgccggccctaccgggactcccagacccgattctctcggcctccacctaccaacggaaacacacgtccttacctacgaaccatccacgtcgggactcgaggtacggaagntggaggctagacttattattgcagcacgtaccgggaacaaccgaagttaacgttggttaacttcggtttccgcccggtaccccgggaaccgtacgggtcctacccggttccgttcgggtcccaaccggttaccccggaaaccgggttaccccctaaacccccgtcgttcccggttacccttacccgtttcccgttaccccggtttccccccggaccccctttccccgttacccgtcccgggttaacccgtttccccgggg

SEQ ID NO: 394123 - DNA, 733 bp, Homo sapiens
  misc_feature: GZ8MTXP01AT450.45.57.F02.1.454.CMB.2.raw
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgaccacggagacagcctacaggacgggcactatgacaaactggaaccaacgagaacggccgggacaccggtcccctctacgttcgtactagttacggtttaacggtaaaaacccggcccggtccccgtaccggggaactccccgaaggtacccgtattccgtcgtcggcctaccaccgtacgaacggaaaaccacaacgtccttccgttacgaccctatccgacgttcgggacctacggaagggtacgaaaggacgttaggacgggtactacggtaacttaattagttacgacgtacggacgtaacggtacccggggtaacctaaaccgtaaagttaacggtttcggtttaacgtttcgggtttacccgccccgggtaacccgggtaacctaacgggttaaccctaacccgggtttccgttaccggttaccgaacccggacccgaaaccggccccgaacccctaacgtccgtaacctaccccgttcttaccccggttccccgttcccgttcccg

SEQ ID NO: 394124 - DNA, 807 bp, Homo sapiens
  misc_feature: GZ8MTXP01EW4AI.45.57.F02.1.454.CMB.2.raw
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgttactttcttctgggctgactcaggagtctgctgtgtctgtggccttgggacagacagtacaagatcaacatcgaccaacggacgacacgcctacgaggacgggcaactatacgacaaacgtacggtaaccaaacgaacggaaacggcccggggaaccgaccgggcccccttacttaccgtttcggtacctaagtttacggttttaacgggtaaaaaaacccggaccccggggtaccccggttacccggggaacttaccccgaacggtaaccgtaacgtttccgtccgtaccggtcccttaccaacccgtaccgaaacggtaaaaaacccaccgtaacgttcctttacccgtaacgaccctaacgtaccgtaacgtacggggtaccgtacggaaggggacgggaaacgtagtaggtaacggcctttaaggaaaccttaattacgttcgacgtaacggaccggtaacggtaacccggggaaaccaaaccgttaaaagttacgtttacggtttacgtaccggttttccggacccggtaccccgggtaaccgtacgggtaaccctaacccggttccgttacggttaccgaacccgtaacccgaaccggttaccccaacccgtcgtcgtccctactcccgttccgtccccgttccttccccg

SEQ ID NO: 394125 - DNA, 738 bp, Homo sapiens
  misc_feature: GZ8MTXP01B1VWG.45.57.F02.1.454.CMB.2.raw
  modified_base (221)..(221): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgaccacgganacagcctgaggagggcactatcgacaaactggtaaccaacgagaacgccgggacacggccccctacgtacttcggtctagtacgtttaacggaaaaaccggcccggtaccccgtaccgggaactaccccgacgacccgtaattccgtctcggcctaccacctcaacggaaacacgacgtcctttacctacgaacccagtaccacggtcggggaaccttcgggaagggtacccgggaaagtacgttacgggaacggtcgttaacggtactttaacgttagttacgaccgagaccgaacgttacccggggaaacctaaacccgtaaacgtttaaagttacggtttaaacggtttcggtttacccggaccgggtaccccgggtaaaccgtacgggtacctacccggttccgtcggaaccgtaccggaccccgtaaaccggaccctaaaccccgtcgttcggttccacccgtttctacccgttccccctacccttcccttacctaacgttcgttaacccgg

SEQ ID NO: 394126 - DNA, 708 bp, Homo sapiens
  misc_feature: GZ8MTXP01BC0RL.45.57.F02.1.454.CMB.2.raw
  modified_base (293)..(293): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgaccaggagacagcctcgaggagggcactatgacaaacgtggtaaccaacgagaacgccgggacacggcccctntacttgtctagttacgtttaacggaaaaccggcccggtacccgtccgggaactccgacgaccgtattctccgtcggcctaccgacctacgaacggaaaaaccactaacgtcctttacccgtacgaaccctacttaccgacgtacgggacctcgaacgggacgggaaagtagtaggaggtactagtacgttagttacgttgactacgacgtaacgttaccggggaacctaaaccgtaaagttaagttacggttacgtttacggtttaccggcccgggtaccccgggtaaaccgtaacgggttcccgtaacccggttccgttacgggttaccgaaccggtacccgttaaccggccccttaaccccgtaactcggtaacctaccgttccgttcccgttcccccgttccctttaacccg

SEQ ID NO: 394127 - DNA, 730 bp, Homo sapiens
  misc_feature: GZ8MTXP01ES9ER.45.57.F02.1.454.CMB.2.raw
tcagacgcgatcgacacgaccggtgctcgatttagctcgatatagttgggtttgggggctcagaagcagagttctgggggtgtctccaccatggcctggacccctctctggctcactctcctcactctttgcatagggtctgtactttcttctgggctgactcaggagtctgctgtgtctggtggccttgggacagacagtcaaagatcacatcgaccaacggagacagcctacgaggacgggcaactatacgacaaacgtcgtaaccaaacgaaggaacggacccgggacaccggccccctacttacttgtactaagttacggtttaaacgggtaaaaacccggccccggccccgtaccgggactaccccgagacccgtattccgacgtcgcctacccactaccgaacggaaacacgacgtccttacctacgaaccctatccgacgtcggggaacctcgggaagggaccgggaagagtacggaggactacgtaacgtttattagttcgacgacgaccgtaacgtacccgggaaacaaccggtaaagtttacggttacggtttagttcggtttaccgcccggtacccgggaaccgtaacggtcccgtaccgttccgttacggaacccgaccggttacccgaacccggaacccctaacccgtacgttccggttacccttacccgttccttccccgttcccctaccctcccttcgtccgttaacgttcccgg

SEQ ID NO: 394128 - DNA, 736 bp, Homo sapiens
  misc_feature: GZ8MTXP01A9QKA.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgccacggagacagcctcaggagggcaactatgacaaactcggtaaccaaacagaacggccgggacacggcccctactacttgtcgtattaggtttaaacgggtaaaaacccggccccggtaccccgtacccggggaactaccccgaacgacccgtaatttccgtccgttcggaccctccccaaccgtacccgaacgggaaaaccacgtaacgtcccttacccttaacgaaccctacgtaccgtaaccgttcgggggaacctacgggaacgggacgggaaagtacgtacgggtaaggtccgttaggtaacttaacgtttaagttcgacgtaacggctaacggtacccggggaactaaaccggtaaattaggtttacggttacgtttacggtttccggcccgggtaacccgggtaacgtaaccgtccgtacccgttcgtcggtcaaccgttacccaaccggaccccaaaccgtcttcgttccttaccgtcctaccgttccccgccctcttccgtaacgttccgtccg

SEQ ID NO: 394129 - DNA, 864 bp, Homo sapiens
  misc_feature: GZ8MTXP01B8GU9.45.57.F02.1.454.CMB.2.raw
  modified_base (219)..(219): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacgganacagcctcgaggagggcactatcgactaaacgtcggtaaccaaacgaggaacggcccgggaacaccgggtcccccttactaccgttgtactaagttacggtttaacggtaaaaaacccgccccggtaccccgtacccggggaactaccccgaacgtacccggtattccttcgtccggtccctacccgtaaccctacccgaaaccggaaaacctacgtaaccggtccctttaacccgttacgaacccgtaacttacccggaaccggttaccggggtaacccgtacgggtaacgggggaaaccgggtaaagtacggttacgggaacggggttaccgtaaggttaaacccgtttaaagtttaacgtttcggaaccgtaacggtcccgtaaaccgggtaccccggggtaaacctaaacccggttaaagtttaaacggttttagggtttaaccgtttacggttttaccccggggaccccggtaaccccgggtaaaccggtaccggttacccgtacccggttccgttcgggtaacccaacccggggttccccaaaacccgggcccctaaaaccccgtcgttaccgttacccgaccgttccccgttacccgttcccccgccccttccgttcccgtaaccgttccgttcccgg

SEQ ID NO: 394130 - DNA, 685 bp, Homo sapiens
  misc_feature: GZ8MTXP01BOFH8.45.57.F02.1.454.CMB.2.raw
  modified_base (223)..(223): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcaacatgccacggagacngcctcaggagggcactatgacaaactggtaaccaacagaaacggccgggacacggtcccctctacttgtcattagttacgggtaaaaaccgccggtccccgtaccgggactcccgacgtacccgtattctcgtcggcctacccacctaccgaacggaaacactacgtccttaaccttacgaacctataccgtacgtacgggaacctacggagggacggaacgagtggacggacttggtaacttagttaacgttgaccagtccgtaacgtacccgggaacaaccggtaaaattaacggttcggttacttcggttaccgccggtaacccggaaccgtaacggtcccgtaaccgttcgtttacgggaaccaaccggttacccgaaacggaccccaaacccgtcgttacgttccttaccttaaccgtccgttccccaacccttccttccgtccgttaacgtcccgg

SEQ ID NO: 394131 - DNA, 696 bp, Homo sapiens
  misc_feature: GZ8MTXP01CTTN5.45.57.F02.1.454.CMB.2.raw
  modified_base (219)..(219): a, c, t, g, unknown or other
  modified_base (273)..(273): a, c, t, g, unknown or other
  modified_base (361)..(361): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacgganacagcctcgagaggcactatgacaactgtacaacagaagccggacacggccctntactgtacattagttacggaaaaccgccggcccgtccggactaccccagtacccgtatctacgtcgcctccacctaccgaaggaaacncgaacgtccttacccttagaaccctatacccgtaagtcggggacctggaacgggacggaagagtaggacgagtacgaacttagttatacgctaacgcaacgtaccgggaaacctaaccggtaaagttaaacgtttaggttacgtttacggttttacccggaccggtacccgggtaacccgtaaacgggtcccgtaacccggttccgttccggtaaccgaacccggaacccggtaaaccggcccccgtaaaacccctcgttccggttacccttacccgttcccgttcccggttcccccgtccccgttcccttaccgttcccgttcgtttccccggg

SEQ ID NO: 394132 - DNA, 548 bp, Homo sapiens
  misc_feature: GZ8MTXP01DGW6O.45.57.F02.1.454.CMB.2.raw
  modified_base (281)..(281): a, c, t, g, unknown or other
  modified_base (353)..(353): a, c, t, g, unknown or other
  modified_base (400)..(400): a, c, t, g, unknown or other
  modified_base (509)..(509): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcaactatgacaaactggtaaccaaacagaagccgggacacggcccctntacttgtcatgttagaaaacgccggccctaccgggatcccagaccgtatctctcgctcacctcaaggaaacncacgccttacccttgaaccatccacgttcgggactcgagggcgaagntgaggctgaactattactgcagacacgtaccggacaacgtaaataagttgttactgttccgacgcccggaactgtccaccgtcgttgtcacgcccaacggcccaacccngttcgcttactcgtacctcccaccctcttctcgcgtccg

SEQ ID NO: 394133 - DNA, 651 bp, Homo sapiens
  misc_feature: GZ8MTXP01CVN1U.45.57.F02.1.454.CMB.2.raw
  modified_base (481)..(481): a, c, t, g, unknown or other
  modified_base (490)..(490): a, c, t, g, unknown or other
tcagacgcgatcgacacgaccggtgctcgatttagctcgatatagttgggtttgggggaggtgtgtcacaagatttggagatggttttctcgatgggggctgggagggctttgttggagaccttgcacttgtactccttgccgttcagccagtcctggtgcaggacggtgaggacgctgaccacacggaacgtgctgttgtactgcctcctcccgcggtctttgtcttggctattatgccacctccacgccgtccacgtaccacttgaactggaccgtcgggtcttcgtggctcacgtccaccaccacgcacgtgacctcgaggggtccggaaatcgaagtaagggtattccggtttagggggtttaggggggaaagagggaaagacgtaggaaccgacgttaccggcggtaacaacgtacccaacaacactagtttccgtagactaagtgggtaatttagaaatccgagacacggccgtntactactgngcgagtcgtcccgtacccgagcgtcgcctagtcggacgtccctagacgtacgtcggtgggggccaacggggtaacccttgggtaccttagttcggtccacccgttccgaccttcccgaaccgtaacgggcccctagttcccggtcccgttcccccgtcggg

SEQ ID NO: 394134 - DNA, 518 bp, Homo sapiens
  misc_feature: GZ8MTXP01CB38B.45.57.F02.1.454.CMB.2.raw
  modified_base (464)..(464): a, c, t, g, unknown or other
  modified_base (480)..(480): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacacggcccctctacttgtcatgtttaggtaaaaccgccggcccctccgggatcccagacccgattctctggctccacctccaggaaacacagccttaccttgccatcactgggactcgagggcgaagatgagctgactattattgcagcagtccggacacgaatatgttatgttcgcgccggacagtcaccgtctgcncgcccacgccaacccncttcgttcactctcgtcccgccctccttctcgctccgg

SEQ ID NO: 394135 - DNA, 732 bp, Homo sapiens
  misc_feature: GZ8MTXP01A7CKF.45.57.F02.1.454.CMB.2.raw
  modified_base (228)..(228): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgaccagganacagcctcgagagggcactatgacaaactgtaaccaacagaacgaccgggacacggcccctctaacttgtactagttacggtttaaggtaaaaaaccggcccggtaccccgtacccgggaactccccgaagacccgtacttctcgtaccggcctaccaccctaccgacggaaaacaccgcgtaccttcccttagacccatccacgtacgggacttacgacgggacggaagtagtaggaacgtcctagtaacttaattagtcggactaacgccggtaacgttacccggggaaactaaccctaaagttaaccgttagggtttaacgttcggttttaccggcccgggtacccgggtaaccgtaaacgggtcccgtacccggttaccgttacggggttaccaaacccgggttaccccaaacccggggttccccaaaacccccgtcggttcccgttaaccgtaaccccttccccgttaccgggtttccccccgttcccctttcccccgg

SEQ ID NO: 394136 - DNA, 775 bp, Homo sapiens
  misc_feature: GZ8MTXP01AIAQT.45.57.F02.1.454.CMB.2.raw
  modified_base (222)..(222): a, c, t, g, unknown or other
  modified_base (438)..(438): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgttacttttcttctgggctgactcaggagtctgctgtgtctgtggccttgggacagacagtcaagatcacatcgccaagganacagcctacgaggacggcactatcgacaaacgtcggtaaccaacgaaggaaacggcccgggaacaccgggtcccccttacgttacctttggtactaagtttacgggtttaaacgggtaaaaaaccccggccccgggtaccccgtacccggggaactaccccgaaggacccgtactttcctccgtcggccctacccaccgttacgaacgggaaaacnctaaccgtcctttacccgttacgaaccctacgtaccacgtacggggacctacggaacgggtacggaaagacgttcgggaacggtcgttaaggtaactttaagttacgttacggacgtaacggacctaacgggtacccggggaaactaacccgtaaaagtttaacggtttggtttaacgtttccggtttaccggaccgggaccccgggtaacgtaacgggtcccctacggttaccgttcggaacctacggacccgacggacccctaacccgtacgttcgttccttccgttaacctccggtttcccccaccccttccgttaccgtcgaaccgttcccgg

SEQ ID NO: 394137 - DNA, 625 bp, Homo sapiens
  misc_feature: GZ8MTXP01EYEAF.45.57.F02.1.454.CMB.2.raw
  modified_base (196)..(196): a, c, t, g, unknown or other
  modified_base (215)..(215): a, c, t, g, unknown or other
  modified_base (371)..(371): a, c, t, g, unknown or other
  modified_base (386)..(386): a, c, t, g, unknown or other
  modified_base (413)..(413): a, c, t, g, unknown or other
  modified_base (463)..(463): a, c, t, g, unknown or other
tcagacgcgatcgacacgaccggtgctcgatttagctcgatatagttgggtttgggggaggtgtgtcacaagatttggagatggttttctcgatgggggctgggagggctttgttggagaccttgcacttgtactccttgccgttcagccagtcctggtgcaggacggtgaggacgctgaccacacggaacgtgcngttgtactgctcctcccgnggctttgtcttggcatatgcacctccacgccgtccacgtaccacttgaactggacctcgggtcttcgtggctcacgtccaccaccacgcacgtgacctcgagggtccgggaaatccagtaagggatccgtgggggttttcgggggaagtagggaanctgaccgattaccgngaacagtccaacgaacacacgttccgngtaccaagttagggattacgttaaagtaactacgacgacgacggtcccgntctactacgtgtcgcgtagtcgggacccgtacccgacgcgtcgactacgtacggaccgcccgtcggagtcgtcgggtcggggacggaaccgggtacccgttcgtactttacgttcgttccgccctcccgccctaccggaccccaacggtccccgcgtccccg

SEQ ID NO: 394138 - DNA, 593 bp, Homo sapiens
  misc_feature: GZ8MTXP01C9B11.45.57.F02.1.454.CMB.2.raw
  modified_base (369)..(369): a, c, t, g, unknown or other
  modified_base (411)..(411): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctggtggccttgggacagacagtcaaagatcaacatgccaacgggagaccagcctcgaggagggcactatgacaaactggtaaccaaacagaacgccgggaacacggccccctctacttgtcatgttaggaaaaccgccggcccctccgggatccccagacccgatcctctggcctccacctccaggaaacncacgcttaccttgccatcaacgtgggactcgagggacggaanagtgaggctagactattattgacagcacgtaccgggacacgtaaattaagttggttatgtttccgccggaccggaccacggtcctaccgtccttcggtcacgacccgaacggccctaaaccccacgttcgttccttaccttcctccggttcccctccccgtccttcctccgttaacgtcccg

SEQ ID NO: 394139 - DNA, 597 bp, Homo sapiens
  misc_feature: GZ8MTXP01BI6I4.45.57.F02.1.454.CMB.2.raw
  modified_base (235)..(235): a, c, t, g, unknown or other
  modified_base (253)..(253): a, c, t, g, unknown or other
  modified_base (361)..(361): a, c, t, g, unknown or other
  modified_base (400)..(400): a, c, t, g, unknown or other
tcagacgcgatcgacacgaccggtgctcgatttagctcgatatagttgggtttggggagctgtgggctcagaagcagagttctgggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctnagaggcactatgcaaacnggtaccaacagaagccgggacacggcccctctactgtcatgttacggtaaaaacgccggccctccgggatcccagaccatctctcggctcacctcaaggaaaaccacngcttccttagaccatcacgtcgggactcgaggacggaanatggaggctagactattattgacacgcgacgttacccggggaaccaaccgtaaataacgttaggttaattcggttttccgaccggtacccgggtaacctaacgggtccaacccgttccgttcggttaccgacgaccccgaacggccccaaccccaacgtcgtaacctaccttccgttccgttccccgccctttcccg

SEQ ID NO: 394140 - DNA, 758 bp, Homo sapiens
  misc_feature: GZ8MTXP01B3KXF.45.57.F02.1.454.CMB.2.raw
  modified_base (228)..(228): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatacacatgaccagganacagcctacgaggaggcactatcgacaaacgtcggtaacaacgaacggaaacggaccggggaacaccggtccccttacgtacttacggtacctaagttacggtttaacgggtaaaaaaccgccccgggtaccccgtaccggggaaccttccccgaacgtaccgtacttccgtcgtccggtaccctaccgaaccgtaccgaacggaaaaacccacgtaacgtcctttacccgttcgaacctacgtccgacgtacgggtacctcgacgggaacgtagacgtaggacggtcgtagtaacttagttagtcgaactacgtacgtaccgtaccgggtaacaacgtaaacttaaacgttggtttactttacgggtttccgaccccggggttacccggaaaccgttaacggtcccgttcccggttaccgttacggttaccccgaaccggtacccgaaccgggttacccccaaccccgttaacggtccgtaaccctacccgtaccgttacccgtttccccccggttaaccgtttccccg

SEQ ID NO: 394141 - DNA, 647 bp, Homo sapiens
  misc_feature: GZ8MTXP01BKOEN.45.57.F02.1.454.CMB.2.raw
  modified_base (257)..(257): a, c, t, g, unknown or other
  modified_base (448)..(448): a, c, t, g, unknown or other
  modified_base (454)..(454): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactcttgcatagggtctgtactttcttctgggctgactcaggagtctgctgtgtctgtggccttgggacagacagtcaagatcaacatcgaccacggagacagcctgaggaggcactatgacaaacnggtaaccaacgaggaagccgggacacggtcccctcgtactgtcagtagtttaacggaaaaaccgcccggtcccgtaccgggactccccgagaccgtattccgtctccggcctccaccgtacgaacggaaaaccacgaacgtcctttacccgtagaccctaagtccaacgtcgggactcgaggcggaagagngacgtntagtactagttatgacgtacgacggtacgtaccgggaacctaacgtaacttaagtacggtttagttacggtttccggaccggtacccgggaacgtaccggtcgtacccggttccgtacgttccgaccgacccgaaccggccaaccccgaactacgtccgtaccgtccgttcccgttccccgttccccttcccg

SEQ ID NO: 394142 - DNA, 785 bp, Homo sapiens
  misc_feature: GZ8MTXP01E5I38.45.57.F02.1.454.CMB.2.raw
  modified_base (210)..(210): a, c, t, g, unknown or other
  modified_base (214)..(214): a, c, t, g, unknown or other
  modified_base (232)..(232): a, c, t, g, unknown or other
  modified_base (262)..(262): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtgccttggacagacagtcaagntcanatgccaggagacagcctnaggaggcactatgacaaacgtggaaccaanaggaacgccggacacggcccctatacttgtctaagttaggtttaacggaaaaaaccgccccggtacccgtaccgggactaccccgagaaccgtattctccgtcggacccttaccgaaccctacgaacgggaaaaaaaccaccgtaacgtcctttacctacggaaccccattaccgaacggttggggaacctaccggaagggaccgggtaaagagttacggaacggtcttaacggtaacttttaacgttaagttcgggaactaacgggaccggtaaacgttacccgggggaaaacctaaacccgtaaaagtttaaacgttagggttttaacgttaaccgggttttcccggtaccccgggaaccccggggtaaacgtaaaccggggttaaccctaaaccccggtttaccggttccggttaacccgaaaccggtaccccgaaaccgggttccccaaaaaccccggttcaccggttaacctaaccccggttccttacccgttttaacccccgaacccgtttcccccg

SEQ ID NO: 394143 - DNA, 637 bp, Homo sapiens
  misc_feature: GZ8MTXP01EC2CJ.45.57.F02.1.454.CMB.2.raw
  modified_base (225)..(225): a, c, t, g, unknown or other
  modified_base (243)..(243): a, c, t, g, unknown or other
  modified_base (375)..(375): a, c, t, g, unknown or other
  modified_base (437)..(437): a, c, t, g, unknown or other
  modified_base (450)..(450): a, c, t, g, unknown or other
  modified_base (574)..(574): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtacttttcttctgggctgactcaggagtctgctgtgtctgtggccttgggacagacagtcaagatcacatcgccaaggagaacngcctcgaggaggcactangaacaaactggaaccaaagagaacggccggacacggcccctctacttgctatgtttaggaaaaaccgccgggtcccctcgggactcccgagacccgtattctcgtacggctaccgacctcgaaacggaaacncgacgtccttacccgttagaaccctataccgacgtacgggaacttacgaagggtacgggaanacgtagaacgggntacggtacttaagttattcgactagacaacgtacggaccaactaagttagttgttagttcgttcgcgccgggaactaggtcctacgtcttcggctaccgacccgaacggttacccaaccccgtnttaccggttccaaccgttcctacccgttcccctcccgtacccttcgtaaccgttcgttcccgg

SEQ ID NO: 394144 - DNA, 709 bp, Homo sapiens
  misc_feature: GZ8MTXP01AOGCP.45.57.F02.1.454.CMB.2.raw
  modified_base (218)..(218): a, c, t, g, unknown or other
  modified_base (279)..(279): a, c, t, g, unknown or other
  modified_base (428)..(428): a, c, t, g, unknown or other
  modified_base (435)..(435): a, c, t, g, unknown or other
tcagacgcgatcgacacgaccggtgctcgatttagctcgatatagttgggtttggggctcagaagcagagttctggggtgtctccaccatggcctggacccctctctggctcactctcctcactctttgcatagggtctgtactttctctgggctgactcaggagtctgctgtgtctgtggccttgggacagacagtcaagatcacatcgccacgganacagcctcagagggcactatgacaaactggtaaccaacagaacgccgggacacggcccctntacttgctagttggttaagaaaaccgccggcccctacgggactccccagacccgtacttcctcgtcggcctcccacctaccgaaggaaacacacgtcctttaacccgtcgaacccattcccacggttacgggactcgaagggacgaagntaggcgntagtactagttagttgacgtagacacgtaccgggaacaaccggtaaatttaacggttacggttaaacgttttccgggttttacccggacccgggtaacccccggggtaaaccgtaacggggttacccctaaacccggtttcccggttttaacggtccccgaaacggttacccccgtaaaaccgggacccccgtaaacccctaccgttaacgttcccttaaccgtcccgtttcccgtcccccgtcccttccccttacgttccgttcgttccccgg

SEQ ID NO: 394145 - DNA, 576 bp, Homo sapiens
  misc_feature: GZ8MTXP01DBDC3.45.57.F02.1.454.CMB.2.raw
  modified_base (213)..(213): a, c, t, g, unknown or other
  modified_base (231)..(231): a, c, t, g, unknown or other
  modified_base (532)..(532): a, c, t, g, unknown or other
tcagacgcgatcgacacgaccggtgctcgatttagctcgatatagttgggtttggggaggtgtgtcacaagatttggagatggttttctcgatgggggctgggagggctttgttggagaccttgcacttgtactccttgccgttcagccagtcctggtgcaggacggtgaggacgctgaccacacggaacgtgctgttgtactgctcctccgnggctttgcttggcattangcacctcacgccgtccacgtaccacttgaaactggacctcgggtcttcgtggctcacgtccaccaccacgcacgtgacctcagggtccaggaaatcataagggtatccgtggggtttgggggaagaggagactgacgagttaccgcggacaaagtccaacaaacacaagtttccgagaacaatgggtaatttgaaatccgacgacacggcgtctactactgtgcgagtcggtccggtaccccagcctcgcactggacgccctgagatcgtgggggcaggggaccctgggctagttgttccnccttcccgcttccaaccgaacgggcccatccggttcttcccccg

SEQ ID NO: 394146 - DNA, 784 bp, Homo sapiens
  misc_feature: GZ8MTXP01C7CHB.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctggtggccttgggacagacagtacaagatcacatcgaccaacgggagaaccagcctacgaaggagggcacgtatacgacaaacgtcggtaaccaagaggaacgaccgggacacgacccctatacttgtacagtttagttaacggtaaaaccgccggccccgtacgggactacccgagaaccgtacttcctcgtacggccttcccaacccgtaccaaacgggaaacacgacgttacccttaacccttacgaacctactaccgaacgttcgggaacctacggaaggggaccgggaaatagtacgggaaacggtcgttaaggtaaacttaagtttagttacgaccgaggtaccaacggttacccgggaaacctaaaccgttaaggttaaacgtttgggtttaacgttcggtttaaccccgggccgggaaccccgggtaaaccgtaaacgggtcccttaaacccgggttcctttacggggaacccaacccggttaacccggaaacccggttacccccttaaaaccccggcttacggttccccgaacttttccccgtcccgttaaccccccggtccccttaccgttccttaaacccggttcgtttcccggg

SEQ ID NO: 394147 - DNA, 677 bp, Homo sapiens
  misc_feature: GZ8MTXP01EKR1A.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacaggacagtcaagatcacatgccaggagacagcctcaggagggcactatgacaaactggtaaccaacagaagccgggacacggcccctctacgtgtacagtgtttacggaaaaaccgccggccccgtccgggactacccgagacccgattctcgtacgctccacctcaaggaaacacgacgtcccttaccttacgaaccctatacctaacgttcggggaacttcgaacgggtaccggaaagtagtacggaggtcctaggtaacctttaattacgttagcaaggctaacgtaccgggaacaacgtaaatttaacgtgtttaacgtttcgtttaccgccggtacccggaaccgtaacggtaccgtacccggttccgttgggtaaccctacggacccgtaaacgggttccccaaaccccgtcgttacgttccttaccttccgttcccggttccccgccccttcccgttccctcggaaccgtttcccggg

SEQ ID NO: 394148 - DNA, 749 bp, Homo sapiens
  misc_feature: GZ8MTXP01AZPYM.45.57.F02.1.454.CMB.2.raw
  modified_base (229)..(229): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgccaacgganacacgcctacgagacgggcactatgacaaacgacggtaaccaacgaaggaaacggacccggggaacgaccgggtacccccttacgtaacctttcgtactaacgttagttttaacggggtaaaaaaccggaccccgggtaccccgtacccgggaacctccccaacggacccggtaatttccgtcgttacccggcctacctaaccctacgaacggaaaaacacgtcgccgtttaccctactacccactaccacgttacgggacctacgaacgggaccgggaaagtaagtggaacggtactaggtaacttaagttagttcgacaggaccgaacgtacccggggaactaacccgtaaagttaacgttggtttaaagttccgttttacggaccccgggtaccccggggtaaccgtaacgggtccgtaacccgttcccgtttacggaccgtaccggaaccccgaaccggttcccccaaccccgtcgtacgttccacctcccgttccgtccccgttccccgttcccg

SEQ ID NO: 394149 - DNA, 595 bp, Homo sapiens
  misc_feature: GZ8MTXP01A476K.45.57.F02.1.454.CMB.2.raw
  modified_base (257)..(257): a, c, t, g, unknown or other
  modified_base (265)..(265): a, c, t, g, unknown or other
  modified_base (288)..(288): a, c, t, g, unknown or other
  modified_base (411)..(411): a, c, t, g, unknown or other
  modified_base (456)..(456): a, c, t, g, unknown or other
  modified_base (588)..(588): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctggtggccttgggacagacagtcaagatcacatcgccacggagacagcctcgaggaggcactatgacaacngtaccaanagaacgccggacacggtcccctntactgtcagttagtttaacggaaaacgcccggccccgtacgggacttacccgacgtacctattctactccggcctaccaccgtacaacggaaaacaccgaacgtcttacccttaggaccctancacgtcggactccgagggacgaagagtacgagtactagtaacttnttatcgacacgcggtacgtaccggaacctaacaagttacgtgttacgttcgttccggccggaccggtacaacggtcacccgttgtacgcgacgtaccgacgccgacccctgtccgctacctcttcgtccccncgttccc

SEQ ID NO: 394150 - DNA, 768 bp, Homo sapiens
  misc_feature: GZ8MTXP01AMWDV.45.57.F02.1.454.CMB.2.raw
tcagacgcgatcgacacgaccggtgctcgatttagctcgatatagttgggtttgggggctcagaagcagagttctgggggtgtctccaccatggcctggacccctctctggctcactctcctcactctttgcatagggtctgtactttcttctgggctgactcaggagtctgctgtgtctgtggccttgggacagacagtcaagatcacatcgccacggagacagcctcgagagggcactatgacaacgtacgtaaccaacaggaacggccgggaacacggcccctacttacgtcgtactagtttacggtttaacgggtaaaaacccggcccgggaccccgtaccgggactaccccgaacgtacccgtagttcctacgtcggtcctcccacctacccgaacggaaacacgacgtccttaaccgtacgaacctacgtaccgtacgtcgggacctacggaacgggacgggtaagagtacgggacgggactagtaacgttaattaacgttcgaacgacgtaccgtaacgttacccgggaactaaacccggttaaacgtttaaaggtttacggtttacgtttcggttttacccggacccgggtaacccgggtaacccgtaacggtacccgtaacccggttcccgttacgggtaacccgaaccgttacccggaacccggacccctaaaccccgtccgttaccgttcccgttacccgttcccgttcccgttccccccgtcccttccccgttccgtaacccgttcgttccccggg

SEQ ID NO: 394151 - DNA, 500 bp, Homo sapiens
  misc_feature: GZ8MTXP02ITJ9F.45.57.F02.1.454.CMB.2.raw
  modified_base (275)..(275): a, c, t, g, unknown or other
  modified_base (328)..(328): a, c, t, g, unknown or other
  modified_base (347)..(347): a, c, t, g, unknown or other
  modified_base (380)..(380): a, c, t, g, unknown or other
  modified_base (415)..(415): a, c, t, g, unknown or other
  modified_base (421)..(421): a, c, t, g, unknown or other
  modified_base (490)..(490): a, c, t, g, unknown or other
tcagacgcgatcgacacgaccggtgctcgatttagctcgatatagttgggtttggggctcagaagcagagttctgggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaaactggtaccaacagaagccgggacaggcccctntacttgtcatgtttggtaaaaacgccggcctccgggatcccagacccgattcnctgctccacctcagaaacncagcttcctgaccatcactggactcaggcgaanatgagctgactatatgcagcatcggacacaataanggttangtttcgcgccggacaaggcacgtctggtcagcccaagccaacccactcgtcactctcgtcccaccctcnctcgactccg

SEQ ID NO: 394152 - DNA, 525 bp, Homo sapiens
  misc_feature: GZ8MTXP02IMUJR.45.57.F02.1.454.CMB.2.raw
  modified_base (332)..(332): a, c, t, g, unknown or other
  modified_base (376)..(376): a, c, t, g, unknown or other
  modified_base (385)..(385): a, c, t, g, unknown or other
  modified_base (488)..(488): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaaccaacagaagccgggacaggcccctctacttgtcatgtttaggtaaaaaccgccggccctccggatcccagacccgattcnctggcctccacctcagaacacagcttcctgccatcactggactnaggcggaantgagctgactattatgcagcagtccgggacaccaatactaggttatcgtttcgcgccgggactaacggtcaccgtcttggtcacgcccaacggcccaaacccnctacgtcacgtctcgtcccaccctctcctcgactccg

SEQ ID NO: 394153 - DNA, 508 bp, Homo sapiens
  misc_feature: GZ8MTXP02F13YH.45.57.F02.1.454.CMB.2.raw
  modified_base (286)..(286): a, c, t, g, unknown or other
  modified_base (357)..(357): a, c, t, g, unknown or other
  modified_base (390)..(390): a, c, t, g, unknown or other
  modified_base (485)..(485): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaacggagacagcctcagagggcactatgcaaactggtaaccaacagaagccgggacaggcccctntactgtcatgtttaggaaaaacgccggcctccgggatcccagaccgatctctcgctccactcagaaacacngcttctgacccatcactgggactcaggcggaanatgaggctgactattatgcagcacgtccggacaaccgaataatggttatgtttcgcgccgggacagtcacgtctggcagcccaagcccaaacccnctcgtcactctctcccaccctcc

SEQ ID NO: 394154 - DNA, 504 bp, Homo sapiens
  misc_feature: GZ8MTXP02GH9A4.45.57.F02.1.454.CMB.2.raw
  modified_base (283)..(283): a, c, t, g, unknown or other
  modified_base (385)..(385): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccggacaggcccctntactgtcatgtttaggaaaaacgccggccctcgggatcccagaccgatctctcgctccactcagaaacacagctcctgaccatcactgggactcaggcgaanatgagctgactatatgcagcatcggacaaccgaataatggttaatgtttcgcgtccgacaagtcaccgtctgtcacgcccaacggcccaacccgaatcgtcactctcgttcccacctcc

SEQ ID NO: 394155 - DNA, 508 bp, Homo sapiens
  misc_feature: GZ8MTXP02JJEY1.45.57.F02.1.454.CMB.2.raw
  modified_base (275)..(275): a, c, t, g, unknown or other
  modified_base (386)..(386): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccggacaggcccctntactgtcatgttaggtaaaaacgccggcctccggatcccgagaccgattctctggcctccacctccaggaaacacacgcttcctgaccatcacgtggactcgaggcgaagntgagctgactatatgcagcatccggacacaatagtgttatgttcgcgccggacagtcacgtctggtcacgccaacggccaaacccgctacgcactctcgttccccacctctactcgactccg

SEQ ID NO: 394156 - DNA, 522 bp, Homo sapiens
  misc_feature: GZ8MTXP02IZOLK.45.57.F02.1.454.CMB.2.raw
  modified_base (374)..(374): a, c, t, g, unknown or other
  modified_base (486)..(486): a, c, t, g, unknown or other
  modified_base (515)..(515): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaaactggtaccaacagaaagccgggacaggccccctctacttgtcatgttaggtaaaaacgccggccctccggatcccagacccgattctctgctccactccagaacacagcttcctgccatcactggactnaggcgaagatgagctgacttatattgcagcatccgggaacaccaaatagtggttatgttacgcgcccggacaaggtccaccgtctacggtcacgcccaacggcccaaacccnctacgtcactctcgttcccaccctcctcncgactcg

SEQ ID NO: 394157 - DNA, 514 bp, Homo sapiens
  misc_feature: GZ8MTXP02FTIXR.45.57.F02.1.454.CMB.2.raw
  modified_base (350)..(350): a, c, t, g, unknown or other
  modified_base (383)..(383): a, c, t, g, unknown or other
  modified_base (486)..(486): a, c, t, g, unknown or other
  modified_base (507)..(507): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaaactggtaaccaacagaaagccgggacaggcccctctactgtcatgtttaggtaaaaacgccggccctccggatcccagacccgatctctgctccactccagaaacncagctcctgccatcactggactcaggcggaaanagtgagctgactatatgcagcatccggacacaataatggttatgtttacgcgcccggacaaggtccacgtccttggcagcccaaggccaacccactcgccacnccgtcgtccccacctcctacncgatccg

SEQ ID NO: 394158 - DNA, 525 bp, Homo sapiens
  misc_feature: GZ8MTXP02JYXI4.45.57.F02.1.454.CMB.2.raw
  modified_base (286)..(286): a, c, t, g, unknown or other
  modified_base (356)..(356): a, c, t, g, unknown or other
  modified_base (395)..(395): a, c, t, g, unknown or other
  modified_base (500)..(500): a, c, t, g, unknown or other
  modified_base (520)..(520): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaccaacagaagccgggacacggcccctntactgtcatgttagaaaacgccggccctcgggactcccagaccgattctctcgcctccacctcagaaacncagccttctcgaccatcacgtgggactcgaggcggaagntgaggctgaacttattattgacagcacgtccgggacaccaataagtggttatcggttcgcgccggacaaggtcaccgtctcggtcacgacccgacgcccaacccncgtcgactctcgtcgtcccncctcc

SEQ ID NO: 394159 - DNA, 531 bp, Homo sapiens
  misc_feature: GZ8MTXP02GLZ7J.45.57.F02.1.454.CMB.2.raw
  modified_base (329)..(329): a, c, t, g, unknown or other
  modified_base (347)..(347): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaaactggaccaacagaagccgggacacggcccctctacttgtcatgtttaggtaaaaacgccggccctcggatcccagaccgattcnctgctccacctcagaacncagcttcctgccatcactgggactcgaggcgaagatgagctagactattattgcagcagtccgggacaccaataatggttaatgtttcgcgtccggaacaaggtcaccgtcgttgtacacgcccaacggcccaaacccactcgtaccacctccgtccgttccccgcccttcctctccgactccg

SEQ ID NO: 394160 - DNA, 510 bp, Homo sapiens
  misc_feature: GZ8MTXP02G16JZ.45.57.F02.1.454.CMB.2.raw
  modified_base (284)..(284): a, c, t, g, unknown or other
  modified_base (378)..(378): a, c, t, g, unknown or other
  modified_base (438)..(438): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagccctcagagggcactatgcaaactggtaccaacagaagccggacaggcccctntactgcatgttaggtaaaaacgcggcctcgggatcccagaccgatctctcgctccacctcaggaaaacacagcttcctgaccatcactggactnaggcgaagatgagcagactagtatgcagcagtccggacaccgaataatggtaatgtttcncgtcccggacacgtcaccgtcgtcgtcacgaccaacggccaacccaacgtcgacactctcgtcccgcctccc

SEQ ID NO: 394161 - DNA, 533 bp, Homo sapiens
  misc_feature: GZ8MTXP02HRXCM.45.57.F02.1.454.CMB.2.raw
  modified_base (226)..(226): a, c, t, g, unknown or other
  modified_base (286)..(286): a, c, t, g, unknown or other
  modified_base (472)..(472): a, c, t, g, unknown or other
  modified_base (511)..(511): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccagganacagcctcaggagggcactatgacaaactggtaaccaacagaagccggacacggcccctntactgtcatgttaggtaaaacgccggccctaccgggactcccagaccgtattctctcggcctccactacaaggaaaccacacgtccttctcgaccctactcacgtcgggactcgaggacgaagatgaggctagactatatgacagcagtccggacactaataagtgtattgttcgcgtacccgganaacccgtcaccgttctcgtcacgccgaacgccctaaccnctcgccactctctcccacctcc

SEQ ID NO: 394162 - DNA, 527 bp, Homo sapiens
  misc_feature: GZ8MTXP02GKV8G.45.57.F02.1.454.CMB.2.raw
  modified_base (279)..(279): a, c, t, g, unknown or other
  modified_base (394)..(394): a, c, t, g, unknown or other
  modified_base (490)..(490): a, c, t, g, unknown or other
tcagacgcgatcgacacgaccggtgctcgatttagctcgatatagttgggtttgggggctcagaagcagagttctggggtgtctccaccatggcctggacccctctctgcctcactctcctcactctttgcatagggtctgtactttcttctgggctgactcaggagtctgctgtgtctgtggccttgggacagacagtcaagatcacatgccacggagacagcctcagagggcactatgacaaaactggtaaccaacagaagccgggacaggcccctntactgtcatgttaggtaaaaacgccggccctccggatccccagaccgattctctgcctccacctccaggaaacacagccttccttagcccatcactgggacctcgaggcggaaanatgaggctagaacttatatgcagcatccgggacaaccaatatgttatgtttcgcgccggacaaggtcaccgtctggacacgccacggccaaccccntcgtacactctacgtccccacctcctcctcgactccg

SEQ ID NO: 394163 - DNA, 522 bp, Homo sapiens
  misc_feature: GZ8MTXP02I8F71.45.57.F02.1.454.CMB.2.raw
  modified_base (275)..(275): a, c, t, g, unknown or other
  modified_base (487)..(487): a, c, t, g, unknown or other
tcagacgcgatcgacacgaccggtgctcgatttagctcgatatagttgggtttggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaccaacagaagccggacaggcccctntacttgcatgttaggtaaaaacgccggccctcgggatcccagacccgattctctggcctccacctcaacggaaacacacgtcttaccttcgaccatcactggggacctcgagggcgaagatgaggctagactattatgcagcagtcggacaccaatatggtatgttcgcgccgacaagtcaccgtcgtcgtcacgcccaaggcccaaacccncgtacgcactctacgtcccacctctctcgactccg

SEQ ID NO: 394164 - DNA, 505 bp, Homo sapiens
  misc_feature: GZ8MTXP02F48E1.45.57.F02.1.454.CMB.2.raw
  modified_base (277)..(277): a, c, t, g, unknown or other
  modified_base (350)..(350): a, c, t, g, unknown or other
  modified_base (499)..(499): a, c, t, g, unknown or other
tcagacgcgatcgacacgaccggtgctcgatttagctcgatatagttgggtttgggtgctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaaagccgggacaggcccctntactgtcatgtttggtaaaaacgccggccctccgggatccccagaccgattctctgctccaccctcagaaacncagcttctgaccatcactgggactcaggcgaaagatgaggctgactattatgcagcatccggacaccaatatggttatgtttcgcgccgggacaaggtcacgtctgtcagcccaagccaacccgactcgcaactctcgttcccacctcnctcgac

SEQ ID NO: 394165 - DNA, 561 bp, Homo sapiens
  misc_feature: GZ8MTXP02IW3XL.45.57.F02.1.454.CMB.2.raw
  modified_base (240)..(240): a, c, t, g, unknown or other
  modified_base (411)..(411): a, c, t, g, unknown or other
  modified_base (544)..(544): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcaggagggcactangacaaactggtaaccaacagaaggccggacacggcccctctacttgtcatgttaggtaaaaacgccggccctaccggactcccagaccgattctctggcctccacctccaacggaaaccacacgtcttcccttcgacctataccacgtacgggactcgagggacggaaagntggagctagaacttattattgactagcacgtccgggaaccaccaattagtggttattcgttcgccgaccggacaacgtcaccgtcgtcgtcacgcccgaacgcccaaaccctctcgccactccgtcgtccccncctctcctcgacttccg

SEQ ID NO: 394166 - DNA, 516 bp, Homo sapiens
  misc_feature: GZ8MTXP02J1D8Y.45.57.F02.1.454.CMB.2.raw
  modified_base (330)..(330): a, c, t, g, unknown or other
  modified_base (418)..(418): a, c, t, g, unknown or other
  modified_base (479)..(479): a, c, t, g, unknown or other
  modified_base (505)..(505): a, c, t, g, unknown or other
  modified_base (512)..(512): a, c, t, g, unknown or other
tcagacgcgatcgacacgaccggtgctcgatttagctcgatatagttgggtttgggggctcagaagcagagttctggggtgtctccaccatggcctggaccccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctctacttgtcatgtttggtaaaaacgccggccctccgggatcccagaccgattcnctggctccactccaggaaacacagctccttgccatcactgggactcaggcgaagactgaggctagactattactgcagcatccggganaccaatatggttaatgtttcgcgccggacaaggtcacgtctgtcagccaacggccaacccncacgtccactcgtactcccacctccnctaccgntccg

SEQ ID NO: 394167 - DNA, 506 bp, Homo sapiens
  misc_feature: GZ8MTXP02F9EGD.45.57.F02.1.454.CMB.2.raw
  modified_base (471)..(471): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaaactggtaaccaacagaagccgggacacggcccctctacttgtcatgtttaggaaaaaccgcccggccctccggatccccagaccgattctctgctccactcagaacacagctcctgccatcactggactcgaggcgaagatgagctgactatatgcagcagtccggacacaatagtgttatgttcgcgaccggacaggtcaccgtctgcacgccaacgccaacccnctcgcactctcgtacccaccctcctactcactccg

SEQ ID NO: 394168 - DNA, 660 bp, Homo sapiens
  misc_feature: GZ8MTXP02JOWCY.45.57.F02.1.454.CMB.2.raw
  modified_base (278)..(278): a, c, t, g, unknown or other
  modified_base (362)..(362): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcagagggcactatgcaaactggtaaccaacagaagccgggacacggccccctntacttgtcatgttaggtaaaaacgccggccctccggatcccagaccgattctctgctccactccagaaacacagctcctgaccntcactgggactcgaggcggaaagactgagctagactattatcgactagctaagtacccggggaaacacccgtaaagtaagttaggttaaacgttcgttttaccgccggttacccccggggaaccgtaaacgggtccctaaaccccggttcccgtttacggttaccctacggacccccgaaaccggggtaacccccaaacccccgtaaccgttaccggttaccctaaacccttcccggttaacccgtttcccccgtaaaccccccttcccgtttaccctacccgtaaccgtttccccgg

SEQ ID NO: 394169 - DNA, 505 bp, Homo sapiens
  misc_feature: GZ8MTXP02HO6Q5.45.57.F02.1.454.CMB.2.raw
  modified_base (277)..(277): a, c, t, g, unknown or other
  modified_base (298)..(298): a, c, t, g, unknown or other
  modified_base (324)..(324): a, c, t, g, unknown or other
  modified_base (343)..(343): a, c, t, g, unknown or other
  modified_base (374)..(374): a, c, t, g, unknown or other
  modified_base (402)..(402): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaccaacagaagccgggacaggcccctntactgcatgttaggtaaaacncggccctcggatcccagaccgattcnctgctccactccagaaacncagctcctgccatcactggactcgagcgaanatgagctgactatatgcagcatccgganacaatatgtatgttcgcgccggacaacggtcaccgtctcgtcacgtcccaacgcccaaaccccgctacgtccactcgtcgtcccgccctctcctcgtactccg

SEQ ID NO: 394170 - DNA, 526 bp, Homo sapiens
  misc_feature: GZ8MTXP02IAS85.45.57.F02.1.454.CMB.2.raw
  modified_base (335)..(335): a, c, t, g, unknown or other
  modified_base (390)..(390): a, c, t, g, unknown or other
  modified_base (394)..(394): a, c, t, g, unknown or other
  modified_base (486)..(486): a, c, t, g, unknown or other
tcagacgcgatcgacacgaccggtgctcgatttagctcgatatagttgggtttggggctcagaagcagagttctgggtgtctccaccatggcctggaccccctctctggctcactctcctcactctttgcatagggtctgtactttcttctgggctgactcaggagtctgctgtgtctgtggccttggacagacagtcaagatcacatgccacggagacagcctcagagggcactatgcaaaactggtaccaacagaaagccgggacaggccccctctacttgtccatgtttaggtaaaaacgccggcccctaccggatccccagacccgattcnctggctccacctccaagaaacacagcttcctgccatcactggactcgagcgagangagntgactattattgcagcagtccggacaaccaataatgttaatgtttcgacgtccggacaggtcacgtcgtgtcacgccaacggcccaaacccnctacgtcacctcctcgtccccacctcctcctcgtactccg

SEQ ID NO: 394171 - DNA, 554 bp, Homo sapiens
  misc_feature: GZ8MTXP02JIK8D.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaaccaacagaagccgggacacggcccctctacttgtcagtgtttaggtaaaaaccgccggccctccgggactcccagaccgattctcgtcgctccacctccgaacggaaacacacgtcttccttcgaccatcacgtggactcgaggcgaagatggagctgactattatgacagacagtaccgggacaaccaatactaggttatgtttcgcgacccggacaaggtcaccgtctggtacacgacccaacggaccctaacccactcgtaccacgttctccgtaccccaccctctacctcgactccgg

SEQ ID NO: 394172 - DNA, 512 bp, Homo sapiens
  misc_feature: GZ8MTXP02HPOG7.45.57.F02.1.454.CMB.2.raw
  modified_base (275)..(275): a, c, t, g, unknown or other
  modified_base (325)..(325): a, c, t, g, unknown or other
  modified_base (344)..(344): a, c, t, g, unknown or other
  modified_base (358)..(358): a, c, t, g, unknown or other
  modified_base (488)..(488): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagaggcactatgcaaactggtaccaacagaagccgggacaggcccctntactgtcatgtttaggtaaaacgccggccctcggatcccagaccgattcnctgctccacctcagaaacncagcttcctgaccntcactgggactcgaggcgaagatgagctagactattattgctaagcagtccggacaccgaaattagtggttattcgtttcgcgtaccggacaagtcacgtcctggtcagccaacgccaaccactcgtacnctcgtctcccacctctctcactcg

SEQ ID NO: 394173 - DNA, 511 bp, Homo sapiens
  misc_feature: GZ8MTXP02F0HFC.45.57.F02.1.454.CMB.2.raw
  modified_base (277)..(277): a, c, t, g, unknown or other
  modified_base (478)..(478): a, c, t, g, unknown or other
tcagacgcgatcgacacgaccggtgctcgatttagctcgatatagttgggtttggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaaactggtaccaacagaaagccgggacaggcccctntacttgtcatgttaggtaaaacgccggccctccggatccccagacccgattctctgcctccacctccaggaaaccacagcttccttgccatcaactgggactcgaggcgaagatgagctgactatattgcagcatccgggacaccaatactgttatgtttcgcgccggacaaggtcacgtctgtcacgccaagcccaaccnctcgcactctcgtcccgcctcctctcgactccg

SEQ ID NO: 394174 - DNA, 625 bp, Homo sapiens
  misc_feature: GZ8MTXP02H3OX6.45.57.F02.1.454.CMB.2.raw
  modified_base (267)..(267): a, c, t, g, unknown or other
  modified_base (351)..(351): a, c, t, g, unknown or other
  modified_base (371)..(371): a, c, t, g, unknown or other
  modified_base (373)..(373): a, c, t, g, unknown or other
tcagacgcgatcgacacgaccggtgctcgatttagctcgatatagttgggtttggggagctgtgggctcagaagcagagttctggggtgtctccaccatggcctggaccccctctctggctcactctcctcactctttgcatagggtctgtactttcttctgggctgactcaggagtctgctgtgtctgtggccttgggacagacagtcaagatcacatgccacggagacagcctcaggaggcactatgacaaacgtggtaaccaanagaacgaccggacacggccccctctacttgtcattggtttaaggaaaaccgccggccctaccgggactcccgagaccgtattcnctcgcctccactcacgaacncngtccttctcgaccatccacgtcgggactcgaggacggaagagtggagtcgtagacttagttattgctaagcaacgtaccgggaaccaaccgaaagttaagttaggtttactttacggttttccggacccggtacccgggaacccgtaacggtcctacccggttccgttacggtaccgaccggaccccgaacggacccccaaaccctaacgtaccgtaccgtaccttcctacccgttccctaaccccttcccg

SEQ ID NO: 394175 - DNA, 532 bp, Homo sapiens
  misc_feature: GZ8MTXP02GJURM.45.57.F02.1.454.CMB.2.raw
  modified_base (391)..(391): a, c, t, g, unknown or other
  modified_base (398)..(398): a, c, t, g, unknown or other
  modified_base (514)..(514): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaaactggtaaccaacagaagccgggacacggcccctctacttgtcatgtttaggtaaaaacgccggccctccgggatccccagaccgattctctggctccactaaagaaacacagcttcctgaccatcactgggactcgaggcgaaantgaggcngactattatgcagcatccggacacaataatgttatcgtttcgccgaccggacaaggtcaccgtcgtggtcacgacccaaggacccaaaccccactcgacacttcctcgttcccccnccctctcctcgactcgcg

SEQ ID NO: 394176 - DNA, 640 bp, Homo sapiens
  misc_feature: GZ8MTXP02JD8RI.45.57.F02.1.454.CMB.2.raw
  modified_base (287)..(287): a, c, t, g, unknown or other
  modified_base (389)..(389): a, c, t, g, unknown or other
  modified_base (527)..(527): a, c, t, g, unknown or other
tcagacgcgatcgacacgaccggtgctcgatttagctcgatatagttgggtttgggggaggtgtgtcacaagatttggagatggttttctcgatgggggctgggagggctttgttggagaccttgcacttgtactccttgccgttcagccagtcctggtgcaggacggtgaggacgctgaccacacggaacgtgctgttgtactgctcctccgcggtctttgtcttggctattatgccacctccacgccgtccacgtaccacttgaactggacctcggggtcttcgnggctcacgtccaccaccacgcacgtcacctcgaggggtccgaaatcgagtaaggtatccgttaggggtttggggaaagaggaagacgtgaccgtattaccgnggaacaagtccaacaacgacgtaagtttccgataacaagttcgggtaaatttagaaatcccgaacgacgaccggaccgtctaactacgtgtacgacgtaggtcggacccgtaacccgagtcctcgacagtcgggaccnccgtagacgtacgtcggtacgggggacgtaacgggtaccgtgggtactagttcgtaccaccgttccgaccttaaccgaacggaccggaccctacggtccgttccctcccgtcg

SEQ ID NO: 394177 - DNA, 616 bp, Homo sapiens
  misc_feature: GZ8MTXP02I4NHA.45.57.F02.1.454.CMB.2.raw
  modified_base (358)..(358): a, c, t, g, unknown or other
tcagacgcgatcgacacgaccggtgctcgatttagctcgatatagttgggtttggggggtcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagaggcactatgacaaactggtaaccaacagaagccggacacggcccctctacttgtcatgtttagtaaaacgccgcctccgggatccagaccgattctctggctccacctcacgaacacagcttctgacntcactggactcacggacgaagatgtaggctagacttatattgctagcacgtccgggaacaaccgtaaataacgttaggttattcggttttacgcccggtacccgggtaacgtaaacgggttccgaaccgtttccgttacgggtacctaccggaacccctaaacgggaccccctaaaccccgaccgttacggtaccctaccgtaccttcccgttaccccctacccgttccccttacgtccgtaaccgttccgttcccgg

SEQ ID NO: 394178 - DNA, 746 bp, Homo sapiens
  misc_feature: GZ8MTXP02JRWRJ.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgccgaacggagacagcctcgaaggaggcactatcgacaaacgtcggtaaccaacagaacgccgggacacggcccctctactgtacagttacggttaaggtaaaaccgccggcccgtaccgggactccccgaagacccgtattcctcgtcggcctacccgacctaccgaaacggtaaaccacgtaacgtcctttaccgttacgaccctacgtacctaccgtacggggtaccttacggaacggggaccgggaaaagacgttacggacgggtccgttaaggtaacctttaagtttaacgttcgacgtacgactaaccggttacccggggaaacctaaacccgtaaaagttaagtttacgggtttaacgtttcgggttttacccggacccgggtaccccggggtaacgtaacggttcccgtaacccggttccgttacggtacccgacggaccccgaaaccggaccccctaaaccccgtacgtccgtacctacccgttcgtcccgtcccccgtcccttccgtccgtaccgtacgttcccg

SEQ ID NO: 394179 - DNA, 702 bp, Homo sapiens
  misc_feature: GZ8MTXP02ICGE8.45.57.F02.1.454.CMB.2.raw
  modified_base (344)..(344): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtacttttcttctgggctgactcaggagtctgctgtgtctgtggccttgggacagacagtcaagatcacatgccaggagacagcctcaggagggcactatgacaaactcggtaaccaacgagaaagccgggaacacggcccctctacttgtcatgtttacggtaaaacgcccggacccgtaccggactccccaagaccgattcnctcggcctccacctaccgaacggaaaccacacgtacctttcccttacgacccactacaccgtacggggaccttcgaagggaccggaaagacgtaggacggtctaggtaaaccttatttaagtgtacgagctaacgtacccgggaaccaaccgtaaaagttaagttacggtttaacgttcgttttaccggaccgggtaccccgggtaaccgtaaacgggtcccgtacccggttccgttacggtaccgaccgaccccgtaaaccggacccccaaaccccgtacgttccggttaaccctaccgttcccgttcccggttacccccgtacccccttcccgttaccgtccgttaacgtccccgg

SEQ ID NO: 394180 - DNA, 496 bp, Homo sapiens
  misc_feature: GZ8MTXP02GT40N.45.57.F02.1.454.CMB.2.raw
  modified_base (379)..(379): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctctactgtcatgttaggtaaaaacgccggccctcggatcccagaccgattctctgctccactccagaacacagcttccttgccatcactgggactcgaggcgaanctgagctgacttatatgcaagcagtccggacaccaatatgtatgttcgcgccggacaggtcacgtctgtcagccagcccaaccactcgcactctcgtcccgcctcctctcgactccg

SEQ ID NO: 394181 - DNA, 726 bp, Homo sapiens
  misc_feature: GZ8MTXP02H52WP.45.57.F02.1.454.CMB.2.raw
  modified_base (293)..(293): a, c, t, g, unknown or other
  modified_base (314)..(314): a, c, t, g, unknown or other
  modified_base (341)..(341): a, c, t, g, unknown or other
  modified_base (369)..(369): a, c, t, g, unknown or other
  modified_base (421)..(421): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcaacatgccacggagacagcctcgaggacggcactatgacaaactggtaaccaacgagaacggccgggacacggcccctntactgtcatgttaggaaaacnccggcctcgggactccgagaccattcnctcggcctccacctcgaagaaacctacncgtcctttacgttcgacctatccgacgttacgggactacgagggcggaaagngtacggaggtccgtagtaacgttagtttacttgactacggtaccgtaacggttacccggggaaacccaaccggtaaaagttaaagtttacgggttttaaacgtttcgggtttttacccggacccgggtaccccgggggtaaacccgtaaaaccggggttaccccgtaaacccggtttcccggttttacggtacccgtaaccggtaacccccgtaacggggaaccccctaaacccccgtaacgtacccggttaccctaacccgttcccgttaccccgggttaccccccgttaccccgtttcccccg

SEQ ID NO: 394182 - DNA, 526 bp, Homo sapiens
  misc_feature: GZ8MTXP02G1RRJ.45.57.F02.1.454.CMB.2.raw
  modified_base (400)..(400): a, c, t, g, unknown or other
  modified_base (461)..(461): a, c, t, g, unknown or other
  modified_base (491)..(491): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcgagagggcactatgcaaactggtaaccaacagaagccgggacacggcccctctacttgtcatgtttaggtaaaaacgccggaccctccgggatcccgagaccgattctctgctccactccaggaaacacacgtcttcctgaccactacacgtacggactcgagggcgaaacgntaggagcgtagacttattatgcagcacgtaccggacacagtatgttatgttcgcgaccganacgtcacgtctggtacgcagcccaccgacncgtacactctcgtccaccctctctcgactcgtccg

SEQ ID NO: 394183 - DNA, 525 bp, Homo sapiens
  misc_feature: GZ8MTXP02IYBE9.45.57.F02.1.454.CMB.2.raw
  modified_base (276)..(276): a, c, t, g, unknown or other
  modified_base (331)..(331): a, c, t, g, unknown or other
  modified_base (388)..(388): a, c, t, g, unknown or other
  modified_base (490)..(490): a, c, t, g, unknown or other
  modified_base (503)..(503): a, c, t, g, unknown or other
  modified_base (511)..(511): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcaggaggcactatgcaaactggtaccaacagaagccggacacggcccctntacttgtcagtgttaggtaaaaacgccggacccgtccggatcccagaccgattcnctgctccacctcacgaacacagcttccttagaccatcactggactcgagcgaagtangagctagacttatatgcagacagtccgggaacacctaaattagtacgttattcgttcgcggtaccggactacggcaccgtctgcacgaccacggccaacccnctacgtcacgtcncgtacccncctcgctacgctcg

SEQ ID NO: 394184 - DNA, 514 bp, Homo sapiens
  misc_feature: GZ8MTXP02FUGTT.45.57.F02.1.454.CMB.2.raw
  modified_base (342)..(342): a, c, t, g, unknown or other
  modified_base (420)..(420): a, c, t, g, unknown or other
  modified_base (424)..(424): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttctctgggctgactcaggagtctgctgtgtctgtggccttgggacagacagtcaagatcacatgccacggagacagcctcagagggcactatgcaaactggtaccaaacagaagccgggacaggcccctctacttgtcatgtttaggtaaaaacgccggccctccgggactcccgagaccgattctcncggcctccactcaaggaaaccacacgcttcctagacccatcacgtcggactcgaggcgaaagatgagctgactatatnacancactcggacacaatactgtatgttcgcgccggacaggcacgtctgtcacgcccaagcccaacccgctcgaccactctcgtcccaccttcc

SEQ ID NO: 394185 - DNA, 598 bp, Homo sapiens
  misc_feature: GZ8MTXP02FMZ7S.45.57.F02.1.454.CMB.2.raw
  modified_base (236)..(236): a, c, t, g, unknown or other
  modified_base (285)..(285): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagccctnagagggcactatgcaaactggtaccaacagaagccgggacaggcccctntactgtcatgtttaggaaaaacgccggccctccgggactcccgagaccgattctctcggctccactcaggaaacacagcttcctgaccatcactgggactcgaggcggaaagagtgaggctagaacttaattatgacagctacgtccgggaacaaccgtaaattaaacgttggttaacttcggtttacgccggtaccccggggaccgtaaaacggtcctaacccggttccgttacgggtaccaccggaccccgaaacggcccctaaaccccaacgttccgacctacctccgttccgtcccccgccctttcccg

SEQ ID NO: 394186 - DNA, 670 bp, Homo sapiens
  misc_feature: GZ8MTXP02JOT8F.45.57.F02.1.454.CMB.2.raw
  modified_base (212)..(212): a, c, t, g, unknown or other
  modified_base (395)..(395): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagntcacatgccacggagacaggcctcgaggagggcactatgacaaactggtaaccaacgaaggaacgccgggaaccacggaccccctcgtaacttgtctagttagtttaacggtaaaaaccgccggacccgtaccgggactacccgacgaccgtatctctcggcctaccacctacgaagaacacncgtccttctacgaccatcacgtcgggactcgacggacgaagagtagagtcgtacgaacttagttacgttcgactacgacgtacgtacccgggaacaacctaaaagttaacgttaggtttaaacttcggtttaccggacccggtaacccgggtaaccgtaaacggttacccgtaaccggtccgtttacggaccgtaaccggaccccgaaacggtaccccgaaaaccctcgtaccgttacctaccgttccgttacccgtacccccgtccctttcccg

SEQ ID NO: 394187 - DNA, 660 bp, Homo sapiens
  misc_feature: GZ8MTXP02H7XCW.45.57.F02.1.454.CMB.2.raw
  modified_base (221)..(221): a, c, t, g, unknown or other
tcagacgcgatcgacacgaccggtgctcgatttagctcgatatagttgggtttgggggctcagaagcagagttctggggtgtctccaccatggcctggaccccctctctggctcactctcctcactctttgcatagggtctgtacttttcttctgggctgactcaggagtctgctgtgtctgtggccttgggacagacagtcaagatcacatgccacgganacagcctcaggagggcactatgacaaactggtaccaacagaacgccgggacacggcccctctactgtcattagtttacggtaaaaccgaccggccccgtaccgggactccccgagaccgtacttctcgtcggcctccacctccgaacggaaaccacacgtcttccttacgaccctataccaccgttacggggacctacggaagggaccggaagagtaggaacggctaggacttatttagttcgacacgtcaacgtaccgggaactaaccgtaaattaagtttcggttaagtttcggtttaccggcccggtacccgggtaaccaacgggttcctaccggttcgttacggtcaccgtacccgaacggaccccaacccgtactccgtacaccttaaccgttccttaaccccctacccttcctaccgttccgaccgttcccgg

SEQ ID NO: 394188 - DNA, 533 bp, Homo sapiens
  misc_feature: GZ8MTXP02F3JM9.45.57.F02.1.454.CMB.2.raw
  modified_base (358)..(358): a, c, t, g, unknown or other
  modified_base (394)..(395): a, c, t, g, unknown or other
  modified_base (483)..(483): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagaggcactatgcaaaactggtaaccaacagaagccgggacacggcccctctactgtcatgttaggtaaaaacgccgcctccggatcccagaccgtatctctgctccactccagaacacagctccttgcancactggactcaggcgaagatgagctagactatatgnngacatcggacaccaataactggttatgtttacgcgacccggacgaacggtcaccggttctggtacacgtcccaaacggcccaaacccncgtacgtaccactccgtccgtacccacccttccctctaccggtactccgg

SEQ ID NO: 394189 - DNA, 633 bp, Homo sapiens
  misc_feature: GZ8MTXP02H7V8Q.45.57.F02.1.454.CMB.2.raw
  modified_base (299)..(299): a, c, t, g, unknown or other
  modified_base (349)..(349): a, c, t, g, unknown or other
  modified_base (418)..(418): a, c, t, g, unknown or other
tcagacgcgatcgacacgaccggtgctcgatttagctcgatatagttgggtttggggagctgtgggctcagaagcagagttctggggtgtctccaccatggcctggaccccctctctggctcactctcctcactctttgcatagggtctgtactttcttctgggctgactcaggagtctgctgtgtctgtggccttgggacagacagtcaaagatcacatgccaacgggagacagccctcgaggagggcactatgacaaacgtggtaaccaaacgagaacgccgggaacacggcccctntacttgtcatgttaggaaaacgaccggcctcgggactccagaccgattcnctacgctaccacctacagaaacacagtccttcctagaccctatccgactggacctcgaggacgaagagngacggactgtaactatttagttacgactagactacgtacccgggaacaaccgtaaagttaacgttaggttaacgtttcgttttacggacccggaccccggggtaactaaaacggggttcccaacccggtttccgtacggtaccgacgacccgaaacggccccaaaccccctaacgtcgtaccgtactaccttccgttaccccctacccttccccg

SEQ ID NO: 394190 - DNA, 513 bp, Homo sapiens
  misc_feature: GZ8MTXP02JE7OB.45.57.F02.1.454.CMB.2.raw
  modified_base (284)..(284): a, c, t, g, unknown or other
  modified_base (491)..(491): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcagagggcactatgcaaactggtaaccaacagaagccgggacaggcccctntactgtcatgttaggaaaaacgccggccctccgggatcccagaccgattctctcggcctccacctcaggaaaccacagcttccttgaccatcactgggactcgaggcgaagatgaggctagactattatgcagcagtccggacaccaaataactgttaatgtttacgcgccggacagtcacgtctcgcacgcccaacgcccaacccngtcgtcactctcgtcccactcc

SEQ ID NO: 394191 - DNA, 851 bp, Homo sapiens
  misc_feature: GZ8MTXP02I8HO4.45.57.F02.1.454.CMB.2.raw
  modified_base (259)..(259): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctggtggccttgggacagacagtcaagatcacatcgccacggagacagcctcagagggcactatgacaaactggtaaccaanaggaacgccgggaacacggccccctctaacgttgtacctaacggttttacggtaaaaaccggtaaccccggccccgtacccggggaccgtaccccgaaccggtaacccggtaacttccgttaccgtcgggtacctcccctaaccgtaccgaaccgggaaaaccaaccgtacggtacctttcccgtttaccggaaccctacgtacctaccggtaccggggtaaccgtaccgtaaacggggaccgggaaaggtaaagtccggtaaggtaccgtaggtaaacgtttaactttaaagtttcggacgtaacggtaccgaaacgttaccccggggaaacctaaaccctaaaagtttaaacggttaagggttttacgtttacgggtttttacccggaccccggggaaccccggggtaaacccgtaacgggttacccgtaaacccggtttccccgtttacgggaacccgtaaccggaacccccgaaaaccggggaccccctaaaacccccctaacgttccggtacccctaaccgtttacccgtccggttttcccccccgcccccgttaccttcccgtcgggtaccctccggttaccccgg

SEQ ID NO: 394192 - DNA, 669 bp, Homo sapiens
  misc_feature: GZ8MTXP02HQPI2.45.57.F02.1.454.CMB.2.raw
  modified_base (174)..(174): a, c, t, g, unknown or other
  modified_base (231)..(231): a, c, t, g, unknown or other
  modified_base (296)..(296): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggngtctgctgtgtctgtggccttgggacagacagtcaagatcacatcgaccgacggganacacgcctcgaggacggcactatgacaaactggaaccaacagaagacccgggacacggccccctntacttgtctagtaggtttaacggtaaaaccgacccggccccgtaccgggtactcccgacgaccgtattcctcgtccggacctccgacctacgaaggaaaccacgcgtccttacctcgaccctataccacgtacgggacctcgaggacggaaagactaggagtcgtagtacttattagtcgacgtacgactacgtaccgggaacaacctaaagtaagttggtttaattcggtttcggacccggtacccgggtaccgtaacggtccgtaacccggtttccgttacggtactaaccggaccccgaaaaccgggtccccaaaccccgtcgttcccggtactacccgttccgttacccgtcccccctacccgttcccg

SEQ ID NO: 394193 - DNA, 688 bp, Homo sapiens
  misc_feature: GZ8MTXP02J26J0.45.57.F02.1.454.CMB.2.raw
  modified_base (225)..(225): a, c, t, g, unknown or other
  modified_base (284)..(284): a, c, t, g, unknown or other
  modified_base (359)..(359): a, c, t, g, unknown or other
  modified_base (393)..(393): a, c, t, g, unknown or other
tcagacgcgatcgacacgaccggtgctcgatttagctcgatatagttgggtttgggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccagganacagcctcagagggcactatgcaaactggtaaccaacagaacgccggacacggcccctntacttgcatgttaggtaaaaccgccggccctcgggactccagaccgagtctcgtcgcctccacctacagaacacngcttcctacgacatcacgtggactcgagcggaangtgaggctagactagttatcgacagcacgtccggacaaccgtaaattaaagtcggttttaaactcggttttacccggacccgggtacccccggggtaaacccgtaaacgggtttccccgtaaaccccgggtttacccgttcgggggttaccctaaacccgggtacccccgtaaaaacccgggggtaacccccccaaaaacccccccggttaacccgttcccggtttaacccgtaacccccgttttaccccgtttccccgtttaaaccccccccgttacccccgttttaccccccg

SEQ ID NO: 394194 - DNA, 659 bp, Homo sapiens
  misc_feature: GZ8MTXP02IA95A.45.57.F02.1.454.CMB.2.raw
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcagagggcactatgacaaactggtaaccaacagaacgccggacacggcccctctactgtcatagtttacggtaaaacgaccggcccctccgggactcccgagaccgattcctctcggcctacccacctacaacggaaaccacacgtcctttccgttacgaccctatccgacgtcggggacctcgacgggacggaagagtaggacggctagaacttagttattgactacgctacgtaccgggaaccaacctaaataagttggttagttcgtttaccggccggtacccgggtaccgtaacggtaccgtacccgttccgttacggtaccgtaccggtaccccgaaaccgggtaccccaaaacccccgtaacgttaccggtaccctacccgtttaccgtaccccggtttcccccggtacccctttccccg

SEQ ID NO: 394195 - DNA, 615 bp, Homo sapiens
  misc_feature: GZ8MTXP02F3SQR.45.57.F02.1.454.CMB.2.raw
  modified_base (236)..(236): a, c, t, g, unknown or other
  modified_base (289)..(289): a, c, t, g, unknown or other
  modified_base (362)..(362): a, c, t, g, unknown or other
tcagacgcgatcgacacgaccggtgctcgatttagctcgatatagttgggtttggggagctgtgggctcagaagcagagttctgggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctnaggagggcactatgacaaactggtaaccaacagaagccgggacacggcccctntactgtcatgtttaggaaaaacgccggccctccgggactcccgagaccgatctctcgctccactcagaacacngctctgaccatcactgggactcgaggcgaagatgaggctgactattatgacagacacgtaccggaacaaccaaataacgttggttaacttcggttttacggccggtaacccggggtaaccgtaaaacggttccgtaacccggtttccgttacgggtaccaaccggaccccgtaaaacgggaccccctaaaacccctaacgttccggtaccctaaccgttcccgtttacccggttcccccgcccctttaccccg

SEQ ID NO: 394196 - DNA, 725 bp, Homo sapiens
  misc_feature: GZ8MTXP02IW8RV.45.57.F02.1.454.CMB.2.raw
  modified_base (360)..(360): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaacgccgggacacggcccctctacttgtacatgtttaggaaaaaccgccggccctccgggactcccaagaccgattctctcgcctccactccaggtaaaccanacgtaccttccttgacccatcacgtcgggactcgacgggacggaaagagtagagggactaggtaacttaattaacgtcgacgtacgacgacgttacccggggaacaaacccgtaaaagttaccgtaggttttaacgttcggttttaccggaccggtaccccgggggtaaacccgtaaacgggttaccccgtaaaccccgggttcccgttaaccgggttacccgtaacggtaaccccccggaaaaccgggaaccccctaaacccccgtacccgttaccggttaccctaaacccgttaaccgtttccccggttacccccggtcccccgttaccccttcccggtttaaccccggacgtttcccccggg

SEQ ID NO: 394197 - DNA, 522 bp, Homo sapiens
  misc_feature: GZ8MTXP02H4OX6.45.57.F02.1.454.CMB.2.raw
  modified_base (287)..(287): a, c, t, g, unknown or other
  modified_base (474)..(474): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcaaggacgggcactatgcaaactggtaaccaacagaagccggacacggcccctntactgtcatgtttaggaaaacgccggcctcgggatcccagaccgatctctcggctccacctcaggaaacacagcttactcgaccatcacgtggacctcgaggcgaagatgaggctagactattactgactagcagtcggacacaatactgtattgttcgcgccggacaacggtcacgtcttcggacncgacccgacgccaacccaacgtcgtactactcctcgttcccgccctcc

SEQ ID NO: 394198 - DNA, 523 bp, Homo sapiens
  misc_feature: GZ8MTXP02JY5C6.45.57.F02.1.454.CMB.2.raw
  modified_base (277)..(277): a, c, t, g, unknown or other
  modified_base (514)..(514): a, c, t, g, unknown or other
tcagacgcgatcgacacgaccggtgctcgatttagctcgatatagttgggtttgggggctcagaagcagagttctggggtgtctccaccatggcctggaccccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctntactgtcatgttacgtaaaaacgccggccctccggactcccagaccgattctctgcctccactccagaacacagcttccttgccatcacgtgggactcgacggcggaaacgagtggaggctgacttatattgcagcagtaccgggacaaccaataagtgttattgttcgcggaccggacaagtccacgtctgtcacgccacgccacccactcgtaccactctccgtcccgccctccnctacgctcg

SEQ ID NO: 394199 - DNA, 608 bp, Homo sapiens
  misc_feature: GZ8MTXP02HTSLA.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaactggtaccaacagaagccgggacacggcccctctactgtcatgtttaggaaaacgccggccctccggatcccgagaccgtattctctggcctccacctcaggaaaccacacgcttcctgacccatcacgtcgggactcgacggacgaacgatggagctgaacttacttattgacagacaacgtaccgggaactaaccgaaattaaagtggtttaattcggttttaccgaccggaccccggggtaacaaacggttcctacccgttaccgttcgggtacacggtaccccgaaacggacccctaaaccccgactccggtacccacgttcccgttcccccgacccttcctccgtcgacttccgtccg

SEQ ID NO: 394200 - DNA, 589 bp, Homo sapiens
  misc_feature: GZ8MTXP02GZW07.45.57.F02.1.454.CMB.2.raw
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcgagagggcactatgacaaactggtaaccaacgagaacgccgggacacggccccctagtaccttgtcattgtttacggaaaaaccgccggcccgtaccgggactccccaagaccgattcctctcggcctccacctcgaacggaaaccacagtccttcctcgacctatcacgtgggactcgaaggcgaagagtgagctagactagttatgacagcgagtaccgggacaccgaaatagttgttacttgtttcggcgtacccgggacacggtccaccgttccgtacggtcaaccgtcccgaaacggccccaaacccgtaacgtcgtaccgacctctaccgttaccccaccctttacccg

SEQ ID NO: 394201 - DNA, 510 bp, Homo sapiens
  misc_feature: GZ8MTXP02IAHUE.45.57.F02.1.454.CMB.2.raw
  modified_base (358)..(358): a, c, t, g, unknown or other
  modified_base (485)..(485): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggaccaacagaagccgggacaggcccctctactgtcatgtttaggtaaaacgccggccctcgggactcccagaccgatctctcgctccacctcaggaaaccacngcttccttagaccatcactgggactgaggcgaagatgagctgactattatgacagcactccggacacaatatgtattgttcgcgaccggacaaggtcaccgtctcggtcacgccaacgcccaacccnctcgactactcgtcttcccacctcc

SEQ ID NO: 394202 - DNA, 552 bp, Homo sapiens
  misc_feature: GZ8MTXP02IQ2WZ.45.57.F02.1.454.CMB.2.raw
  modified_base (230)..(230): a, c, t, g, unknown or other
  modified_base (367)..(367): a, c, t, g, unknown or other
  modified_base (429)..(429): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttggggacagacagtcaagatcacatgcccaacgganacagcctcgaggagggcactatgacaaactggtaccaacagaagccggacacggcccctctactgtcatgttaggaaaacgccgccctaccgggactcccagaccgatctctcggcctccacctcaaggaaaccacngcttccctagacccatcaacgtggactcgaggacggaagactggagcctagacttattagtncagcacgtaccggacacaaagtatggttatcgtttcgcgaccgggacacggtcaccgttctcgtacacgcccaaacggcccaaacccctgtcgtaccacgtcctaccgttcccgcccttcccg

SEQ ID NO: 394203 - DNA, 742 bp, Homo sapiens
  misc_feature: GZ8MTXP02GEVML.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcaggaggcactatgacaaactggtaccaacagaacgccgggacacggcccctctactgtcatgtttacggaaaacgccggcccgtaccggactcccgagaccgtattcctcgtcggcctcctactccgacggaaaccacacgtccttccttacgaccctatactacgtcggggactcgacgggacggaaagagtacggagacgtacgtaacgttattaagttacggacgtacgaccgtaacgtacccggggaaacctaaacccgtaaaagttaaacgtttacgggtttaacgtttacggttttaccgggacccggtaccccggggtaaacccgtaaaccgggttacccgtaaccccgggtttacccgttaacgggttcccgtaaaccggacccccggaaaccggggaaccccctaaacccccgtaaccgttacccgtacccgtacccttaacccgttccccggtttaaccccctaacccccttcccggttacccttacccgtaccgtttaccccgg

SEQ ID NO: 394204 - DNA, 521 bp, Homo sapiens
  misc_feature: GZ8MTXP02ISWVB.45.57.F02.1.454.CMB.2.raw
  modified_base (334)..(334): a, c, t, g, unknown or other
  modified_base (353)..(353): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaaactggtaccaacagaagccgggacaggcccctctacttgtccattgttaggtaaaaacgccggccctaccgggatcccagacccgattcnctggctccacctcagaacncagcttccttgccatcacgtggactcgaggcgaagatgagctgaacttattattgcagcagtccgggacaccaatatggttatgtttcgcgccggacaagtcaccgtctcggtcacgccacggcccaacccactcgtcactcgtcgtcccgccctctcctcgactccg

SEQ ID NO: 394205 - DNA, 677 bp, Homo sapiens
  misc_feature: GZ8MTXP02I9W24.45.57.F02.1.454.CMB.2.raw
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctacgaggagggcactatgacaaacgtcggtaaccaacgaagaacgccggacacggcccctatacttgtcagttgtttaacggaaaaaccgccggccctaccgggactacccgaacgaccgtattcctcgtcggcctacccaccgtacgaaacggaaacacacggtcctttaccgtacgaccctataccgacgtcgggacctcgaggacggaaagagtagaggcctaggtaacttattagttgacagcacgtaccgggaacctaaccgtaaagtacgttaggttacttcggtttaccgacccggtacccgggtaaccgaacggttacccgtacccggttccgttacggtaaccgaccggaaccccgtaacccggaacccctaaccccgtaaccgttaccgtaccgtaccttacccgtttcccgttaccccctaccccgtttccccg

SEQ ID NO: 394206 - DNA, 622 bp, Homo sapiens
  misc_feature: GZ8MTXP02H47SW.45.57.F02.1.454.CMB.2.raw
  modified_base (277)..(277): a, c, t, g, unknown or other
  modified_base (377)..(377): a, c, t, g, unknown or other
tcagacgcgatcgacacgaccggtgctcgatttagctcgatatagttgggtttgggggctcagaagcagagttctggggtgtctccaccatggcctggacccctctctggctcactctcctaactctttgcatagggtctgtactttcttctgggctgactcaggagtctgctgtgtctgtggccttgggacagacagtcaagatcacatgccacggagacagcctcagagggcactatgacaaactggtaaccaacagaagccggacacggccccnctacttgtacagtgtttacggtaaaaacgcccggcccgtaccgggactccccagaccgattctctcggctccacctcacgaaacacagccttcctgaccntcactgggactcgaggcgaagatgagctgaactatttattgctagacacgtaccgggacctaaccaaataagttaggtttattacgttttcggaccggtacccgggaccgtaacgggtccttaacccggtcgttacggtaccgtaacggtaccccgaaacgggacccaaacccccgtactaccgtacctaccgttcctaaccggttcccccaccccttccgtccctaccgtacgttccgtcccgg

SEQ ID NO: 394207 - DNA, 575 bp, Homo sapiens
  misc_feature: GZ8MTXP02JL37D.45.57.F02.1.454.CMB.2.raw
  modified_base (425)..(425): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtgccttgggacagacagtcaagatcacatgaccaggagacagcctcaggagggcactatgacaaactggtaaccaacagaacgccgggaacacggcccctactacttcgtcagtgtttacggtaaaaacgaccggccctaccggggactcccacgaccgattctactcggcctaccacctcacggaaacacagccttactacgaccatacgactacgggactcgacggacggaaganggagctagacttatagttcgacagcacgtaccggacacaaatagtacgttatcgtttcgacgtaccggaacgaacgtcgtaccgtcgttcgacgtacgacccaacggacccaaccaacgtactacaccgtctaccgttacccaccttccc

SEQ ID NO: 394208 - DNA, 649 bp, Homo sapiens
  misc_feature: GZ8MTXP02IJVOY.45.57.F02.1.454.CMB.2.raw
  modified_base (230)..(230): a, c, t, g, unknown or other
  modified_base (294)..(294): a, c, t, g, unknown or other
  modified_base (377)..(377): a, c, t, g, unknown or other
  modified_base (428)..(428): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttggggacagacagtcaagatcacatcgccaacgganacagcctcgaggaggcactatgacaaactggtaaccaagagaaggcccgggacacggccccctntactgtcatgtttaacggaaaaccgccggccctaccgggactcccgagaccgattctcgtcgcctccgactcgaggaaaaccncaggtccttaccttacgacctactcacgtaggacctgacggacggaagagngagcctagtacttagttatgacacgcgtacgtcccgggaactaccgtaaagttaagttaggttacgtttacggttttcggacccggtaccccgggtaaccgtaaacgggtacccgtaacccggttccgttacgggttaccgaaccggtaccccgaaaccgccccgtaaaccccgaacgttccgtacctaccgttacctcccgtttaccccctccgttcccg

SEQ ID NO: 394209 - DNA, 538 bp, Homo sapiens
  misc_feature: GZ8MTXP02IID4F.45.57.F02.1.454.CMB.2.raw
  modified_base (329)..(329): a, c, t, g, unknown or other
  modified_base (387)..(387): a, c, t, g, unknown or other
  modified_base (492)..(492): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgacaaaactggtaccaaacagaagccgggacaggcccctctactgcatgttaggaaaaacgccggccctaccggatcccagaccgattcnctgctccactcaagaacacagcttcctcgaccatccacgtggacctgagggcgaaagnagagctagactattatgacagacagtaccggacaacgaatatgttatgtttcgcgccggacaacggtcaccgtctcggtacacgacccgaacggaccccaacccncgtacgtccacctccttccgtaccccacccttcctctacgactccg

SEQ ID NO: 394210 - DNA, 628 bp, Homo sapiens
  misc_feature: GZ8MTXP02HQCI4.45.57.F02.1.454.CMB.2.raw
  modified_base (214)..(214): a, c, t, g, unknown or other
  modified_base (283)..(283): a, c, t, g, unknown or other
  modified_base (501)..(501): a, c, t, g, unknown or other
  modified_base (519)..(519): a, c, t, g, unknown or other
tcagacgcgatcgacacgaccggtgctcgatttagctcgatatagttgggtttgggggaggtgtgtcacaagatttggagatggttttctcgatgggggctgggagggctttgttggagaccttgcacttgtactccttgccgttcagccagtcctggtgcaggacggtgaggacgctgaccacacggaacgtgctgttgtactgctcctccgnggctttgcttggcattatgcacctccacgccgtccacgtaccacttgaactggacctcggggtcttcgnggctcacgtccaccaccacgcacgtcgacctcgagggtaccggaaatcaagtaaggtatccgttggggtttggggaaagaggaagacgtgaccgattaccgcgaacaacgtaccaacaacactaacgtttcctagaacctaagtagggttaaattagaaaactccgaacgacacggcgttactaacttactgtgacgagtacggtcccgtaaccccgngtctacgacagtcggacncccgtagagtacgtcgggtggggaccgaacgggtaccgtggactagttcgacctacccgtccgtactaaccgaaccgaacggtccctacgttcccgtccttccccgtcg

SEQ ID NO: 394211 - DNA, 697 bp, Homo sapiens
  misc_feature: GZ8MTXP02G5PPY.45.57.F02.1.454.CMB.2.raw
  modified_base (242)..(242): a, c, t, g, unknown or other
  modified_base (261)..(261): a, c, t, g, unknown or other
  modified_base (386)..(386): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtacttttcttctgggctgactcaggagtctgctgtgtctgtggccttgggacagacagtcaagatcacatgccacggagacagcctacaggagggcactangacaaactggtaaccaaanaggaacgccgggacacggcccctctactgtcatgttaggtaaaaacgccggccctccggactcccgagacccgattacctcgtacgcctccactaccgaacggaaacacacgtccttaccgttanaccctataccgtaccgtacggggaccttacggaaacggggaccgggaaaagtagtaggaaacgggcccgtaggtaaccgtttaattagttacggaccgtaacgaccgtaacggttaccccgggggaaaccaaacccgttaaaacgttaaaggtttacggtttaaaggtttcgggtttttacccggccgggtaacccccgggggtaaccgtaaacggggttcccaacccgttcgttacggtaccgacgtacccgaaacgcccaaacccgactacgcctactaacgtctacccctacctcctctcgacttccg

SEQ ID NO: 394212 - DNA, 742 bp, Homo sapiens
  misc_feature: GZ8MTXP02IFLJY.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctggtgccttggacagacagtcaagatcacatcgccacggagacagcctcgaggagggcaactatcgacaaacgtcggtaaccaaacgaggaacggcccgggaacaccggccccctactacttgtactagttaggtttaacgggtaaaaaccgcccggaccccgtaccggggactaccccgaacgaccgtattcctcgcggcctaccacctaccgaacggaaacacgtacgtccgttaccttacgacctactcacgttacgggacctcggagggacggaaagacgtaggacgacgtagtaacttagttacgtcgacacgactaaccggtacccgggaaacctaaaccgtaaaagtttaaagttacggtttaacgttcggttttaccggaccccgggtaacccggggtaaacccgtaacgggtaccctacccgggttaccgttacgggttacccgaacggaccccggaaaaccgacccccgaaaccccgtacgtacccggtacctaaccgttccgttccccggtacccccgtccccttaccggtaccctcggtaacccgtcccggg

SEQ ID NO: 394213 - DNA, 501 bp, Homo sapiens
  misc_feature: GZ8MTXP02FLRN8.45.57.F02.1.454.CMB.2.raw
  modified_base (468)..(468): a, c, t, g, unknown or other
  modified_base (493)..(493): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaaactggtaccaacagaagccgggacaggcccctctacttgtcatgttaggtaaaaacgccggccctcggatcccagaccgattctctgctccacctccagaaacacagcttccttgccatcactgggactcagggcgaagatgagctgactatatgcagcatccggacacaataatggttatgtttcgcgccggacaaggtcacgtctgcagccacgccaacccnctcgcactctcgtcccgcctcctcncgactccg

SEQ ID NO: 394214 - DNA, 514 bp, Homo sapiens
  misc_feature: GZ8MTXP02FX06A.45.57.F02.1.454.CMB.2.raw
  modified_base (213)..(213): a, c, t, g, unknown or other
  modified_base (400)..(400): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctggtggccttgggacagacagtcaagntcacatgccaggagacagcctcaggaggcactatgcaaactggtaccaacagaagccgggacacggcccctctacttgtccatgtttaggtaaaaacgccggccctaccgggatcccgagaccgattctctcggctccactcaggaaaccacagcttcctgaccatcactgggactcgaggcggaanatgaggctagactattatgcagcatccggacacaatactggttatgtttcgcgtccggactagcacgtctgtcacgtccacgcccaccaactcgacactctacgtcccgctccc

SEQ ID NO: 394215 - DNA, 638 bp, Homo sapiens
  misc_feature: GZ8MTXP02JJ6KI.45.57.F02.1.454.CMB.2.raw
  modified_base (281)..(281): a, c, t, g, unknown or other
  modified_base (329)..(329): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcaggagggcactatgacaaactggtaaccaacgagaagccgggacacggcccctntactgtcatgttacgtaaaacgccggcctaccggatccagaccattcnctgctccactccgagaaacacacgtccttaccgtcgaccatccacgtcgggactcgagggcggaaagataggagctagtaacttattatgacagcacgtacccgggacaaactaaacgttagttaggtttacgttcggttttaccggaccgggtaccccggggaaccgtaaacgggttccctaacccggttccgttacggtaccgacgacccgaaaccgggaccccaaacccccgtacgttccggtacctacccgtaaccgttacccgttaccccctaccccttcccttaccgtccgtaacgttcccgg

SEQ ID NO: 394216 - DNA, 693 bp, Homo sapiens
  misc_feature: GZ8MTXP02HQQIW.45.57.F02.1.454.CMB.2.raw
  modified_base (235)..(235): a, c, t, g, unknown or other
  modified_base (286)..(286): a, c, t, g, unknown or other
  modified_base (361)..(361): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagccctnaggagggcactatgcaaactggtaaccaacagaagccgggacaggcccctntacttgtcatgttaggtaaaacgccggcctccgggatcccagaccgattctctcggctccacctacaggaaaccnacgcttcctgaccatcaacgtgggactcgaggcggtaaagatggaggtcgtaggaaccttagtttaacgttcgactaacggccgtaaacgttcccgggggaaacctaacccgtaaaagttaaagttacggtttaagttcggtttttaaccggccgggtacccccggggtaaaacccgtaacggggttacccgttaacccgggttcccgtttacgggttaccgtaaccggacccccgtaaacggggtaacccccaaacccccgtaaccgttacccggttacccgtaaacccttaccccgttaccgtttaccccccgggtacccctttcccccg

SEQ ID NO: 394217 - DNA, 657 bp, Homo sapiens
  misc_feature: GZ8MTXP02I07T1.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaaacagaaagccgggacacggccccctctactgtcatgttaggtaaaaacgccggccctccggatcccagaccgattcactcgcctccacctcaacgaaacacagtcttcctgaccatcactggacctcgagggcgaagatggaggctagacttattattggacagactagtacccgggaacaacccaaattaagttaggtttaatttgttttcccggaccggtacccccgggaaccgtaaacggtcccgtaacccggtttcccgttacgggttacccaccggttacccccgaaaccgggtacccccaaaacccccggaccttacggtacccctaaccgttccgttccccggttaccccccggtcccccttcccgttcccgttaccggtaaccgtttcccccggg

SEQ ID NO: 394218 - DNA, 564 bp, Homo sapiens
  misc_feature: GZ8MTXP02HGSHS.45.57.F02.1.454.CMB.2.raw
  modified_base (226)..(226): a, c, t, g, unknown or other
  modified_base (288)..(288): a, c, t, g, unknown or other
  modified_base (556)..(556): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccagganacagcctcaggagggcactatgacaaactggtaaccaacagaacgccggaacacggcccctntacttgtcatgtttacggaaaacgccggcctcgggactccacgaccgtatctctcgcctccacctacgagaaaccacacgtccttacctcgaccatcactgggactcgaggcgaagagtgagctgacttatagttcgacacgcacgtaccggacaaccgtaataagtggttattcgttcggccgtaccggactacggtcctaccgtcgttcggacgaccgacccgaacggcccctaacccgcgtcgtacctactccgttccgtccccncccttccg

SEQ ID NO: 394219 - DNA, 835 bp, Homo sapiens
  misc_feature: GZ8MTXP02JADL4.45.57.F02.1.454.CMB.2.raw
  modified_base (362)..(362): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgccaacggagacacgcctcgaggacgggcaactatcgacaaaacgtggtaaccaaacgaggaacggccgggaccacggcccctactacttgtacagttcggtttaacggtaaaaaccgcccggcccgtaccgggactacccgacgaccgtnttctcgtcgctaccacctaccgaacgaaacacgtacgtcctttacccgttcgacctacgtacctaacggtccggactcgacgggacgaagagtaggacggtactaggtaaactttaagttagttacgacgacgaccgtaaccggttacccggggaaacctaaacccgtaaaagtttaaccgttagggtttaacgttttaccgggtttacccggacccggggtaacccccgggggttaaacccgtaaaccgggggtttaccccgtaacccgggtttacccgtttttacgggggtaacccgtaacccgggtaaacccccggaaaacccgggggtaacccccctaaaaccccccggtaaccgtttcccgggttaacccgttaaacccccgtttcccgtttacccccgggtttaaacccccccgttacccccctttacccggtttaccccgtacccggttaaaccgtttcccccggg

SEQ ID NO: 394220 - DNA, 536 bp, Homo sapiens
  misc_feature: GZ8MTXP02FOW4Z.45.57.F02.1.454.CMB.2.raw
  modified_base (203)..(203): a, c, t, g, unknown or other
  modified_base (276)..(276): a, c, t, g, unknown or other
  modified_base (351)..(351): a, c, t, g, unknown or other
  modified_base (386)..(386): a, c, t, g, unknown or other
  modified_base (407)..(407): a, c, t, g, unknown or other
  modified_base (434)..(434): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtacttcttctgggctgactcaggagtctgctgtgtctgtggccttgggacagacagtcaagntcacatgccacggagacagcctcagaggcactatgcaaaactggtaccaacagaagccgggacaggccccctntacttgtcatgttggtaaaaacgaccggccctccgggatccccagaccgattctctggctccactccaggaaacncagcttccttgccatcactgggactcaggcgaaanatgaggctgactattattgcngcatccggacaccaataaatggtttangttttaccgcggcccgggaccaaaggtcaccgtcctggtccagccccaaaggcccaaacccccactcgtcactcgtcgttccccaccctcctctccgatccg

SEQ ID NO: 394221 - DNA, 664 bp, Homo sapiens
  misc_feature: GZ8MTXP02GZO7P.45.57.F02.1.454.CMB.2.raw
  modified_base (229)..(229): a, c, t, g, unknown or other
  modified_base (280)..(280): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgaccacggagacagccctnagagggcactatgcaaactggtaaccaacagaagccgggacacggcccctntactgtcatgttaggaaaacgccggccctccggactacccagacccgtattcctcgtcggcctaccacctaccacggaaacacgacgtccttacctgaccatctacgtcggactcgagggacgaaagctaggagctagtactagttagtgtacgagcgaacgtaccggaaccaaaccgtaattaacgttggtttaactttggtttaccccggacggtacccccggggtaacctaaacgggtccctaacccggtttccgttcggtaccgaaacccggtaccccgaaaccgggaaccccctaacccccgtacgttaccggtacctaacccgtcgtttccccgttacccccgtccccttccccgttccgtacccgtacgttccccgg

SEQ ID NO: 394222 - DNA, 782 bp, Homo sapiens
  misc_feature: GZ8MTXP02JEBCD.45.57.F02.1.454.CMB.2.raw
  modified_base (228)..(228): a, c, t, g, unknown or other
  modified_base (240)..(240): a, c, t, g, unknown or other
  modified_base (290)..(290): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggganacagcctcgagngggcactatgacaaactggtaaccaacagaacgccgggacacggcccctntactgtcatggtttaaggtaaaacgccggccctaccgggactcccgacgaccgtatctctcgcctccgacctacgacggtaaacacacgtccttaccgttacgacccgtacttaccgaaaccgtcgggggaaccttacggaacgggacggaaacggagttacgggaaacggtccgttaacggtaacctttaacgtttagtttacggtaccgaacgtacccgaacgggtttacccccggggaaacctaaaacccgttaaagttaaaccggtttagggtttaacgtttacggtttttacccgggaccccgggttacccccgggggtaaaccgtaaaccggggttaccctaaccccgggtttcccggtttaaccggggtaccctaaacccgggtaacccccgtaaacccggggaaccccctaaaccccgtaaccgttaccggtacccttaacccgtcccgtttacccggttccccccggtaccccctttcccccg

SEQ ID NO: 394223 - DNA, 567 bp, Homo sapiens
  misc_feature: GZ8MTXP02FM6D5.45.57.F02.1.454.CMB.2.raw
  modified_base (276)..(276): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaagccgggacaggcccctntactgcatgtttaggtaaaaacgccggccctccgggatcccagaccgatctctgctccacctccagaaacacagcttccttgaccatcacgtgggactcgaggcgaaagatgaggctagacttattattgacagacacgtaccgggaacaacctaaataagtggttaattgtttccgaccggtcccgggaacctaaacggtccaaccgtccgttaggtacacgacccgaaacggccccaaacccactacgtccacctctaccgttaccccaccctcctaccgtcgactccg

SEQ ID NO: 394224 - DNA, 657 bp, Homo sapiens
  misc_feature: GZ8MTXP02INYP7.45.57.F02.1.454.CMB.2.raw
  modified_base (226)..(226): a, c, t, g, unknown or other
tcagacgcgatcgacacgaccggtgctcgatttagctcgatatagttgggtttggggagctgtgggctcagaagcagagttctggggtgtctccaccatggtctggacccctctctggctcactctcctcactctttgcatagggtctgtactttcttctgggctgactcaggagtctgctgtgtctgtggccttgggacagacagtcaagatcacatgccagganacagcctcaggagggcactatgacaaactcggtaccaacgagaacgccgggacgacggccccctactacttgtctagttaggtttaacggaaaaaccgtccggccccgtaccgggactcccgacgaccgtattaccgtcgtccggcctacccaccgtacgaacggaaaccaccacgtccttccttacgacctactcgacgtcggggactcgaggacggaagagtgaacgcttagaacttattacgtacacgacgacgtaccgtacgggaacccaacgtaaacttagttacggttaacgttcggtttccggaccgggtaccccggaacgtaaccggtccgtacccgttcggttacggaaccgacgtaccccgaaacggccccaaaccccgaagttaccgtacctacctcgttcccgtccccgtccctacccg

SEQ ID NO: 394225 - DNA, 630 bp, Homo sapiens
  misc_feature: GZ8MTXP02HJBJT.45.57.F02.1.454.CMB.2.raw
  modified_base (219)..(219): a, c, t, g, unknown or other
  modified_base (415)..(415): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctggtggccttgggacagacagtcaagatcacatgccagganacagcctcaggagggcactatcgacaaactcggtaaccaacgagaagccggacacggcccctctactgtcattgttacggaaaacgccggcccgtaccggactcccaagaccgtacttctcgtcgcctccacctccgaacgaaacacgacgtccttacctacgacctactcacgtcggacctcgagggcggaaagngtgacgtctacgaactttagttacgtcgactacgacacgtaccggaacctaaaccgtaagttaaagttggtttattacgtttccggaccggtacccgggtacaaacgggtcctaccgttcgttacggtaccacggtacccaaccggacccaacccgtactccgacctaccgttccgttcccgttccccgtcccgtccttccgacgtacttcccgg

SEQ ID NO: 394226 - DNA, 718 bp, Homo sapiens
  misc_feature: GZ8MTXP02JFIYY.45.57.F02.1.454.CMB.2.raw
  modified_base (219)..(219): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacgganacagcctcgagagggcactatgacaaactggtaaccaacagaacgccgggacacggccctctactgtcatgttaggaaaaccgccgcccgtacggactccacgaccgtatctactgcctaccgacctcgacgaaacacacgtcttaccttcgaccctataccgacgtcgggaacctcggaacgggaccggaaagacgttaggaacgggcttacggtaactttaattagttacgtacgtaacggacctaacggtaccccggggaaacctaaacccgtaaaaagtttacgtttaacgggttttacgtttacggttttacccgggacccgggttacccccggggaaccgttaaccgggtacccgtaaccccggttccgttacgggtaccaccggacccgtaaaacccgggacccctaaaaccccgtaccgttacggtaccctaaccgttcccgttacccgttaccccctacccgttccctccgtacccggtactttccccgg

SEQ ID NO: 394227 - DNA, 922 bp, Homo sapiens
  misc_feature: GZ8MTXP02HLN1P.45.57.F02.1.454.CMB.2.raw
tcagacgcgatcgacacgaccggtgctcgatttagctcgatatagttgggtttgggggctcagaagcagagttctggggtgtctccaccatggcctggaccccctctctggctcactctcctcactctttgcatagggtctgtacttttcttctgggctgactcaggagtctgctgtgtctgtggccttgggacagacagtcaagatcacatcgccgaacggagacagccctacgaggagggcaactatagacaaaacgtcggtaaccaaacgaaggaacgcccggggaacaccggccccctacgttaccgttggtacctaagtttacggttttaaaccgggtaaaaaacccggtaccccggggacccccgtacccggggtaaccttacccccgaacggtaacccgtactttcccgtcgtccggccctacccctaacccgtacccgaaaacgggaaaaaccacccgtaacggttacccttttacccgttacgaaccctaactacccgtaacggttaccgggggtaacccttaccgggaaacgggaaccgggaaaagtaacggttaacgggaacggtacgtaacgtaacccgttttaaacgtttaagttacgaaccgtaaccggaccgtaaacccggttaaccccggggaaaacctaaaacccgtaaaagtttaaaaggttcgggttttaacggtttaccgggttttacccgggacccggggtaacccccggggtaaacccgttaaaaccggggttccccgtaacccggtttcccggtttaccggtacccggaacccggtacccccgtaaaaccggaacccccgaaaccccttaccgtaccgtacccttaacccgttccccgttaccccggtttccccccggtacccccgttaccccttcccgttacccgtaccggttccccg

SEQ ID NO: 394228 - DNA, 675 bp, Homo sapiens
  misc_feature: GZ8MTXP02H8DZU.45.57.F02.1.454.CMB.2.raw
  modified_base (553)..(553): a, c, t, g, unknown or other
tcagacgcgatcgacacgaccggtgctcgatttagctcgatatagttgggtttgggggaggtgtgtcacaagatttggagatggttttctcgatgggggctgggagggctttgttggagaccttgcacttgtactccttgccgttcagccagtcctggtgcaggacggtgaggacgctgaccacacggaacgtgctgttgtactgctcctccgcggtctttgtcttggcattatgccacctccacgccgtccacgtaccacttgactggacctcgggtctcgtgctcacgtccaccaccacgcacgtcgacctcgacggggtccggaaatcgaagtaacggtcttccgtttggggtttaggggaagaggaagacgtgacccgagtaccgacgacaacgtaccaacaacacgtagttaccgtagacgtaagtacgggttaaatttacgaaacgtcccgaacgacgtaccggccgttactaccgtactggttcgacgtacgttacgggtcccccgtaacccacgtctccggctagtcggacgcccttaggaacgngtaccgggtcgggggacctaacggggtaaccccttggggtcctagttcgtcctaaccccgtcgtacccttaaccgaacccgaacggggtcccctacggttcccggttcccgttcccccgcgg

SEQ ID NO: 394229 - DNA, 616 bp, Homo sapiens
  misc_feature: GZ8MTXP02HW7IK.45.57.F02.1.454.CMB.2.raw
  modified_base (228)..(228): a, c, t, g, unknown or other
  modified_base (288)..(288): a, c, t, g, unknown or other
  modified_base (337)..(337): a, c, t, g, unknown or other
  modified_base (360)..(360): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttggggacagacagtcaagatcacatgccacgganacagcctacaggagggcactatgacaaactggaaccaagagaacgccggacacggccctntactgtcatgttacgaaaacgccggtcctcgggatccgagaccgattcnctcgcctaccactcgaagaaccncgacgtcttcctagacctatacacgtcggactacgaggacgaagactagagtctagtaactattagtgatacgactacggttacccgggaacaaccgtaaagttaagttaggttaactttcgggtttaccgccgggaaacccgggtacgaacggttcccgaaccggtttcccgtacggttaccgaccgtaccccgaaacggtcccccaaacccggaactcgtacccacttccgttaccgttcccctacccgtcccg

SEQ ID NO: 394230 - DNA, 616 bp, Homo sapiens
  misc_feature: GZ8MTXP02JA8FG.45.57.F02.1.454.CMB.2.raw
  modified_base (271)..(271): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgaggcctcctatgaggtgacacagccacctcggtgtcagtgtcccaggacagacggccaggatcacctgctctggagatgctttgccaacacaatatggttactggtaccagcagaaggcggcaggccctntatgataatatatctggactacgtaagacggccctcgacggggactccctgacgcgtattcgtcgtacggcctcgagcgcgaagggaaccacgtgtaccacgtacttacgacctatacctaagttcggacgtacccgaacgtccgtaggacggtacgacgggtactaggaacttattaaccgtgtacctaagtacgaaggttacgaccgacccacctaacgtacctaccgaacggtccgacggttaccgggacggaacgggaacccaaacggtcgttaaccggtccgttaccgtcggtaccaacggacccgaaggtcccgtccgcccccgtcggtacctacccgg

SEQ ID NO: 394231 - DNA, 721 bp, Homo sapiens
  misc_feature: GZ8MTXP02GHV79.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctggtggccttgggacagacagtcaagatcacatcgccacggagacagcctcaggaggcactatgacaaactggtaaccaaacagaacggccgggacacggcccctctactgtcatgttaggaaaaccgccggcccgtccggactcccagacccgattctctcggcctaccacctccgaacggaaacacacgtccttccttacgacctatccaacgttcgggacctacgaacgggacggaaagagtacggacggtctaggtaaccttagttacgttacgacgaagaccgtaacgttacccggggaaactaaaccgtaaaagtttaaagttacgggttttaaacgttcgtttttacccggacccgggtaccccggggtaaccgtaaacgggttcccaacccgggtttccgttacgggtaccaccggtaaccccgaaaacccgggacccctaaacccccgtacgttacccggtaccctaacccgttccgttcccggttacccccggtacccccttccccgttacgtacccggtaactttccccggg

SEQ ID NO: 394232 - DNA, 707 bp, Homo sapiens
  misc_feature: GZ8MTXP02GBF1K.45.57.F02.1.454.CMB.2.raw
  modified_base (219)..(219): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacgganacagcctcagaggcactatgacaaaactggtaccaaacagaagccgggacacggcccctctactgtcatgttaggtaaaaacgccggccctcggactcccgagaccgattctcgtcgcctacctacctaccgaacggaaaccacgacgtccttaccttacgacctactactacgtacggggaacctcggaagggaccggaaagtacgtaggaacgggtctaacggtaaccgttagtttaacgttcggaacctacggtaccgaaacggttaccccgggggaaacctaaacccgtaaaacgtttaaaggtttacgggtttaaacgtttcggtttttaaccccgggaccgggtacccccggggaaaccgtaaacggggttcccctaaaccgggttcgtttacgggacctacggaccccgaaacggtacccctaaacccgactcgtacctaccgtccttcccgtaccccacccttcctccgtcgtacgtccg

SEQ ID NO: 394233 - DNA, 604 bp, Homo sapiens
  misc_feature: GZ8MTXP02FG2CV.45.57.F02.1.454.CMB.2.raw
  modified_base (278)..(278): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcgagagggcactatgacaaactggtaccaacagaagccgggacacggccctntactgcatgtttagaaaaaccgccggccctccggactcccagaccgatcgtctgctccacctccaggaacacagtccttccttgaccatcacgtgggactcgaggcgaaagatgaggctagaacttagtatgacgacgcgaacgtcccgggaaacaaccgtaaattaagttacggtttaacgtttcggtttaccgacccgggtacccgggtaaccgtacggtaccgtacccgttcgtttacggaccgacgacccgtaaacggccccaaaccctacgtacgtacctacctcgttacccgttcccgccccttccgcctacgcttccgg

SEQ ID NO: 394234 - DNA, 577 bp, Homo sapiens
  misc_feature: GZ8MTXP02FRG8S.45.57.F02.1.454.CMB.2.raw
  modified_base (227)..(227): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctnagagggcactatgacaaaactggtaaccaacagaaagccgggacacggcccctctactgtcatgtttaggtaaaaacgaccggccctccgggatcccagaccgatctctgctccacctccagaaacacagtcttccttgccatcactcgggactcgaggcgaaagatgagctagaacttatattgacagacacgtccggaacaccaaataagtcggttaattgtttaccgcgacccgggactaaacggtccaaccggttctcggtacacggtaccccaaaggccccaaacccacgttacgcctaaccgtccgtccgttccccggccccttacttccaccggtactcccgg

SEQ ID NO: 394235 - DNA, 614 bp, Homo sapiens
  misc_feature: GZ8MTXP02IYWIP.45.57.F02.1.454.CMB.2.raw
  modified_base (411)..(411): a, c, t, g, unknown or other
  modified_base (461)..(461): a, c, t, g, unknown or other
tcagacgcgatcgacacgaccggtgctcgatttagctcgatatagttgggtttgggggaggtgtgtcacaagatttggagatggttttctcgatgggggctgggagggctttgttggagaccttgcacttgtactccttgccgttcagccagtcctggtgcaggacggtgaggacgctgaccacacggaacgtgctgttgtactgctcctccgcggctttgtcttggcattatcgcacctccacgccgtccacgtaccacttgaactggacctcggggtcttcgtggctcacgtccaccaccacgccacgtgacctcgaggggtccggaaatcgataagggtatccgttggggtttaggggaagaggaagactgaccgattaccgcgacaagtccacaacacagtttccgngacaagtgggtaaatttgaaatccgacgacacggccgtactactactgtnacgagtggtcccgtacccagctcgcagtcggacgccctgagcgtcgtcgggggcacggggaaccctgggtccacgtttcggcctacccgtcccgtaccttcccgaaacccggaaacgggcccctaacgtcccggttcccgttcccccgtcggg

SEQ ID NO: 394236 - DNA, 582 bp, Homo sapiens
  misc_feature: GZ8MTXP02H2Q68.45.57.F02.1.454.CMB.2.raw
  modified_base (226)..(226): a, c, t, g, unknown or other
  modified_base (285)..(285): a, c, t, g, unknown or other
  modified_base (368)..(368): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccagganacagcctcagaggcactatgacaaactggtaaccaacagaacgccggacacggcccctntactgcatgttaaggaaaacgccggccctcgggactcccgagaccgtatctactcggcctacccacctacgaaggaaaccacngtccttaccttcgacctatcacgtcgggactcgaggacgaagatgagctgaactattatcgacagcacgtaccggaacacctaaataacgtggttacttcggtttacgaccggtacccggactaaacggtcctaaccggttccgttacgacgaccgtcccgaaacggtcccaacccgtaacgtcgtacacctcctaccgttccccaccttcccg

SEQ ID NO: 394237 - DNA, 722 bp, Homo sapiens
  misc_feature: GZ8MTXP02HOSAQ.45.57.F02.1.454.CMB.2.raw
  modified_base (448)..(448): a, c, t, g, unknown or other
tcagacgcgatcgacacgaccggtgctcgatttagctcgatatagttgggtttgggggaggtgtgtcacaagatttggagatggttttctcgatgggggctgggagggctttgttggagaccttgcacttgtactccttgccgttcagccagtcctggtgcaggcggtgaggacgctgaccacacggacgtgctgttgtactgcctcctccgcggtctttgtcttggctattatcgcctacctccacgtccgtccacgtaccacgttcgaacgtcggaccgtcggggtcttcggtcggtctcaccgtcccaccaccacgctaccgtgaccgtcggacggggtacggaaatcgaagtaaggggttcttccgggttttaggggtttacgggggaaagaagggtaacgtacgtacggaaccgtacgttacggacgaactaagtacccgaanaaccgtctacgtttcgagtaactaagtgggttaaattacgaaactcccggaacgtaccgaccggtccgttactacctacgtgtcgacgtacggttccgttacccgtacccagtcctacgcgtagtcgggactccgtagacgtacgtccggggtgggggacctaaccggggtacccgttgggtaaccttcggttacccgtccgtacccgttcccgtaccttaaccccggacgacccgggtaccctacgttccccggtcccctttccccggcccgg

SEQ ID NO: 394238 - DNA, 653 bp, Homo sapiens
  misc_feature: GZ8MTXP02GC60D.45.57.F02.1.454.CMB.2.raw
  modified_base (208)..(208): a, c, t, g, unknown or other
  modified_base (615)..(615): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcanatcgaccacggagacagcctacgagaggcactatgacaactggacaacagacgccggacacggccctctactgtcagtagtttacgtaaaaccgccggtacccgtaccggacgtcccgaacgaccgtacttcgtcgtacggcctaccctacctacccgaacggaaaccacgtacgtccttcctacgaccactctaacggtcgggactacggaacgggacgaaagtacgtaggtacggacgtaggtaaaccttagtttacgttacgacgtacggaccgtaaacggtacccggaacctaaaccgtaaagttaacgttaggttacgtttcggttaccgacccgggtacccggaaccgtaacgggtcctaccggtcgtacgtaccacgaccctacggaccctaccggtacncgtcctactccgtctccccgcctctccgtacgtcgtcg

SEQ ID NO: 394239 - DNA, 732 bp, Homo sapiens
  misc_feature: GZ8MTXP02JZ0TA.45.57.F02.1.454.CMB.2.raw
  modified_base (501)..(501): a, c, t, g, unknown or other
tcagacgcgatcgacacgaccggtgctcgatttagctcgatatagttgggtttggggagctgtgggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatcgaccacggagacagccctcgaggagggcactatcgacaaacgtcggtaaccaacgaaggaacggccgggaacaccggtccccctacttacgttcgtactagttacggtttaacggtaaaaaccggccccgggtaccccgtaccggggactacccgacgaccgtacttcctcgtcgcctaccacctacgacgaaacactacgtccttaccttacgaccatacacgtacgggacctacggaggacggaaagcgtaggacggtcgtagtaacttattagttcganacgctacggtacccgggaactaaccgtaaagttaagttacggtttaacgtttcggtttaccggacccgggtaccccggggtaaccgtaaaccgggttccgtaccccgggtttccgttacggggtaccctaaccggacccccgaaacccggacccccgtaaaacccccgtaacgttcccggttacctacccgtttcccgttacccgtttacccccctacccccgtttccccg

SEQ ID NO: 394240 - DNA, 751 bp, Homo sapiens
  misc_feature: GZ8MTXP02HZXFO.45.57.F02.1.454.CMB.2.raw
  modified_base (204)..(204): a, c, t, g, unknown or other
  modified_base (208)..(208): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagntcanatcgccgacggagacagcctcgaggagggcacgtatacgacaaacgtcggtaaccaacgacggaacgaccgggacacggcccctctacttgtcagttagttaacggtaaaaaccgccggaccccgtacgggactcccgacgacccgtattaccgtcgtcggcctacccgaacctaccgaaacgggaaaaccacacgttcctttacccttacgaccacttcctaacggtacgggtaacctacggaacgggtaccgggaaagtaacgtcggaacgtcgtaaggtaaacccttttaagttacgttacggacgtacgtacgtaacggtaccccgggaaactaaacccgtaaaagttaaacgtttagggtttaacgtttcggtttaaccggcccgtaaccccggggttaaccgaaacgggttcccgtaaccggtccgtttacggtaccgaaccggtacccggaaaccggtaacccctaaacccctcggtacctacccgtacctccgttaccggtccccttacccgtacctccgtacgtacgttcccgg

SEQ ID NO: 394241 - DNA, 736 bp, Homo sapiens
  misc_feature: GZ8MTXP02FKJII.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacggagacagcctcagagggcactatgcaaactggtaccaacagaacgccgggacacggccccctctacttcgtcatgtttaggtaaaaaccgacccggccctccgggactccccagacccgattctctggctccacctccgagaacacagcttccttcgccatcacgtcgggactcgagggtcggaaagagtaggacggctacggtacttaacgtttagttagaccgaagaccgaccgttaccccgggggaaccaaacccgtaaaattaaagtttagggtttactttacggtttttaccccggacccgggtacccccggggtaaaccgtaaccggggttacccgtacccccgggtttacccggtttaccggtaccggtaaacccggacccccgaaaacccggggtaccccctaaaaccccccgtaccgttacccggttaccctaccccgttaacccgttccccggtttaccccccgtcccccgttacccccgttaccgttccccggtaacgtttcccccggg

SEQ ID NO: 394242 - DNA, 586 bp, Homo sapiens
  misc_feature: GZ8MTXP02JP81R.45.57.F02.1.454.CMB.2.raw
  modified_base (279)..(279): a, c, t, g, unknown or other
  modified_base (402)..(402): a, c, t, g, unknown or other
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttctctgggctgactcaggagtctgctgtgtctgtggccttgggacagacagtcaagatcacatgccacggagacagcctcagaggcactatgacaaactggtaccaaacagaaagccgggaacaggccccctntacttgtcatagtttaggaaaaaccgccggaccctccggatcccagaaccgtagttctctcgacctaccacctacccgaagaaacacagcttcctagccatcacgtggactacgagccgaaanactaggacgatgaactattatagcagactagtaccgggaacaaccgtaaatagtaggttatagtttccggaccgacccggtaacgagtaccgaccgtccgtacgtcgacgacccaaacggcccaaaccccgactacgttaccacttaacgtccgtacccccactccctacctaccggtatcccg

SEQ ID NO: 394243 - DNA, 662 bp, Homo sapiens
  misc_feature: GZ8MTXP02IB9IT.45.57.F02.1.454.CMB.2.raw
  modified_base (180)..(180): a, c, t, g, unknown or other
  modified_base (283)..(283): a, c, t, g, unknown or other
  modified_base (359)..(359): a, c, t, g, unknown or other
  modified_base (395)..(395): a, c, t, g, unknown or other
  modified_base (422)..(422): a, c, t, g, unknown or other
tcagacgcgatcgacacgaccggtgctcgatttagctcgatatagttgggtttgggggctcagaagcagagttctggggtgtctccaccatggcctggaccccctctctggctcactctcctcactctttgcatagggtctgtactttcttctgggctgactcaggagtctgctgtgtcngtgccttgggacagacagtcaagatcacatgccaaggagacagcctgagagggcactatgacaaactggtaccaaacgagaaacgccgggacaacggcccctntaacgtgtactatgtttaggaaaaaccgccggccctacggatcccgagaccgattctcgtgctccactcaagaacncagtctctgacatcacgtggactcgagacggaaatntaggaaggccttaggaactatttaganacacgctaacgtaccgggaaactaacctaaaagttacgtaggtaattcggtttaccgccgaacccgggaaccgtaacgggttccctaaccggttccgtttacgggaccttaacggaccccctaaaacgggtacccccgaaaaaccccctcggttaccctaacccggtaacccttaacccggttacccggtttaccccccccgtaccccgttacccgtaccggtaacccgtaccggtaccg

SEQ ID NO: 394244 - DNA, 671 bp, Homo sapiens
  misc_feature: GZ8MTXP02JL41J.45.57.F02.1.454.CMB.2.raw
tcagacgcgatcgacacgaccggtgctcgatttagctcgatatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccaggagacagcctcaggagggcactatcgacaaactggaaccaacagaacgccggacacggcccctactacttgtcagttgttacggtaaaaaccgccggcccgtaccgggactcccgacgacccgtattcctacgtcgcctccacctacccgaaggaaaccacacgtcttacctacgaccactacacgtacgggactacgaggaccggaaagacgtaggacgtctagtaacttagttacttgactacgacgacgtaccgggaaccaaaccgtaattaacgttgtttaacgttcggttttaccgaccggtacccgggtaacgaacggttccgtaccggttacgtacggttaccgaccggacccgtaaaccggacccaaaccccgtacgtccggtacctaccttaaccgttaccccggtttaccccaccccgtttccgtcccttacgtaccgtttcccgg

SEQ ID NO: 394245 - DNA, 511 bp, Homo sapiens
  misc_feature: GZ8MTXP01D282E.44.12.B01.1.454.CMB.2.raw
  modified_base (466)..(466): a, c, t, g, unknown or other
tcagacagtatatacacgaccggtgctcgatttagtagtgtagattccgcggggggtagctcaggaagcagagcctggagcatctccactatggcctgggctccactacttctcaccctcctcgctcactgcacaggttcttgggccaattttatgctgactccacccccctctgtgtcggagtcgtccggggaagacggtaaccatctcctgcacccgcagcactggcagcattgccagcaactttgtgcagtggtaccagcagcgcccgggcagtcgcccccacactgtgatctatgaggactaccccaacgaccctcgtgggggtccctgatcggttctctcggctcatcgacaagctcctccaactctcgccctccctcaccatctctggactgaagactgaggacgaggctgactactactgtcagttcttatgatagcagcaatcatgtggttatcgggnggagggaccaagcttagccgtctaaggtcacgcccaaggctcccg

SEQ ID NO: 394246 - DNA, 538 bp, Homo sapiens
  misc_feature: GZ8MTXP01DZ39I.44.12.B01.1.454.CMB.2.raw
  modified_base (385)..(385): a, c, t, g, unknown or other
  modified_base (435)..(435): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagtagtagttactactggggctggatccgccagcccccagggaagggctggagtggattggggagtatctattatagtggagcacctactacaacccgtcctcaacgagtcgagtcacccaatatcagtagacacgtccaagaccagttcnccctgaagctgagctctgtcgaccgccgcggacacggccggtgtattacngtgcgagagtaggctagttcgtcaccgaacttactttgacccacgtcgggggccaggggaaccccttgggtccaccgtctccgtcacgcccttccgaacccgg

SEQ ID NO: 394247 - DNA, 528 bp, Homo sapiens
  misc_feature: GZ8MTXP01ELR0C.44.12.B01.1.454.CMB.2.raw
  modified_base (204)..(204): a, c, t, g, unknown or other
  modified_base (290)..(290): a, c, t, g, unknown or other
  modified_base (330)..(330): a, c, t, g, unknown or other
  modified_base (368)..(368): a, c, t, g, unknown or other
  modified_base (427)..(427): a, c, t, g, unknown or other
tcagacagtatatacacgaccggtgctcgatttagtagtgtagattccgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacngcccaccctctcctgcagggccgccagactgtgacaacgacttagcctggtaccaacagaagcctggccaggctcccaggctcctnatctatgatactccagtaggccatggcatccccagcccgnttcagtggcaggtcgggtctggggacagtagtttaacnctcaccatcctccagcctagacgcctgaagtatttgctagtttatactgtcagctcganaagaggtcgactccaattattcacgtttcggaccctgggaccaaagtggaataatacaaagacttggtgcttgcacctaatctgtcttcactccttcccgc

SEQ ID NO: 394248 - DNA, 505 bp, Homo sapiens
  misc_feature: GZ8MTXP01DYAMY.44.12.B01.1.454.CMB.2.raw
  modified_base (248)..(248): a, c, t, g, unknown or other
  modified_base (273)..(273): a, c, t, g, unknown or other
  modified_base (341)..(341): a, c, t, g, unknown or other
  modified_base (435)..(435): a, c, t, g, unknown or other
  modified_base (442)..(443): a, c, t, g, unknown or other
  modified_base (446)..(447): a, c, t, g, unknown or other
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactccacccccctctgtgtcggagtcgtccggggaagacggtaaccatctcctgcacccgcagcactggcagcattgccagcaactttgngcagtggtaccagcagcgcccgggnagtcgcccccacactgtgatctatgaggactacccaacgaccctcgtgggggtccctgactcggttcnctcggctcatcgacaagctcctcaactctcgccctcctcacccatctctggactgaagactgagacgaggctgactactactgtcagtcttagngatgcannatnntgtgttgtcggcggacggacgacgcgcgaacgtcgtcgtcgacgaccgaacgcgtccg

SEQ ID NO: 394249 - DNA, 544 bp, Homo sapiens
  misc_feature: GZ8MTXP01D0H7B.44.12.B01.1.454.CMB.2.raw
  modified_base (260)..(260): a, c, t, g, unknown or other
  modified_base (385)..(385): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagtactactgggctgganccgccagcccccagggaagggctggagtggattgggagtatctattatagtgggagcacctactaccaacccgtcctcaacgagtcgagtcaccaatatcagtagacacgtccaagaccagttcnccctgaagctgagctctgtcgaccgccgcggacacggccggtgtattactgtgcgagaggtagggctagttcgcaccgaaactctttggaccacggtcggggacccacgggaccccgttgggtcccaccgtcttcccgcacgtcccttcccgaacccgg

SEQ ID NO: 394250 - DNA, 537 bp, Homo sapiens
  misc_feature: GZ8MTXP01EKOXL.44.12.B01.1.454.CMB.2.raw
  modified_base (261)..(261): a, c, t, g, unknown or other
  modified_base (437)..(437): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctgganccgccagcccccagggaaggggctggagtggattggggagtatctattatagtggagcacctactacaacccgtcctcaacgagtcgagtcacccaatatcagtacgacacgtaccaagaccagttctccctgaagctgagctctgtcgaccgccgcgacacggcggtgtattacngtgcgagagtagggctagttcgtcacctaactctttggaccacgtggggcccaggggaccccttgggttccaccgtctcctcacgtcccttccaacccgg

SEQ ID NO: 394251 - DNA, 536 bp, Homo sapiens
  misc_feature: GZ8MTXP01AFPPP.44.12.B01.1.454.CMB.2.raw
  modified_base (435)..(435): a, c, t, g, unknown or other
  modified_base (443)..(443): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagcccccagggaaggggctggagtggattggggagtatctattatagtgggagcacctactacaacccgtcctcaacgagtcgagtcaccaatatcagtagacacgtccaagaccagttctccctgaagctgagctctgtgaccgccgcggacacggccggtgtattacngtgcgagngtagggctagtcgtcaccgaactctttgacccacgtcgggggcccaggggaccccttgggtccaccggtctcctcacgtcccttccaacccgg

SEQ ID NO: 394252 - DNA, 525 bp, Homo sapiens
  misc_feature: GZ8MTXP01AU8IO.44.12.B01.1.454.CMB.2.raw
  modified_base (473)..(473): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagcccccagggaagggctggagtggattgggagtatctattatagtggagcacctactacaacccgtccctcaacgagtcgagtcaccaatatcagtagacacgtccaagaaccagttctccctgaagctgagctctgtcgaccgccgcgacacggccgtgtattactgtgcgagagtagggctagttcgtcaccaactcttgaccngtcggggccagggacccttggtccaccgtctcctcacgtcccttcgaacccg

SEQ ID NO: 394253 - DNA, 561 bp, Homo sapiens
  misc_feature: GZ8MTXP01AMIMJ.44.12.B01.1.454.CMB.2.raw
  modified_base (369)..(369): a, c, t, g, unknown or other
  modified_base (396)..(396): a, c, t, g, unknown or other
  modified_base (443)..(443): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctcatcagcagtagtagttactactggggctggatccgccacgcccccagggaagggctggagtggattggggatatctattagtagtgggagcaccgtactaccaacccgtcctacaacgagtcgagtcaccaatatcagtanacacgtaccaagaaccagttcctcccngaagctgagctctgtcgaccgccgcggacgacggccggtgtattacngtgcgagaggtagggctagttccgacacctaactcgtttcgacccttacgtcgggggccaacggggaccccttgggtaaccaccggttcctcccgtcgacgtcccttccgaaacccgg

SEQ ID NO: 394254 - DNA, 556 bp, Homo sapiens
  misc_feature: GZ8MTXP01ESC41.44.12.B01.1.454.CMB.2.raw
  modified_base (433)..(433): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccgagggaagggctggagtggattgggagtatctattatagtggagcacctactaccaacccgtccctacaacgagtacgagtcaacccaatatcaagtacgacacgtaccaaagaacctagttctccctagaagctgagctctgtcgaccgccgcggacncggccgtgtattacgtgtgcgagagtagggctagttcgcaaccgaacttactttgaccttacgtcggggtccacgggacccttgggtccacccgtctcccgtcacgtcccgttccgaacccgg

SEQ ID NO: 394255 - DNA, 606 bp, Homo sapiens
  misc_feature: GZ8MTXP01CJO6D.44.12.B01.1.454.CMB.2.raw
  modified_base (331)..(331): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactacgtggggctggactccgccacgccccccgaaggggaaggggctgggagtggagttggggagtatctaattatagtgggancacctactaccaacccgtcctacaacgacgtcgagtcaaccaatactcagtagaacacgtaccaaacgaaccacgttcctccctagaaacgctagacgtctcgtgtcgacccgccgacggacaccggtcggtgttaacttacgtggtgcgaggaggttaacggggctaacgttcgacaacctaaacttacgtttgacccacgttcgggggcccttaacggggacccttcgggtcctacccgttcctccctcaccgtccccgttcccgaaacccgg

SEQ ID NO: 394256 - DNA, 568 bp, Homo sapiens
  misc_feature: GZ8MTXP01ELQJQ.44.12.B01.1.454.CMB.2.raw
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagtagtagttactactggggctggatccgccacgccccgagggagggctggagtggagtgggatatctattataggtggacgcaccgtactaaccaacccgtccctacaagacgtcgagtcaccaatatcagtagacacgtacaagacctagttcctcctagaagctagacgtcttctgtacgacacgccgacggacgacgggggtcctggtacttacgtgtgcgagaaggtgggctagtttcgccaacctaacgttactttcgaccgacggtcgggggacccacggggttaaccctgggtaccaaccggttctcccgttcaacgccctaacccg

SEQ ID NO: 394257 - DNA, 638 bp, Homo sapiens
  misc_feature: GZ8MTXP01CXNRJ.44.12.B01.1.454.CMB.2.raw
  modified_base (260)..(260): a, c, t, g, unknown or other
  modified_base (289)..(289): a, c, t, g, unknown or other
  modified_base (295)..(295): a, c, t, g, unknown or other
  modified_base (365)..(365): a, c, t, g, unknown or other
tcagacagtatatacacgaccggtgctcgatttagtagtgtagattccggggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccgccagactgtgacaacgacttagcctggtaccaanagaagcctggccaggctcccaggctcctnatctangatactcagtacggccatggcatccccagcccgctcagtgcaggtcgggtctgggactagtagtttaacncctcacctatctacccagccctagacgtcctagaatattttgacttagtttattactgtccgagtcctccgacaaggtaaaggtcggtacccttaccaaacttacttcccgtaaccgtttccgggtaccccgtaggggtaaaccctaaagggtacgggtaaacttaaacgtaaccgaaaacggtaacgttacgggttacgggccttacggcccgttaacccgtaacttctttcggtttacctttccttaaccgtttcccgtttcccccgtccg

SEQ ID NO: 394258 - DNA, 579 bp, Homo sapiens
  misc_feature: GZ8MTXP01A8802.44.12.B01.1.454.CMB.2.raw
  modified_base (321)..(321): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatcccgccacgcccccgagggaagggctggagtggagttgggagtatctattagtagtggancgacctactaccaacccgccctacaacgagtcgagtcacctaatatcagtagacacgtaccaaacgaccacgttcctaccctagaacgctagagtctcgtgtcgacccgccgacggacaccgggtccggtagttacgttacgtggtgcggagtaggtacggggctagtccgtacaaccgtaactacttcgaccacgtcgggaccgacggggttcccttcggtccaccgtcctcctcgacgtcccttaaccgtaacccg

SEQ ID NO: 394259 - DNA, 599 bp, Homo sapiens
  misc_feature: GZ8MTXP01DD9FH.44.12.B01.1.454.CMB.2.raw
  modified_base (285)..(285): a, c, t, g, unknown or other
  modified_base (332)..(332): a, c, t, g, unknown or other
  modified_base (363)..(363): a, c, t, g, unknown or other
  modified_base (381)..(381): a, c, t, g, unknown or other
  modified_base (395)..(395): a, c, t, g, unknown or other
tcagacagtatatacacgaccggtgctcgatttagtagtgtagattccgggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacgagccaccctctcttgcagggccgccagactgttgacgacgacttagcctggtaccaacagaagcctggccaggcctccagactccncatctatgatacttctagtaggcctcgtggcactccccagccccgtntttcaggtggcaggtggggtctaggggaccngtacttcactctacaccntcaccagcctagcncctagaagtatttgctagtttattactgttctaacaccgtaagaagtcggacctacctaagttactttcctaaccgtttccggacccgtagggaaaccgtaaaggttacgaataataaccgaaaacgtacgttaaggtcgggactcgaccgtacctattccgttcgttcctttcacttccttcccgcttacttccgttaagtaa

SEQ ID NO: 394260 - DNA, 528 bp, Homo sapiens
  misc_feature: GZ8MTXP01CTZX9.44.12.B01.1.454.CMB.2.raw
  modified_base (262)..(262): a, c, t, g, unknown or other
  modified_base (440)..(440): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctgganccgcagcccccaggggaaggggctgggagtggattggggagtatctattatagtgggagcacctactacaacccgtcctcaacgagtcgagtcaccaatatcagtagacacgtccaagaaccagttctccctgaagctagagctctgtcgaccgccgcggacacggcggtgtattacngtgcgagagtagggctgtcgtcactaatcttgaccagtcggggcagggacccttgggtccaccgtcctcacgcctccgaacgaaccgg

SEQ ID NO: 394261 - DNA, 540 bp, Homo sapiens
  misc_feature: GZ8MTXP01DP754.44.12.B01.1.454.CMB.2.raw
  modified_base (267)..(267): a, c, t, g, unknown or other
  modified_base (389)..(389): a, c, t, g, unknown or other
  modified_base (455)..(455): a, c, t, g, unknown or other
  modified_base (473)..(473): a, c, t, g, unknown or other
  modified_base (476)..(476): a, c, t, g, unknown or other
  modified_base (522)..(522): a, c, t, g, unknown or other
  modified_base (526)..(526): a, c, t, g, unknown or other
  modified_base (531)..(531): a, c, t, g, unknown or other
tcagacagtatatacacgaccggtgctcgatttagtagtgtagattccggggggaggaactgctcagttaggacccagagggaaccatggaagccccagctcagcttctcttcctcctgctactctggctcccagtttcagattccagcggcgaaactgtgttgacacagtctccagccaccctgtctttgtcgtccgggggaacagcccaccctctcctgcagggcccggccagactgttgaacaacgacttagcctggtaccaanagaagcctggccaggcctcccgaggctcctcatctatgatacttccagtacggccacgtggcactcccagccccgcttcgagtggcaggtcggggtctaggggactaggtacgttttaaccnctcacctatcctaccagtcctagacgcctagaagtatttgacttagtttattactgtcagctcganaagaggtcgcctacaatntcncttcggcctggaccaagtgataatacaaagtacttgtgcttgcacntctntctcntccttccgc

SEQ ID NO: 394262 - DNA, 563 bp, Homo sapiens
  misc_feature: GZ8MTXP01BKGDE.44.12.B01.1.454.CMB.2.raw
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagtactactggggctggatccgccagccccccgagggaaggggctggagtggagttggggagtatctattataggtgggagcacctactaccaacccgtccctacaacgagtcgagtcacccaatatcagtagacacgtaccaagaccagttcctaccctgaagctagagctctgtcgaccgcgcggacaccggcggtgtattacgtgtgcgagaggtagggctaggttcgtcacctaacttactttgacccttacggtcggggccaacggggaccccttgggtccaccgttcgtcctccgttacaaccgttcccgaacccg

SEQ ID NO: 394263 - DNA, 525 bp, Homo sapiens
  misc_feature: GZ8MTXP01D0H5B.44.12.B01.1.454.CMB.2.raw
  modified_base (365)..(365): a, c, t, g, unknown or other
  modified_base (380)..(380): a, c, t, g, unknown or other
  modified_base (389)..(389): a, c, t, g, unknown or other
tcagacagtatatacacgaccggtgctcgatttagtagtgtagattccgcgggggcttactgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagtagtagttactactggggctggatccgccagcccccagggagggctggagtggatgggagtatctattataggtggagcacctactaaccaacccgtcctcaagcgtacgagtcacccaatatcagtanacacgtccaagaacngttctcccngaagctgagctctgtcgaccgccgcggacaccggccggtagtattactgtgcgagagtagggcagttcgcaccaactcttgaccttagtcgggccacgggacccttggtccacgtctcctcacgccttccaaccgg

SEQ ID NO: 394264 - DNA, 539 bp, Homo sapiens
  misc_feature: GZ8MTXP01ER0AU.44.12.B01.1.454.CMB.2.raw
  modified_base (439)..(439): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaaggggctggagtggagttgggagtatctattatagtggagcacctactacaacccgtccctacaacgagtcgagtcaccaatatcagtagacacgtacaagaccagttctccctgaagctgagctctgtcgaccgccgcggacacggccggtgtattacngtgcgagagtagggctagtcgtcactaactctttgaccttacgtgggccttacgggacccttgggtccaccgtctacctccacgtcccttcccgaacccg

SEQ ID NO: 394265 - DNA, 525 bp, Homo sapiens
  misc_feature: GZ8MTXP01AQE1B.44.12.B01.1.454.CMB.2.raw
  modified_base (436)..(436): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaaggggctggagtggattggggagtatctattatagtggagcacctactacaacccgtcctcaacgagtcgagtcaccaatatcagtagacacgtccaagaaccagttctccctgaagctgagctctgtcgaccgcgcggacacggccgtgtattacngtgcgagagtagggctgttcgcaccaactctttgaccacgtggggccagggacccttggtccaccgtctcctcacgccttccgaacccg

SEQ ID NO: 394266 - DNA, 543 bp, Homo sapiens
  misc_feature: GZ8MTXP01AT8G3.44.12.B01.1.454.CMB.2.raw
  modified_base (322)..(322): a, c, t, g, unknown or other
  modified_base (449)..(449): a, c, t, g, unknown or other
  modified_base (489)..(489): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatcccgccacgccccccgagggaaggggctggagtggattggggatatctattatagtgggancacctactacaacccgtccctacaacgagtcgagtcacccaatatcagtagacacgtccaaagaaccagttcctccctgaaacgctgacgctctgtcgacccgccgcggacaccggcgtgtattacngtgcgagagtagggctagttcgcaccgaactacttgaccncgtgggccacggggacccttggtccaccgtctcctcacgcccgttccgaacccg

SEQ ID NO: 394267 - DNA, 647 bp, Homo sapiens
  misc_feature: GZ8MTXP01B9K3F.44.12.B01.1.454.CMB.2.raw
  modified_base (379)..(379): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgtaggagtcgggcccaggactggtgaagccttcggagaccctgtccctcacctgcactgtctctggtgctcatcagcagtagtagttactacgtggggctggactcccgccacgcccccgagggaaggggctggaggtggagttgggagtatctattagtaggtgggacgcaacctactaccaacccgtcctacaagacgtcgagtcaccataatcaagtanacacgtaccaaagaaccagttcctaccctagaaacgtctagacgtctacgtgtcgacccggccgacggaccacggtccgtagggttacttacgtggtcgacggagtaggtaggggtaccaggtttccgacctaacccgtaaacgttaaccgttttacgaaacccgtacgttcggggggaacccctacgggggttaaacccccgttggggttacccaacccggttcctcccgtaccgacggttcccctaacccgaacccgtaacccggg

SEQ ID NO: 394268 - DNA, 543 bp, Homo sapiens
  misc_feature: GZ8MTXP01BKLN7.44.12.B01.1.454.CMB.2.raw
  modified_base (396)..(396): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgcagcccccagggaaggggctggagtggagttggggagtatctattatagtggagcacctactacaacccgtcctcaacgagtcgagtcaccaatatcagtagacacgtacaagaaccagttctccctgaacnctgagctctgtcgaccgcgcgacacggcgtgtatctgtgcgagagtaggctagttcgtcacctaaactctttcgaccacggtcggggcccacggggaccccttgggtccacccggtcctacccgtcacggtcccttccgaaccccgg

SEQ ID NO: 394269 - DNA, 582 bp, Homo sapiens
  misc_feature: GZ8MTXP01E3ITQ.44.12.B01.1.454.CMB.2.raw
  modified_base (260)..(260): a, c, t, g, unknown or other
  modified_base (331)..(331): a, c, t, g, unknown or other
  modified_base (369)..(369): a, c, t, g, unknown or other
tcagacagtatatacacgaccggtgctcgatttagtagtgtagattccggggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccgcagactgtgacaacgacttagcctggtaccaanagaagcctggccaggctcccaggctcctcatctatgatacttccagtaggccactggcatccccagcccgnttcagtggcaggtcgggtctgggacaggtagtttaacnctcaaccatcctccagtccctaagacgtcctagaagtatttgctagtttatactgtccagtcctacgacgaagaagggtcggacccttaccaaattcttaccaaccttttccgggacccttacgggggaaaccctaaaaggtcgggaataacgtacaaaacgtaacttgtacgggcttgaccacctaatctgttctcacttccttcccgaacc

SEQ ID NO: 394270 - DNA, 679 bp, Homo sapiens
  misc_feature: GZ8MTXP01DIVN6.44.12.B01.1.454.CMB.2.raw
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagacccctgtcccctcacctgcactgtctctggtgctccatcagcagtagtagttactacgtggggctggactcccgccacgccccccgagggaacggggctggagtggattggggagtatcttattataggtggagacaccgtactaccgaacccgtccctacgaaacgacggttacgacgtaccaaccctaaattaactcgaaacgttaaaggaaacccgtaaccgttaaccccaaaacggaaaccctacggttttacccctacccccgttaggaaacgcttaggaacgtccttcgtacgtcggaacccgccgaccggacgaccgggtccggttgttaactttaaccgtggtcgcgaggaggtaacgggctaaggttccgtaccaacctaaacttacgtttcgaacccgttacgtccggggaccaacgggttacccttcgggtccacccggtcctccctcaccggtcccttaacccgaaccccgg

SEQ ID NO: 394271 - DNA, 540 bp, Homo sapiens
  misc_feature: GZ8MTXP01AK2LH.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagacccctgtcccctcacctgcactgtctctggtgctccatcagcagtagtagttactactggggctggatccgccagccccccgagggaaggggctggagtggagttggggagtagtctattatagtggagcacctactacaacccgtccctcaacgagtcgagtcaccaatatcagtagacacgtccaagaccagttcctccctagaagctgagctctgtcgaccgccgcggacacggccggtgtattactgtgcgagagtagggctagttcgcacaactacttgaccacgtggggccacggggacccttgggtccaccgtctcctcgacgcccttccgaacccgg

SEQ ID NO: 394272 - DNA, 586 bp, Homo sapiens
  misc_feature: GZ8MTXP01CQJOJ.44.12.B01.1.454.CMB.2.raw
  modified_base (263)..(263): a, c, t, g, unknown or other
  modified_base (460)..(460): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtgggctggacnccgccacgcccccgagggagggctggagtggatgggatatctatagtagtggagcacctactaccaacccgtcctacaacgagtacgagtaccaccaatatcagtaagacacgtaccaaagaaccagttcctccctagaacgctagagctcgtgtcgaccgccgcggacacggccggtatattacgtggtgcgaggnggtaagggctacggttcgtaccaaccctaaactacgtttacggaacccgacggttcggggacccgttaacgggaaccccgttggtaaccctacccggtctcccgtacacgtcccttcccgaacccg

SEQ ID NO: 394273 - DNA, 666 bp, Homo sapiens
  misc_feature: GZ8MTXP01CD1T4.44.12.B01.1.454.CMB.2.raw
  modified_base (387)..(387): a, c, t, g, unknown or other
tcagacagtatatacacgaccggtgctcgatttagtagtgtagattccgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccgggggaacagcccaccctctcctgcgagggccgcagactgtgacaacgacttagcctggtaccaacagaagcctggccaggcctcccgaggcctcctcatctatgactacttccaggtacggccacgtggcactccccagcccgcttcgagtggctaggtcgggtctaggggactaggtacgttttaaccnctccacctactcctccagtcctagacgtactagtaagttcgttggacttaagtttacttacgtcgtaccacgtccgtacgaacgtaaaggtacgggtcgtaccctaacctaaagtttaccttaccgtacccggtttacccgggacccgtaacggggtaaacctaaagggttacgaaacttaacgtaaaccgaaaaccggtaacgttcgggtacggaccgttcgacccttaccgtaacttcgttccgttaccttaccttactttccccgttcccgtaacc

SEQ ID NO: 394274 - DNA, 596 bp, Homo sapiens
  misc_feature: GZ8MTXP01BGN9V.44.12.B01.1.454.CMB.2.raw
  modified_base (347)..(347): a, c, t, g, unknown or other
  modified_base (363)..(363): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagacccctgtcccctcacctgccactgtctctggtgctccatcagcagtagtagttactactggggctggatccgccacgcccccgagggagggctggagtggattgggatatctattagtagtggagcacctactaccaacccgtcctcaacgngtcgagtcaccaatancagtacgacacgtaccaagacctagttctccctagaacgctgagctcgtgtcgacccgcgcggacacggccgtgtattacgtggtgcgagtaggtacggctacggttcgtaccaccgtaaacttcgtttcgaacccgttacggttcgggggacccgttacggggttaacccttcggggtccctacccgggttcctacccgtccgaaccggtcccttaacccgaaacccccggg

SEQ ID NO: 394275 - DNA, 590 bp, Homo sapiens
  misc_feature: GZ8MTXP01BZ0TY.44.12.B01.1.454.CMB.2.raw
  modified_base (327)..(327): a, c, t, g, unknown or other
  modified_base (449)..(449): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcagggagtcgggcccaggactgggtgaagcccttcgggacgaccctgtcccctcacctgcactgtctctggtgctccatcagcagtagtagttactacgtggggctggactccgccacgcccccgagggagggctggagtggagttgggagtatctattatagtgggancacctactaccaacccgtcctacaacgagtcgagtccaccaatatcaagtacgacacgtaccaaacgaacctacgttcctcccgtagaacgtctagacgctcgtgtcgaccgccgacggacncggcgtgtatacgtgtgcgagagtacggctaggttcgtacacctaacttcgtttcgacccttacggtcgggggacccttaacggggaccccttcgggtccacccggttcctcccgtcaccggtccccttaaccgaacccgg

SEQ ID NO: 394276 - DNA, 587 bp, Homo sapiens
  misc_feature: GZ8MTXP01COZOR.44.12.B01.1.454.CMB.2.raw
  modified_base (320)..(320): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccacgcccccagggaggggctggagtggattgggagtatctattatagtggancacctactacaaccgtcctcaacgagtcgagtcaccaatactcagtagacacgtccaaacgacagttcctcccgtagaacgctaggacgtctctgtcgaccgccgacggacacgggcgtgtagttactggtgcgagagtacgggctagttcgactaccgaacttacgtttcgacccacgttacgggggcccaacggggaccccttcggggtccctaaccccggttcctaccccgtcgaaccggtccccttaacccgtaaaccccggg

SEQ ID NO: 394277 - DNA, 605 bp, Homo sapiens
  misc_feature: GZ8MTXP01CBXZO.44.12.B01.1.454.CMB.2.raw
  modified_base (218)..(218): a, c, t, g, unknown or other
  modified_base (247)..(247): a, c, t, g, unknown or other
  modified_base (271)..(271): a, c, t, g, unknown or other
  modified_base (341)..(341): a, c, t, g, unknown or other
  modified_base (360)..(360): a, c, t, g, unknown or other
  modified_base (375)..(375): a, c, t, g, unknown or other
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactccacccccctctgtgtcggagtcgtccggggaagacggtaaccatctcctgcaccgnagcactggcagcattgccagcaactttgngcagtggaccagcagcgcccgggnagtcgcccccacactgtgatctatgaagactaacccaacgaccctcgtcgggggtccctgactcggttcncgtcggctcatcgacaacnctcctccaactctcncctccctcaccactctctcgacgtagaagaacgaggaggacggacggacgtacgtactaaccttaacgtggttcgtacgttacgttagttaagtaagtaacgacgaacgtaactaactacgtagttaaggttagggttacggtacgggacgggaacgggaaccggaacggttcgttaccggtaacccgtaccgtaacggtaccgaccggaccgtaaccggttccgtcccg

SEQ ID NO: 394278 - DNA, 527 bp, Homo sapiens
  misc_feature: GZ8MTXP01EYLT5.44.12.B01.1.454.CMB.2.raw
  modified_base (387)..(387): a, c, t, g, unknown or other
  modified_base (422)..(422): a, c, t, g, unknown or other
  modified_base (438)..(438): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaaggggctggagtggattggggatatctattatagtggagcacctactacaacccgtcctcaagagtcgagtcaccaatatcagtagacacgtaccaagaaccagttcnccctgaagctgagtctctgtcgaccgccgcggacncgggccgtgtattacngtgcgtagagtagggctagttcgaccacaactctttgaccacgtgggccagggacccttggtcacgtctcctcacgtcccttcgaaccg

SEQ ID NO: 394279 - DNA, 558 bp, Homo sapiens
  misc_feature: GZ8MTXP01DZL37.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccgagggagggctggagtggattgggagtatctattatagtggagcacctactacaacccgtcctcaacgagtcgagtcaccaatatcagtagacacgtaccaagaacctagttctccctagaagctgagctctgtcgaccgcgcgacacggcggtgtattactgtgcgagaggtaggctagttcgtacacctaaactctttcgacccttacgtcgggggcccaacggggttaccccttcgggtccacccggttccttccctcgacggtccccttccgaaccccgg

SEQ ID NO: 394280 - DNA, 519 bp, Homo sapiens
  misc_feature: GZ8MTXP01DBP1Y.44.12.B01.1.454.CMB.2.raw
  modified_base (403)..(403): a, c, t, g, unknown or other
  modified_base (441)..(441): a, c, t, g, unknown or other
  modified_base (449)..(449): a, c, t, g, unknown or other
  modified_base (461)..(461): a, c, t, g, unknown or other
  modified_base (473)..(473): a, c, t, g, unknown or other
  modified_base (501)..(501): a, c, t, g, unknown or other
  modified_base (512)..(512): a, c, t, g, unknown or other
tcagacagtatatacacgaccggtgctcgatttagtagtgtagattccgcgggggcttactgagagtcatggacctcctgtgcaagaacatgaagcacctgtggttcttcctcctgctggtggcggctcccagatgggtcctgtcccagctgcagctgcaggagtcgggcccaggactggtgaagccttcgggagaccctgtcccctcacctgcactgtctctggtgctccatcagcaagtatagttactacgtggggctggatccgccagcccccgaagggaaggggctggagtggattggggatatctattatagtggagcacctactacaacccgtcctacaacgagtcgagtcaccaaatatcagtagacacgtaccaaagaccagttctccctagaanctgagctctgcgaccgcgcgacgacggcgtgtattacngtgcgagngtaggctagtcnacaatcttgacncgtggccagggaccttggtccaccgtcncctcacgtccncaacccg

SEQ ID NO: 394281 - DNA, 673 bp, Homo sapiens
  misc_feature: GZ8MTXP01D3QJ2.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcagggagtcgggcccaggactgggtgaagccttcgggacgaccctgtcccctcacctgcactgtctcgtggtgctccatcagcagtagtagttactacgtgggctggactccgcacgccccgagggaagggctggagtggagttgggatatctattataggtggagcacctactaccaacccgtcctacgaacgacgtacgagtacaaccctaatactcgaagtaacgaaccacgtaccaaacgaacctacgtttcctacccgtagaaacgtctggaacgtcttcgtacggtacgaaccccggcccgggacggaaccgaccggggtccggttacggtttaacgtttaaccgtggtacggcgtaaggtacgggtaagggtcgtacgtttcggtaccaacctaaacttacgtttcggaaccgttacggtacgggggacccttaacggggttaccccttcggggtaaccctacccggttccttccctacgaccgtccccgttaaccgaaacccccggg

SEQ ID NO: 394282 - DNA, 643 bp, Homo sapiens
  misc_feature: GZ8MTXP01EWCSN.44.12.B01.1.454.CMB.2.raw
  modified_base (324)..(324): a, c, t, g, unknown or other
  modified_base (402)..(402): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagtagtagttactacgtggggctggactccgccacggcccccgaaggggaaggggctggagtggattggggatatctattataggtggancacctactaccaacccgtcctacaacgacgtacgagtcaaccaatatcagtagacacgtaccaaagaacctagttccncctaggaacgctagacgtctcgtgtcgacccggccgcggaaccgaccgggtccggtagttactttacgtggtggacgaggtacggtacgggctacggttaccgtccaacctaaacgtttaccgtttacggaacccgttacggttaccgggggtacccgaacgggggttaaccccttcgggggtaacccctacccggttcccttcccgttaccaacggtcccccttaacccgaaaccccggg

SEQ ID NO: 394283 - DNA, 773 bp, Homo sapiens
  misc_feature: GZ8MTXP01B3VUK.44.12.B01.1.454.CMB.2.raw
  modified_base (332)..(332): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagcccttcgggacgacccctgtcccctcacctgcactgtctcgtggtgctccatcagcagtagttagttactacgtggggctggactcccgcgacgcccccgaaggggaggggctggagtggagttgggatatctattagtagtgganctacctactaccacccgtcctacaacgagtcgagtcacctaatatcagtacgaacacgtaccaaacgaaacctagttcctaccctaggaaacgccttagaagtccttcgtaggttaccgaaccccggcccggacccggaaacgtaacccggggtcccggtaggttttaacgttaacccgtggtacggtaccggtaagggacgggttaaacggggcctaaacggggttttcccgtacccgtaaacccttaaaacccgtttaaccgttttaccgggaaaccccttaaccgggtttaccggggggggaaccccgttaaaacccggggggggttaaaccccctttacggggggttaaccccctaacccccggggttttcccttacccccgttacccggaaaccccgggtaacccccctttaacccccggaaaaaccccccggggg

SEQ ID NO: 394284 - DNA, 567 bp, Homo sapiens
  misc_feature: GZ8MTXP01DP5CZ.44.12.B01.1.454.CMB.2.raw
  modified_base (339)..(339): a, c, t, g, unknown or other
  modified_base (370)..(370): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtccctggtgctccatcagcagtagtagttactacgtggggctggatccgccacgcccccagggaaggggctggagtggattgggagtatctattatagtgggagcactactacaacccgtccncaagacgtcgagtcacccataaatcaagtanacaacgtccaaagaaccagttacctccctgaagctgagctcgtgtcgaccgccgcgacacggccgtggtacttacgtgtcgcgagagtacgggctagttcgtacgaacctaattaactttgacccacgttcggggaccacgggaacccgttcggttccaaccggttctccgtcacgccctaacccgaacgaaccggg

SEQ ID NO: 394285 - DNA, 556 bp, Homo sapiens
  misc_feature: GZ8MTXP01B5LNN.44.12.B01.1.454.CMB.2.raw
  modified_base (461)..(461): a, c, t, g, unknown or other
  modified_base (503)..(503): a, c, t, g, unknown or other
  modified_base (524)..(524): a, c, t, g, unknown or other
  modified_base (535)..(535): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctcatcagcagtagtagttactactggggctggactccgccacgccccccgagggaacggggctggagtggagttggggagtatctattatagtgggagcaccgtactaccaaacccgtccctacaacgacgtcgagtcaaccctaatactcagtagacacgtccaaacgaacctacgttctccctgaacgctagagctctgtcgaccgccgcggacacgggccgtgtattacgngtgcgagaggtagggctagttcgcacctaactctttcgaccncgtcggggccacgggttaccnggtcaccgtcncctcacgcccttcgaacccgg

SEQ ID NO: 394286 - DNA, 547 bp, Homo sapiens
  misc_feature: GZ8MTXP01DQS9X.44.12.B01.1.454.CMB.2.raw
  modified_base (525)..(525): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagtactacgtgggctggatccgccacgcccccgaagggagggctggagtggattgggagtatctattagtagtggagcacctactacaacccgtcctacaacgagtcgagtcaccaatatcgagtagacacgtaccaaagaacacgttctaccctagaacgctgagctctgtcgaccgccgcgacgcggcggtgtattactgtgcgagagtacgggctagttcgacactaactcttgaccacgtcgggccaacggggttacccttggtccaccgtccttccncacgtcccttcccgaaacccgg

SEQ ID NO: 394287 - DNA, 566 bp, Homo sapiens
  misc_feature: GZ8MTXP01DU9TB.44.12.B01.1.454.CMB.2.raw
  modified_base (156)..(156): a, c, t, g, unknown or other
  modified_base (175)..(175): a, c, t, g, unknown or other
  modified_base (222)..(222): a, c, t, g, unknown or other
  modified_base (252)..(252): a, c, t, g, unknown or other
  modified_base (293)..(293): a, c, t, g, unknown or other
  modified_base (393)..(393): a, c, t, g, unknown or other
tcagacagtatatacacgaccggtgctcgatttagtagtgtagattccgcgggggggtagctcaggaagcagagcctggagcatctccactatggcctgggctccactacttctcaccctcctcgctcactgcacaggttcttgggccaattttangctgactccaccccccctntgtgtcggagtcgtccggggaagacggtaaccatctcctgccaccgnagcactggcagcattgccagctaactttgngcagtggtaccagcagcgcccggcagtcgccccacactgtnatctatgacgactaacccgaaccgaccctcgtcggggtccctgtacttcggttctcgtcggcctcatcgacaacgcctccacctaactctcgccctcccncacctactctcgtacgacagaacgacgtaggacggacgaggctagactactacgtgtctagttctagtgagtacgacgacacatctgttgtgggttacgtcgggacgggaacggaacacgttcgcggtaaccgtccgtaagtccacggttacccgaacggttcccgtccccgg

SEQ ID NO: 394288 - DNA, 527 bp, Homo sapiens
  misc_feature: GZ8MTXP01DRAHA.44.12.B01.1.454.CMB.2.raw
  modified_base (430)..(430): a, c, t, g, unknown or other
  modified_base (436)..(436): a, c, t, g, unknown or other
  modified_base (508)..(508): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtccctcacctgcactgtctctggtgctccatcagcagtagtagttactactgggctggatccgccagcccccagggaagggctggagtggatgggatatctattatagtggagcacctactacaacccgtcctacaacgagtcgagtcaccaatatcagtagacacgtccaagaccagttctccctgaagctgagctctgtcgaccgcgcgacacggccgtgtattacngtgcgngagtaggctagttcgtcaccaattcttgaccttagtggggccaacggggttacccttggtccaccgtctccncacgtcccttcgaacccgg

SEQ ID NO: 394289 - DNA, 534 bp, Homo sapiens
  misc_feature: GZ8MTXP01EVJ2I.44.12.B01.1.454.CMB.2.raw
  modified_base (386)..(386): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactgggctggatccgccagcccccagggaagggctggagtggattgggagtatctattatagtggagcacctactacaacccgtcctcaacgagtcgagtcaccaatatcagtagacacgtaccaagaaccagttcnccctgaagctgagctctgtgaccgccgcggacacggccgtgtattactgtgcgagagtagggctagttcgtcaccaactctttgaccttacgtcggggccaggggacccttgggtccaccggtctccgtcacgcccttccgaacccgg

SEQ ID NO: 394290 - DNA, 564 bp, Homo sapiens
  misc_feature: GZ8MTXP01BKS01.44.12.B01.1.454.CMB.2.raw
  modified_base (507)..(507): a, c, t, g, unknown or other
  modified_base (546)..(546): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactcccgccacggccccccgaggggaacggggctgggagtggagttggggagtatctattataggtgggagcacctactaccaacccgtcctacaacgagtcgagtcaccaaatatcagtagacacgtaccaaagaccagttcctccctagaacgctagagctctgtcgaccggccgcggaccgacggccggttgtattcgtagtgcgagaggtagggctagttcgtacaccaacttcttagaccncgtcggggccacggggacccttggtccaccgtcgtcccncacgtccttccgaaccgg

SEQ ID NO: 394291 - DNA, 577 bp, Homo sapiens
  misc_feature: GZ8MTXP01A42TB.44.12.B01.1.454.CMB.2.raw
  modified_base (323)..(323): a, c, t, g, unknown or other
  modified_base (406)..(406): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagccccccgaggggaaggggctgggagtggagttggggagtatctattatagtggancacctactacaacccgtcctcaacgagtcgagtcaccaatactcagtagacacgtaccaaagaaccagttcctccctagaacnctgagctctgtcgaccgcgcggacacggccggtgtattactggtgcgagaggtaagggctagttccgtacacccgtaaacttccgtttagacccttacgtcgggggacccacggggaacccttcgggtccacccggtcctcccgtacgacgtcccgttcccgaaccccggg

SEQ ID NO: 394292 - DNA, 544 bp, Homo sapiens
  misc_feature: GZ8MTXP01C2ASW.44.12.B01.1.454.CMB.2.raw
  modified_base (390)..(390): a, c, t, g, unknown or other
tcagacagtatatacacgaccggtgctcgatttagtagtgtagattccgcggggggctttctgagagtcatggacctcctgtgcaagaacatgaagcacctgtggttcttcctcctgctggtggcagctcccagatgggtcctgtcccaggtgcagctgcaggagtcgggccaggactggtgaggccttcgggaaccctgtctctcatctgcactgtctctggtagttcatcagttctgatctattcgtggggctggatccggcacgccccgagggagggatggagtggatggtgacatcatatacgtggggcgacgtactactcctccgtcctaccaagacgtcgtctcaactattcgagggacacgtcatcgaaccgcttcctcctanaaactcgacctcgtcgaccgcgacgacgacgtccgtttattcgtggtcgtcggagcgagtacgtgttcttacatcgtagcgggcgtcgccaccgtgctacgtgttccttccttcaacgtcttcccgaacgacggccctaacgttccggttcccc

SEQ ID NO: 394293 - DNA, 554 bp, Homo sapiens
  misc_feature: GZ8MTXP01EZOC4.44.12.B01.1.454.CMB.2.raw
  modified_base (368)..(368): a, c, t, g, unknown or other
  modified_base (449)..(449): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggatcccgccacgccccccgaggggaacggggctggaggtggattgggagtatctattatagtggagcacctactacaacccgtccctcaacgagtcgagtcaccaatancagtagacacgtaccaagaaccagttcctacccgtgaagctgacgctcgtgtcgaccgccgcgacacggcgtgtatactgngcgagagtacgggctgttcgcaccaacttacgtttgaccttacgtcggggcccacggggttacccttggtcctacccgtctcccgtcacgtcccttcccgaaccg

SEQ ID NO: 394294 - DNA, 603 bp, Homo sapiens
  misc_feature: GZ8MTXP01CRHU8.44.12.B01.1.454.CMB.2.raw
  modified_base (265)..(265): a, c, t, g, unknown or other
  modified_base (315)..(315): a, c, t, g, unknown or other
  modified_base (374)..(374): a, c, t, g, unknown or other
  modified_base (485)..(485): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtagaagccttcggacgaccctgtcccctcacctgcactgtctctggtgctcatcagcagtagtagttactacgtgggctggacnccgccacgccccgagggagggctggagtggatgggatatctattagtagnggacgcacctactaccaacccgtcctacgaacgcgtacgagtcaacctaatatcagtanaacacgtaccaaagaaccagttcctacctgaaacgcttacgacgtcgttctggtcggaccccgcgtacggaccgtacggtccgggtagttagttaccgtggtcgcgaaggnggttacgggctagtttcgcaaaccggtaacttacgttcgacccgttacgtcgggggaccaacgggttacccgttcgggtcccaccgtctcctaccgacgtcccttaaccgaacccggg

SEQ ID NO: 394295 - DNA, 544 bp, Homo sapiens
  misc_feature: GZ8MTXP01DAFTP.44.12.B01.1.454.CMB.2.raw
  modified_base (425)..(425): a, c, t, g, unknown or other
  modified_base (526)..(526): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagccccccagggaagggctggagtggattggggagtatctattatagtggagcacctactaccaacccgtcctacaacgacgtacgagtccaccaatatcagtagacacgtccaagaaccagttcctcctgaagctgagctactgtgccgccgcggacncggccgtgtattactgtgcgagtgtagggctaggttctcaccgaacttcttgacccttacgtcggggccagggttaccccttgggtccaccgtctccgtcncgtcccttccgaacccgg

SEQ ID NO: 394296 - DNA, 568 bp, Homo sapiens
  misc_feature: GZ8MTXP01CI9VS.44.12.B01.1.454.CMB.2.raw
  modified_base (273)..(273): a, c, t, g, unknown or other
  modified_base (394)..(394): a, c, t, g, unknown or other
  modified_base (444)..(444): a, c, t, g, unknown or other
tcagacagtatatacacgaccggtgctcgatttagtagtgtagattccgcggggggtagctcaggaagcagagcctggagcatctccactatggcctgggctccactacttctcaccctcctcgctcactgcacaggttcttgggccaattttatgctgactcacccccctctgtgtcggagtcgtccggggaagacggtaaccatctcctgcacccgcagcactggcagcattgccagcaactttgtgcagtggtaccagcagcgcccgggnacgtcgcccccacactgtgatctatgacggactacccaacgaccctcgtcggggtccctgactcggttctcgtcggctcatcgacaacgcctcctcaactctcgccctccacaccatctcnggactgaagactggaggcgaggctagactactcgtgtctacgttcttagngtatacgccgtaaatactaatcgtaggttggtacggttacggtacgggacggtaaacggaccaacggttccgttacggtaacccgtacgtaacggaccgaccgacccgtaacggttccgtcccg

SEQ ID NO: 394297 - DNA, 586 bp, Homo sapiens
  misc_feature: GZ8MTXP01DK056.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactacgtggggctggactccgccacgcccccgaagggaggggctggagtggattgggagtatctattagtaggtggagcacctactaccaacccgtcctacaacgacgtcgagtcaccaatatcagtagacacgtaccaagaaccacgttctcccgtagaacgctagagtctctgtcgcccgccgcggacgaccggcggttgtattacgtgtcgcgagaggtagggctacgttcgtaccaaccctaaactacgtttcgaccgttacggtcggggcccgaacggggttacccttcggtcccacccgtcctcccgtcaccgtcccttaacccgtaacccgg

SEQ ID NO: 394298 - DNA, 628 bp, Homo sapiens
  misc_feature: GZ8MTXP01CK6NR.44.12.B01.1.454.CMB.2.raw
  modified_base (324)..(324): a, c, t, g, unknown or other
  modified_base (404)..(404): a, c, t, g, unknown or other
  modified_base (463)..(463): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggacgaccctgtcccctcacctgcactgtctctggtgctccatcagcagtagtagttactactggggctggatccgccacgcccccgaagggacgggctggagtggattgggatatctattagtagtgggacncacctactaccaaacccgtccctacaacgagtcgagtcaacaatatcagtacgaacacgtaccaaacgaaccagttaccnccctagaacgctgacgctactgtcgacccgccgcggacaccgggtcgtgttacttacgngtgcgagaggtacgggctacgttcgtaccaacctaaacttcgtttaccggaaccaccggttacggggcccgttaaccgggggttaaaccccgttggggtaacccctaacccgggttcctttacccctaccggaccgtcccccgttaaccccgtaaaaccccgggg

SEQ ID NO: 394299 - DNA, 445 bp, Homo sapiens
  misc_feature: GZ8MTXP01AVRMS.44.12.B01.1.454.CMB.2.raw
  modified_base (190)..(190): a, c, t, g, unknown or other
  modified_base (308)..(308): a, c, t, g, unknown or other
  modified_base (430)..(430): a, c, t, g, unknown or other
  modified_base (433)..(445): a, c, t, g, unknown or other
tcagacagtatatacacgaccggtgctcgatttagtagtgtagatgggatggatgaagccctatagtggcaacacgggctttgcccagaagttccaaggcagagttagtatgaccaggagccaccctccccaggtacagtctacatggaactgagcagcctgagatctgaggacacggccgtgtatttcngtgcgagacgccaccagcacctggcttgacttggcggggccagggaccctggtccaccgtctcctcagcctccacaaggcccatcggtccttccccgtggccgccctgctccgaggcnccacctccgagacgccacgacgccggcccgtggggccttcggcccgtggtaccccaaacggtacttacgttccctataacttacctgtcctgggacggccggggtctgggacaagggccganagnnnnnnnnnnnnn

SEQ ID NO: 394300 - DNA, 522 bp, Homo sapiens
  misc_feature: GZ8MTXP01A99J3.44.12.B01.1.454.CMB.2.raw
  modified_base (173)..(173): a, c, t, g, unknown or other
  modified_base (274)..(274): a, c, t, g, unknown or other
  modified_base (292)..(292): a, c, t, g, unknown or other
  modified_base (383)..(383): a, c, t, g, unknown or other
  modified_base (388)..(388): a, c, t, g, unknown or other
  modified_base (447)..(447): a, c, t, g, unknown or other
  modified_base (455)..(455): a, c, t, g, unknown or other
  modified_base (458)..(458): a, c, t, g, unknown or other
  modified_base (461)..(461): a, c, t, g, unknown or other
tcagacagtatatacacgaccggtgctcgatttagtagtgtagattccgcggggggtagctcaggaagcagagcctggagcatctccactatggcctgggctccactacttctcaccctcctcgctcactgcacaggttcttgggccaattttatgctgactccacccccctntgtgtcggagtcgtccggggaagacggtaaccatctcctgcaccgcagcactggcagcattgccagctaactttgtgcagtggtaccagcagcgcccgggnacgtcgcccccacactgngatctatgagactaaccccaacgccctcgtcggggtccctgtactcggttctcgtacgctcatcgacaagctcctcacgtctcacctcccncaccngtctcgtaggactagagaccgtggagacgtggctagactactactgtacagttcttagngatagacntanatntgtgtggttggtcggacggacggacgacgcgttcgcgtcgtcgcgacgaccgtcgcgtccg

SEQ ID NO: 394301 - DNA, 655 bp, Homo sapiens
  misc_feature: GZ8MTXP01EDDJK.44.12.B01.1.454.CMB.2.raw
tcagacagtatatacacgaccggtgctcgatttagtagtgtagattccgcgggggcttactgagagtcatggacctcctgtgcaagaacatgaagcacctgtggttcttcctcctgctggtggcggctcccagatgggtcctgtcccagctgcagctgcaggagtcgggcccaggactggtgaagccttcggacgaccctgtcccctcacctgcactgtctctggtgctccatcagcagtagtagttactacgtgggctggactccgccacgcccccgaggggaagggctggagtggagttggggagtatctattagtaggtgggagcacctactaccaacccgtccctacaaacgacgtacgacgtaccaacctaaatatcaagtagaccaccgtaccaaacgaacctacgtttcctacccgttagaaacgcgtgaagtccttcgtggtccggaaccccgcccggaccgggaaccgaccgggtcccgggttaggttaacgtttaccgtaggtcggacggagtacgggtacggggctaggttccgtaccaaccgtaaacttcgtttacggacccgttacggtcgggggacccacggggttacccttggtaacccacccggttctcccgtcaccggtccccttaaccgaaccccgg

SEQ ID NO: 394302 - DNA, 565 bp, Homo sapiens
  misc_feature: GZ8MTXP01D71JB.44.12.B01.1.454.CMB.2.raw
  modified_base (174)..(174): a, c, t, g, unknown or other
  modified_base (251)..(251): a, c, t, g, unknown or other
  modified_base (368)..(368): a, c, t, g, unknown or other
  modified_base (478)..(478): a, c, t, g, unknown or other
tcagacagtatatacacgaccggtgctcgatttagtagtgtagattccgcggggggtagctcaggaagcagagcctggagcatctccactatggcctgggctccactacttctcaccctcctcgctcactgcacaggttcttgggccaattttatgctgacctccacccccctntgtgtcggagtcgtccggggaagacggtaaccatctcctgcacccgcagcactggcagcattgccagctaactttgngcagtggtaccagcagcgcccgggcagtcgcccccacactgtgatctatgacggaactaaccccaacgtaccctcgtcgggggtccctgtacttcggtctcgtcggcctcatcgacncgctcctcaactctcgccctcctcacctatctctggactgaaagtacgtggacggacgaggctagaacttactacgttgtctagttcttagtgatagacagtctaaatcngtcggtgggttacgttcggggacggaacgggaccaaggttcttacggaacccgtcgtaaggtccacgacccgtaaggccgtccccgg

SEQ ID NO: 394303 - DNA, 805 bp, Homo sapiens
  misc_feature: GZ8MTXP01AJD40.44.12.B01.1.454.CMB.2.raw
  modified_base (422)..(422): a, c, t, g, unknown or other
tcagacagtatatacacgaccggtgctcgatttagtagtgtagattccggggggaggaactgctcagttaggacccagagggaaccatggaagccccagctcagcttctcttcctcctgctactctggctcccagtttcagattccagcggcgaaactgtgttgacacagtctccagccaccctgtctttgtcgtccgggggaacacgcccaccctctcctgcgacgggccggccagactgttcgaacaacgacttagcctggtaaccaacagaacgcctggccaggcctcccgaggcctcctcatctaatgacttccttcgaggtacgggccactggacctacgtccccgacgtccccgtactttcgacggtcggacgaggggttcggggtcgtgggggacctagggtaacgttttaaccncttccaccctacttcctacccacggtaccctaagggtaccgtacccgtaagggtaaacgttaagtttttccggggatttaaacggttttactttaacgtcggttaaccgacggttaccccgttaaccgggaccgtaaaacgggtaaaccggggttcgggtaccccgttaacccttaaaacgtttacctttacccggttaacccggttttccccggggaaccccggttacgggggaaaacccctaaaaggggttagggaaacttaaaccgtaacgttaaaaaaccccgggtgttaacggggttcgggaccttaccgggcccttaaccgttaacgttacccttcggttccctttaccgttacctttcccggtttccccgtaaccc

SEQ ID NO: 394304 - DNA, 592 bp, Homo sapiens
  misc_feature: GZ8MTXP01DOR98.44.12.B01.1.454.CMB.2.raw
  modified_base (352)..(352): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagacccctgtcccctcacctgccactgtctctggtgctccatcagcagtagttagttactacgtgggctggactccgccacgcccccgagggaaggggctggagtggattgggattatctattagtagtggagcacctactaccaaccgtcctcaacgngtcgagtcaccaaatatcagtagacacgtaccaaacgaacctacgttcctccctagaagcctagacgtctactgtcgacccgccgacggacgaccggccggttgttacttccgtgtcgacgtaggaggtacggggctaggttccgtacaacccgtaacttacgtttcgacccacggtcggggaccttaacggggacccttgggtccacccgtctccctcgacgtcccttccgaacccggg

SEQ ID NO: 394305 - DNA, 579 bp, Homo sapiens
  misc_feature: GZ8MTXP01BEFLW.44.12.B01.1.454.CMB.2.raw
  modified_base (330)..(330): a, c, t, g, unknown or other
  modified_base (360)..(360): a, c, t, g, unknown or other
  modified_base (376)..(376): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagacccctgtcccctcacctgcactgtctctggtgctccatcagcagtagtagttactacgtgggctggactccgccacgcccccgagggaacggggctgggagtggagttggggagtatctattagtaggtgggancgacctactaaccaacccgtcctacaacgngtcgagtcaccaatancatagacacgtcaagacagtctcctagagctagagtctcgtcgtcgacccgcgcggacgacggccggttgtacttactggtgcgagaggtacgggctacggttccgtaccaacccgtaactttacgttcgaacccttacggcggggtaccaacggggttcccttgggtccaccgtctccctcgacgtcccgttccgaacccgg

SEQ ID NO: 394306 - DNA, 563 bp, Homo sapiens
  misc_feature: GZ8MTXP01CJPVO.44.12.B01.1.454.CMB.2.raw
  modified_base (349)..(349): a, c, t, g, unknown or other
  modified_base (444)..(444): a, c, t, g, unknown or other
  modified_base (550)..(550): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagacccctgtcccctcacctgcactgtctctggtgctccatcagcagtagtagttactactggggctggatccgccagcccccgagggaagggctggagtggattgggagtatctaattatagtggagcacctactacaacccgtcctacaaacgngtcgagtcaccaatatcagtagacacgtaccaaagaaccagttctccctagaagctgagctctgtcgaccgcgcggacacggccggtgtattacngtgcgagagtaggctagttcgcacctaaactcgttgaccttaggtcggggcccaacgggggttaacccttgggttcccaacccggttctccctacaccggtccccncccgaaaccccgg

SEQ ID NO: 394307 - DNA, 544 bp, Homo sapiens
  misc_feature: GZ8MTXP01C0ZUL.44.12.B01.1.454.CMB.2.raw
  modified_base (351)..(351): a, c, t, g, unknown or other
  modified_base (368)..(368): a, c, t, g, unknown or other
  modified_base (451)..(451): a, c, t, g, unknown or other
  modified_base (521)..(521): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcaagtagtagttactactggggctggatccgccagcccccagggaaggggctggagtggattggggagtatctattatagtgggagcgacctactacaaccccgtcctcaaacgngtcagtcaccaatactnagtagaacacgtaccaaacgaaccagttctccctagaagcctagagcttactgtcgaccgccgcggacacggcgtgtattacngtgcgagagtagggctagtcgcaaccgtaatcttgaccacgtcggggccacgggaccttggtccacgtcncctcgacgtcccttcgaacccgg

SEQ ID NO: 394308 - DNA, 711 bp, Homo sapiens
  misc_feature: GZ8MTXP01DQ9QV.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagtactacgtgggctggactccgccacggcccccgaaggggaacggggctaggagtggagttggggattatcttaattagtaggtgggacgactaacctactaacccgaaccccgtccctacgaaacgacgtacgagtccaacctaaattactccgaagtaacgaaccgaaccgtaccaaacgtaaccgtaacgttccctacccgtaggaaacgtctagacgtcttccgtagtccggacccgacccggacgggaaccgtacccggtaccggttacgttaacgtttaccgtggtcggacgtaggtagggttacgggtcgtaacggtttccgtaaccaacccgttaaactttaccgtttcgaacccgttacgggttaccgggggaccgttaaaccggggttaccccgttggttaaccccaacccggttcttaccccgttcgacccggtccccttaaccccgtaaacccggg

SEQ ID NO: 394309 - DNA, 704 bp, Homo sapiens
  misc_feature: GZ8MTXP01AX1H8.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagtagtagttactacgtgggctggactcccgccgacgcccccgaggggaacgggctggagtggagttgggagtatctagttagtaggtggacgctaccgtactaccaacccgtccctacgaacgacgtacgagtaccacccaaatactcaagtacgaacctaccgtaccaaacgaacctaacgttcctacccgtagaacgtcctaggaacgtcctcgtcggtaccggaccccggccgaccgggaaccgtacccgggtaccgggttagttaacgtttaccgtagggttacggcggtaaggtacgggtacggggtccttaacgggttaccgtacctaaaccctaaacgtttacctttacggacccttaaccggtcggggggacccttaccggggttaaaccccggttcgggttccctaaccccggttccttaccccgtaccgacccggtccccttaacccggaaaccccggg

SEQ ID NO: 394310 - DNA, 602 bp, Homo sapiens
  misc_feature: GZ8MTXP01BPUYE.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctccagatgggtcctgtcccagctgcagctgcaggagtcgggcccaggactggtgaacgccttcggagaccctgtccctcacctgcactgtctctggtgctcatcagcagtagtagtactacgtgggctggatccgcacgccccgagggagggcgtggagtggattgggagtatctattataggtgggagctaaccgtactaaccgaacccgtcctacaacgagtacgagtcaccaatatcaagtaacgactaccgtaccaaagaaacctagttactacccgtagaacgcgttagacgtctagtcgtcgacccgccgacggacgacggccggtagtatacgtggtagcgaagaggtacggctacggttcacgtaaccaacttaccgttcgaccgttacggtcgggggaccttaacgggggaacccttcggggtaaccctaccggtctccctcgaccggtcccttcccgaaacccgg

SEQ ID NO: 394311 - DNA, 503 bp, Homo sapiens
  misc_feature: GZ8MTXP01A28I2.44.12.B01.1.454.CMB.2.raw
  modified_base (154)..(154): a, c, t, g, unknown or other
  modified_base (171)..(171): a, c, t, g, unknown or other
  modified_base (193)..(193): a, c, t, g, unknown or other
  modified_base (216)..(216): a, c, t, g, unknown or other
  modified_base (370)..(370): a, c, t, g, unknown or other
  modified_base (385)..(385): a, c, t, g, unknown or other
  modified_base (422)..(422): a, c, t, g, unknown or other
  modified_base (436)..(436): a, c, t, g, unknown or other
  modified_base (438)..(438): a, c, t, g, unknown or other
  modified_base (442)..(442): a, c, t, g, unknown or other
  modified_base (445)..(445): a, c, t, g, unknown or other
  modified_base (450)..(450): a, c, t, g, unknown or other
  modified_base (463)..(463): a, c, t, g, unknown or other
  modified_base (485)..(485): a, c, t, g, unknown or other
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttangctgactcacccccctntgtgtcggagtctccggggaanacggtaaccatctcctgcaccgnagcactggcagcattgccagcaactttgtgcagtggtaccagcagcgcccgggcagtcgcccccaccactgtcgatctatgaggactaccccaacgaccctcgtggggtccctgactcggttctctcggctcatcgacaacgctcctcaactcncgacctccctcaccntctctggactgaaagctagagaccgaggctgactacncgtgtcatcttagnanagcngtnatcgntgtgttgtcgggnggacggacagcttcgccgtcgngcacgaccgcggcctccg

SEQ ID NO: 394312 - DNA, 556 bp, Homo sapiens
  misc_feature: GZ8MTXP01EC396.44.12.B01.1.454.CMB.2.raw
  modified_base (366)..(366): a, c, t, g, unknown or other
  modified_base (451)..(451): a, c, t, g, unknown or other
  modified_base (460)..(460): a, c, t, g, unknown or other
  modified_base (485)..(485): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtccctcacctgcactgtctctggtgctccatcagcagtatagttactactggggctggatccgccagcccccgagggaaggggctggagtggattgggagttatctattataggtggagcacctacttaacaacccgtcctacaacgagtacgagtccacaatancagtagacacgtaccaagaacctagttctccgtagaacgctgacgctctcgtcgaccgcgacggacaccggcgttagtattacgngtagcgagngtagggctagttcgtcacgtaactntttcgaccagttcgggccttacgggacccttgggttccaccgttctcccgtcacgtcccttccgaacccgg

SEQ ID NO: 394313 - DNA, 666 bp, Homo sapiens
  misc_feature: GZ8MTXP01DT8E1.44.12.B01.1.454.CMB.2.raw
  modified_base (261)..(261): a, c, t, g, unknown or other
  modified_base (479)..(479): a, c, t, g, unknown or other
tcagacagtatatacacgaccggtgctcgatttagtagtgtagattccgcgggggcttactgagagtcatggacctcctgtgcaagaacatgaagcacctgtggttcttcctcctgctggtggcggctcccagatgggtcctgtcccagctgcagctgcaggagtcgggccaggactggtgaagccttcggagaccctgtcccctcacctgcactgtctctggtgctcatcagcagtagtagttactactggggctggacnccgcacgcccccgagggaagggctggagtggattggggatatctattagtagtggagcacctactacaacccgtcctacaacgacgtacgacgtcaaccctaaatactcagtaacgaacaaccgtaccaaacgtaaacctagttacctaccctagaagctgagtcctctgtcgacccgccgacggaaccaccgggtccggttagttaacgtttaccgnggttcggacggaggtaacggttacgggggtcctacgggtttaccgtaccaaacccgttaaacgttacgtttacgggtaacccttaaacgggttccgggggaacccaacgggggttaaccccgttacgggtaaccctaacccggttcctaccccgttacgaccggtccccttaacccgaaaccccggg

SEQ ID NO: 394314 - DNA, 582 bp, Homo sapiens
  misc_feature: GZ8MTXP01A9T23.44.12.B01.1.454.CMB.2.raw
  modified_base (261)..(261): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtgggctgganccgcacgccccgagggagggctggagtggagttgggagtatctattataggtggagcactactacaacccgtcctcaacgagtcgagtcaccaatactcagtagacacgtaccaaagaacctagttccctaccctaggaaacgtcgtagacgtctccgttgacgacccgccgcggacacggccggtgttataccgtgtcgacgagtaggtagggctaaggttccgtacaaccctaaactactttcggaaccttacggtcggggcccacggggaccccttagggtcccaccggtctcccgtacacgcccttccgaaacccgg

SEQ ID NO: 394315 - DNA, 671 bp, Homo sapiens
  misc_feature: GZ8MTXP01BJWK2.44.12.B01.1.454.CMB.2.raw
  modified_base (324)..(324): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggacgaccctgtcccctcacctgcacttgtctcgtggtcgctccatcagcagtagtagttactacgtggggctggactccgccacgcccccgagggagggctggagtggagtgggatatctattagtagtggancactactacaacccgtccacaacgagtcgacgtcaccaatactcgagtaagacaccggtaccaaacgaaacctacgtttccctaccgtagaacgctagacgcttcgtacgtacgacccggccgcggaaccgaccggtaccgggttagtttaacgtttccgtaggttcgccggtaaggaggttacggggcgtacggtttaccggtacctaacccgtaaacgtttaacctttcggaaacccgttaccggttacgggggaccccgaacggggttaaccccgttcgggtaaccccgtacccgggttccttccccgtacgttacccgccccgttaaccccggaaaaccccgg

SEQ ID NO: 394316 - DNA, 686 bp, Homo sapiens
  misc_feature: GZ8MTXP01CXBIP.44.12.B01.1.454.CMB.2.raw
  modified_base (176)..(176): a, c, t, g, unknown or other
  modified_base (224)..(224): a, c, t, g, unknown or other
  modified_base (233)..(233): a, c, t, g, unknown or other
  modified_base (252)..(252): a, c, t, g, unknown or other
  modified_base (279)..(279): a, c, t, g, unknown or other
  modified_base (285)..(285): a, c, t, g, unknown or other
  modified_base (292)..(292): a, c, t, g, unknown or other
  modified_base (296)..(296): a, c, t, g, unknown or other
  modified_base (366)..(366): a, c, t, g, unknown or other
tcagacagtatatacacgaccggtgctcgatttagtagtgtagattccgcgggggggtagctcaggaagcagagcctggagcatctccactatggcctgggctccactacttctcaccctcctcgctcactgcacaggttcttgggcctaattttatgctgacctccacccccctntgtgtcggagtcgtccggggaagaccggtaaccatctcctgccaccgnagcatggcngcatgccagctaactttgngctaggtggacagcagccggccggacncgcccnccccacntganatctagaggacgaacctaaccccgacgccgtcggtcggcctgtcgttcgtctcgtcgcctcgatccgacncctcctccctactaccgtcctccctcccctaccctacacctacttccgtacgtacggtactaacggaaacgtacggtaaggggaacggacggtacggtctaacgtaaccttaccgttacggttacgtacgttaacgttacttaagtagtaaagtacgacgtaaactaactaacgtacgtaggttaacgggttacgggttacgggttacggggaccggggtaacgggtaaccggttaacggttaccggttacccggtaaccggttaccggttaaccggtaaccggtaccggttacccggtaacccggttcccggtccccgg

SEQ ID NO: 394317 - DNA, 472 bp, Homo sapiens
  misc_feature: GZ8MTXP01EMB9G.44.12.B01.1.454.CMB.2.raw
  modified_base (410)..(410): a, c, t, g, unknown or other
  modified_base (459)..(472): a, c, t, g, unknown or other
tcagacagtatatacacgaccggtgctcgatttagtagtgtagatttgagtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagccctccctggccatcactgggctccaggctgaagatgagggtgattattactgccagtcctatgacagcagcctcgagttggttgggtgtcggcggaggacaagctcgaaccgtcgtgggtcacgcccaaggctcgcccctggtcactctcgtcccnccctcctctatatactgtctgacgcgggcgtggacgaaggcgcagtagnnnnnnnnnnnnnn

SEQ ID NO: 394318 - DNA, 664 bp, Homo sapiens
  misc_feature: GZ8MTXP01BCUT1.44.12.B01.1.454.CMB.2.raw
  modified_base (319)..(319): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggacgaccctgtccctcacctgcactgtctctggtgctcatcagcagtagtagttactacgtgggctggactccgcacgccccgagggagggctggagtggagttgggatatctattagtaggtggacnctaacctaactaccaacccgtcctacgaaacgcgtacgagtaccaaccgaaattactcgaagtaacgaccgtaaccgtaaccgaaaacgtaaccctacgttaccctacccgtagaaacggtcttaggacgtctcgtcgtacgacccgcgacggacgacgggccgttagtacgttaccgtgtcgacggtagacggtacggggactcggtttaccgtaccgaaccttaaacgtttcgtttaccggaaccgttacgggttacggggacccggaaccgggttacccgttcgggtaacccacccgggttccgaccccgttcccgacccgtaacccgaaccggaacccggg

SEQ ID NO: 394319 - DNA, 531 bp, Homo sapiens
  misc_feature: GZ8MTXP01BEC6J.44.12.B01.1.454.CMB.2.raw
  modified_base (356)..(356): a, c, t, g, unknown or other
  modified_base (395)..(395): a, c, t, g, unknown or other
  modified_base (472)..(472): a, c, t, g, unknown or other
  modified_base (512)..(512): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactgggctggatccgcagcccccaggagggctggagtggatgggagtatctattatagtggagcacctactacaacccgtcctcaacgagtcgagtcacccaatactnagtagacacgtcaagaccagttctcctgaagctgagctntgtgaccgccgcggacacggccggtgtattactgtagcgagagtacgggctaagtcgtcgacctaactctttgaccncgtcggggccacgggacccttgggtccacggtcttacccncgacgtccgttccgaaccg

SEQ ID NO: 394320 - DNA, 566 bp, Homo sapiens
  misc_feature: GZ8MTXP01A0SMW.44.12.B01.1.454.CMB.2.raw
  modified_base (321)..(321): a, c, t, g, unknown or other
  modified_base (372)..(372): a, c, t, g, unknown or other
  modified_base (392)..(392): a, c, t, g, unknown or other
  modified_base (444)..(444): a, c, t, g, unknown or other
  modified_base (538)..(538): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggatccgccacgcccccgagggaaggggctggagtggattgggagtatctattatagtggancgaacctactacaacccgtcctacaacgagtcgagtcaccaatatcagtanacacgtcaagaccagttccncctgaacgctgagctctgtcgacccgccgcgacgcggccggtgtacttacgngtgcgagagtacggggctgtttccgacaacctaacttaacgtttcgaaccacgttcggggaccacggggaacccttggggtcccacccggttcnccctacgccgtcccttccgaaaccccgg

SEQ ID NO: 394321 - DNA, 582 bp, Homo sapiens
  misc_feature: GZ8MTXP01DYT2U.44.12.B01.1.454.CMB.2.raw
  modified_base (445)..(445): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtccctcacctgcactgtctctggtgctccatcagcaagtagtagttactacgtggggctggactccgccacggcccccgaagggaagggctggagtggattgggatatctattatggtggagcacctactaaccaacccgtcctacaagacgtacgacgtcaacccaatatcgaagtacgaaccaacgtaccaaagaacctacgttcctcccgtagaacgctgaagctacgtgtcgaccgccgnggacacggcggtagtattatcgtgcgagaggtaaggctagttcgacaaccgtaaacttcgttacgaccttacggtcggggacccaggggttaccccttggtcccaccgtctccgtcacggtcccttaaccgaacccg

SEQ ID NO: 394322 - DNA, 515 bp, Homo sapiens
  misc_feature: GZ8MTXP01CGZKL.44.12.B01.1.454.CMB.2.raw
  modified_base (305)..(305): a, c, t, g, unknown or other
  modified_base (454)..(454): a, c, t, g, unknown or other
  modified_base (476)..(476): a, c, t, g, unknown or other
  modified_base (500)..(515): a, c, t, g, unknown or other
tcagacagtatatacacgaccggtgctcgatttagtagtgtagatttgagtttgggggctgttcctggaaggtgttggtaccagagggtcaccatctcctgcactgggagcagatccaacatcgggacagattctgatgtccactggtaccaacaccttccaggaacacgcccccaaactcctcatctttggtaacaactatccggccctcaggggtccctgaccgattctctggctccaagtctggcacctcacgccctcctggcccatcacgtgggcctccgaggctagaagagtggagggtntattattactgccagtcctatgacagcacgcctcgtaggttgggttgggtggttccgggccgggagggacagctcggaacccgtcgtgggcacgcccgaggcctccgcccctcggtcctacgtcctccgtccccgccttcctcttactntacgtgtcgtggacgtccgggngtcgggacgtacggcgacaagtgnnnnnnnnnnnnnnnn

SEQ ID NO: 394323 - DNA, 696 bp, Homo sapiens
  misc_feature: GZ8MTXP01B6A4T.44.12.B01.1.454.CMB.2.raw
  modified_base (266)..(266): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggtccaggactggtgaagccttcggagaccctgtcccctcacctgctactgtctctggtgctccatcagcagtagttacgttactacgtgggctggacnccgccacgccccgagggagggctggagtggagttgggatatctaagtttagtacggtagggacgtacctaaccttaaccgttaaccccgtaaccccgttccccgtacgaaacggacggtcggaacgttacccaaccctaaattactaacgacgtaaacgaaccctacgtacccaaacggtaaaccctagttaccctccgtagaacgctgacgtcctcgtgtcgacccgccgcggacgacccgggtcgttagttacgttaccgtggtacggacggtaggtacggacggggtctacgggttccctaccaacccgtaaacttcgtttaccgacccgttaacgggtaccgggggacccttaaccggggttacccttccggggtaaccctcccggttcctcccgtccgaccgtccccgttaacccgaaccccggg

SEQ ID NO: 394324 - DNA, 599 bp, Homo sapiens
  misc_feature: GZ8MTXP01ATDIG.44.12.B01.1.454.CMB.2.raw
  modified_base (319)..(319): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagtactacgtgggctgatccgccagcccccagggaacgggctggagtggagttcgggagtatctattataggtgggancacctactaccaacccgtcctcaacgagtcgatcgacaatatcagtagacacgtacctaacgaacctagttcctacccgtgaagctggagccttatcgtcgacccgccgacggacaaccggccgggttagtacttaccgtggtcgacggtagacggtaggcgtaagttccggtacaacctaacgtacctttcggaacccttacggttacggggaccgacgggttaccccttgggtaaccacccgttcctccctcgacgtcccgttcccgtaaaccccggg

SEQ ID NO: 394325 - DNA, 689 bp, Homo sapiens
  misc_feature: GZ8MTXP01D605Z.44.12.B01.1.454.CMB.2.raw
tcagacagtatatacacgaccggtgctcgatttagtagtgtagattccggggggaggaactgctcagttaggacccagagggaaccatggaagccccagctcagcttctcttcctcctgctactctggctcccagtttcagattccagcggcgaaactgtgttgacacagtctccagccaccctgtctttgtcgtccgggggaacgagcccaccctctcctgcagggccgcagactgttgaacaacgacttagccgtggtaaccaacagaacgcctcggccaggcctcccgaggctcctcatctatgatactccgaggtacggccactcggcactcccgacgcccgtcttcaggtcggcgaggttcgggtcgtggggactaggtacgtttaacctcttcacctatcctaccacgtcccgtaagacgtcctagaagttatttgacttagttttaacttacgttgtaccacgtccgtaccgaacgtaaaggtaacggttcggaccccttaactaactttaacgttcccttaccggtttacccggtaccccggttacgggaaacctaaacgggtgggtaaacttaaacgttaaaccgaaaacggtaaccgttagggtacgggcttaccggccttaacccttaacttccgttcggtttcccttacttaccgtttccccttcccggttaacccc

SEQ ID NO: 394326 - DNA, 738 bp, Homo sapiens
  misc_feature: GZ8MTXP01E0SF7.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggacgaccctgtcccctcacctgcactgtctctggtgctccatcagcagtagtagttactacgtgggctggactcccgccacgcccccgagggaacggggcgtggagtggagttggggagtatctattagtaggtgggagctacctactaccgaaccccgtccctacgaacgacgtcgacgtcaccaattatcaagtagaccacgtaccgaaacgaaaccctacgttccctacccgttagaacgtccgtaggacgtccttcgtacggtacggaaccccggcccgggaaccgggaaccgtaaccggggtccccgggtttaggtttaactttaccggtacgggttcgggaccggtaagggtacgggttacgggggtaccttaacgggttttcccggtaaccctaaaccccgttaaacgtttccgttttaccgggaaacccgttaccggggttacgggggaaccccgttaaccggggggttaaaccccttcgggtaaccctacccgggttcctcccgtccaccgggtccccttaacccgaaaccccgggg

SEQ ID NO: 394327 - DNA, 666 bp, Homo sapiens
  misc_feature: GZ8MTXP01A98KX.44.12.B01.1.454.CMB.2.raw
tcagacagtatatacacgaccggtgctcgatttagtagtgtagattccgcggggggtagctcaggaagcagagcctggagcatctccactatggcctgggctccactacttctcaccctcctcgctcactgcacaggttcttgggcctaattttatgctgacctccacccccctctgtgtcggagtcgtccgggaagacggtaaccatctcctgccaccgcagcactggcagctattcgaccagctaacgtttgtagcgaggtcggtaccagcgacggccggcccgggcacgtccgacccccactaccgtgtacgatcgtagtacggaacggtaactaaccccgaaccgtaccccgtcggttcgggggtcctggtacttccggttctcgtccggaccttcgatcgacacgtaccctcctaccaacctctccgtcccctccctactaccctacttccgtcgtacggtaactacggaacgtacgtacgggacgggtaacgacggtcgtaccgtaacttaccgttacggtcgttaccttacggttatttagagtacgtacgacagtactaacgtcgttaagtgggtacggttacggtcggggacggacgggtaacacggcttcggaacccgttcgaacggccacggacccgtaaggttcccgtccccgg

SEQ ID NO: 394328 - DNA, 581 bp, Homo sapiens
  misc_feature: GZ8MTXP01AX1P3.44.12.B01.1.454.CMB.2.raw
  modified_base (265)..(265): a, c, t, g, unknown or other
  modified_base (486)..(486): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagacccctgtcccctcacctgcactgtctctggtgctccatcagcagtagtagttactacgtggggctggacnccgccacgcccccgaagggaacggggctggagtggagttggggatatctattatacgtggagcactactacaacccgtcctacaacgagtcgagtccacgaaatatcagtagacacgtaccaacgaaacctagttcctaccctgaaacgcgtgagtctcgttgcgacccgccggacggaaccgaccgggtccggtaggtacttaccgtggtagccggaagnggtaacgggctaagttccgtacaccaacttacttcgaccttacgtcgggcaacgggacccttgggtccaccgtctcctcacgccttccaacccgg

SEQ ID NO: 394329 - DNA, 668 bp, Homo sapiens
  misc_feature: GZ8MTXP01AHCEY.44.12.B01.1.454.CMB.2.raw
  modified_base (177)..(177): a, c, t, g, unknown or other
  modified_base (263)..(263): a, c, t, g, unknown or other
  modified_base (282)..(282): a, c, t, g, unknown or other
  modified_base (326)..(326): a, c, t, g, unknown or other
  modified_base (456)..(456): a, c, t, g, unknown or other
  modified_base (556)..(556): a, c, t, g, unknown or other
  modified_base (599)..(599): a, c, t, g, unknown or other
tcagacagtatatacacgaccggtgctcgatttagtagtgtagattccgcgggggggtagctcaggaagcagagcctggagcatctccactatggcctgggctccactacttctcaccctcctcgctcactgcacaggttcttgggcctaattttatgctgacctccaccccccctntgtgtcggagtcgtaccggggaagacggtaaccatctcctgccaccgcagcacgtggcagctattcgaccaagtcttaactttggngacgaggttcggtaacccngccacggcccggcccgggcacgtcccgaccccccacacgtcgtnattctagtaggacggaacctaaccccgaaccgtcccgtcggttccgggtacctgtacttcggttctcgtccgcctcacgtaccgcaactcctccctacctactccctcctcccctcctaccacctcttcncggtagacgtacggacacggtaggaacgggtacgtacggctaacggaacctttaactcggttgtacttgtttatagtagtacagacagtacctaattcgngggttaacggtggtttacgggcggggaacgggaacgaaccggngttaccggttacggaacccggttactaacgggaccgaccgggttaacccgcggggttccctcccccggg

SEQ ID NO: 394330 - DNA, 557 bp, Homo sapiens
  misc_feature: GZ8MTXP01CDKAC.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaagggctggagtggattgggagtatctattatagtggagcacctactacaacccgtccctacaacgagtcgagtcaccaatatcagtacacgactaccaacgaacacgttactcctcgaagctgaggctctgtcggaccgcccggcggacgaaccggccggggtcgtacgttactgtgcgagaggtaagggcgtagttcgtcaccaacgttacttgaccacgtcggggccgaacggaccgttcggtccaccgtccgtcctcacgtcccttcaaccccgg

SEQ ID NO: 394331 - DNA, 523 bp, Homo sapiens
  misc_feature: GZ8MTXP02GCXF7.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagtagtagttactactggggctggatccgccagcccccaggaagggctggagtggattgggagtatctattatagtggagcacctactacaaccgtcctcaacgagtcgagtcaccatatcagtagacacgtaccaagaaccagttctccctgaagctgagctctgtcgaccgccgcgacacggccgtgtatactgtgcgagagtagggcagttcgtcacctaactactttgaccacgtcgggccacgggaaccctggtcaccgtctacctcacgccctcaacccg

SEQ ID NO: 394332 - DNA, 544 bp, Homo sapiens
  misc_feature: GZ8MTXP02GCBAQ.44.12.B01.1.454.CMB.2.raw
  modified_base (314)..(314): a, c, t, g, unknown or other
  modified_base (363)..(363): a, c, t, g, unknown or other
  modified_base (524)..(524): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccaggagggctggagtggatgggagtatctattatagtggancgacctactacaacccgtcctacaacgagtcgagtcaccatatcagtanacacgtaccaagaaccagttcctccctagaagctagagctctagtcgaccgccgcgacgacggccgtgtattacgtgtgcgagagtagggctagtcgtcaaccacttacgttgacctagtcggggaccaacgggaacccttggtaaccacccgtcttcccncgacgccctaccaaacccgg

SEQ ID NO: 394333 - DNA, 530 bp, Homo sapiens
  misc_feature: GZ8MTXP02FTNJO.44.12.B01.1.454.CMB.2.raw
  modified_base (384)..(384): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagtagtagttactactggggctggatccgccagcccccaggaaggggctggagtggattgggagtatctattatagtggagcacctactacaacccgtcctcaagagtcgagtcaccatatcagtagacacgtccaagaaccagttcnccctgaagctgagctctgtgaccgccgcggacacggccgtgtattactgtgcgagagtagggcagttcgtcacccaactactttcgaaccacgtcgggggccaggggaacccctggtccaccgtctccgtcacgccctccaacccg

SEQ ID NO: 394334 - DNA, 524 bp, Homo sapiens
  misc_feature: GZ8MTXP02JPQ2D.44.12.B01.1.454.CMB.2.raw
  modified_base (404)..(404): a, c, t, g, unknown or other
  modified_base (516)..(516): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagtagtagttactactggggctggatccgccagcccccagggaagggctggagtggattgggagtatctattatagtgggagcacctactacaacccgtccctcaacgagtcgagtcaccatatcagtagacacgtccaagaaccagttctccctgaagctgagctcngtgaccgcgcggacacggccgtgtattactgtgcgagagtagggcagttcgtacacaactactttgaccactggggccaggggaacccctggtcaccgtctcctcacgtccnccaacccg

SEQ ID NO: 394335 - DNA, 532 bp, Homo sapiens
  misc_feature: GZ8MTXP02IKA7Q.44.12.B01.1.454.CMB.2.raw
  modified_base (383)..(383): a, c, t, g, unknown or other
  modified_base (390)..(390): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaagggctggagtggattgggagtatctattatagtggagcacctactacaacccgtcctcaacgagtcgagtcaccatatcatagacacgtccaagaccagttcncctgaanctgagctctgtgaccgcgcgacacggccgtgtattactgtgcgagagtagggcagttcgcaccaactactttgaccctagtcggggccaacggggaaccctgggtaaccacccggtctaccgtcacgtccctaccaacccgg

SEQ ID NO: 394336 - DNA, 548 bp, Homo sapiens
  misc_feature: GZ8MTXP02I4XUE.44.12.B01.1.454.CMB.2.raw
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccaggaagggctggagtggatgggagtatctattatagtgggagcacctactacaaccccgtcctcaagagtcgagtcaccatatcagtagacacgtccaaagaaccagttctccctgaagctgagctctgtgaccgccgcggacacggccgtgtacttactggtgcgagaggtagggcagttccgtcacccgaaacttactttggaccctacgtcggggcccaacggggaacccctgggtccacccggtctacccgtcacgccctacccaacccgg

SEQ ID NO: 394337 - DNA, 523 bp, Homo sapiens
  misc_feature: GZ8MTXP02IM620.44.12.B01.1.454.CMB.2.raw
  modified_base (206)..(206): a, c, t, g, unknown or other
  modified_base (361)..(361): a, c, t, g, unknown or other
  modified_base (382)..(382): a, c, t, g, unknown or other
  modified_base (389)..(389): a, c, t, g, unknown or other
  modified_base (509)..(509): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctnacctgcactgtctctggtgctccatcagcagtagtagttactactggggctggatccgccagcccccaggaagggctggagtggattgggagtatctattatagtggagcacctactacaacccgtcctcaagagtcgagtcaccatatcagtanacacgtccaagaaccagttcncctgaanctgagctctgtgaccgccgcggacacggccgtgtattactgtgcgagagtaggcagttcgcacctaactactttgacctacgtcgggccaacggaaccctggtaaccgaccgtctcctanacgcctacaacccg

SEQ ID NO: 394338 - DNA, 524 bp, Homo sapiens
  misc_feature: GZ8MTXP02GVZ0V.44.12.B01.1.454.CMB.2.raw
  modified_base (339)..(339): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaagggctggagtggattgggagtatctatatagtggagcactactacaacccgtcctcaagngtcgagtcaccatatcagtagacacgtaccaagaaccagttctccctgaagctgagctctgtcgaccgcgcggacacggcctgtacttacgtgtgcgagagtgggcagttcgcactactacttcgacctacgtcgggaccacgggaccctggtccaccggtctcccgtcacgccctaccaacccg

SEQ ID NO: 394339 - DNA, 595 bp, Homo sapiens
  misc_feature: GZ8MTXP02GUT5I.44.12.B01.1.454.CMB.2.raw
  modified_base (208)..(208): a, c, t, g, unknown or other
  modified_base (434)..(434): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggcccaggactgggtgaagccttcggagaccctgtcccctnacctgcactgtctctggtgctccatcagcagtagtagttactactggggctggactccgccacggccccccgaggggaaggggctgggagtggattggggagtatctattatagtgggagcacctactaccacccgtcctacaacgagtcgagtcaccatatcagtagacacgtccaagaaccagttctccctagaacgctgacgtctctgtcgaccgcgcggacncggccgtgttatactgtgcgagaggtagggcagttcgacaacccgtaacttacgtttcgaacccgtacggttacgggggacccgaaacggggtaacccccgttgggtaacccgtaacccggtccttcccgtaccaaccggtcccctacccgaaacccccgg

SEQ ID NO: 394340 - DNA, 526 bp, Homo sapiens
  misc_feature: GZ8MTXP02GCE6J.44.12.B01.1.454.CMB.2.raw
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagcccccaggaagggctggagtggattgggagtatctattatagtggagcactactacaacccgtcctcaacgagtcgagtcaccatatcagtagacacgtccaagaaccagttctccctgaagctgagctctgtcgaccgccgcgacacggccgtgtattactgtgcgagagtagggcagttcgacaccaacttactttgacctacgtcggggccacgggaaccctggtaaccaccgtctccgtcacgcctaccaacccg

SEQ ID NO: 394341 - DNA, 543 bp, Homo sapiens
  misc_feature: GZ8MTXP02I5GK0.44.12.B01.1.454.CMB.2.raw
  modified_base (448)..(448): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagtagtagttactactggggctggatccgccagcccccaggagggctggagtggattgggagtatctattatagtgggagcacctactacaacccgtcctcaagagtcgagtcaccatatcagtagacacgtccaaagaaccagttctccctgaagctgagctctgtcgaccgccgcgacaccggccgtgtattactgtgcgagagtggacngttcgtcactaactactttacgacctacgtcggggaccgacgggtaaccctgggtaaccgaccgttcctcctacgacgtcccgtccaaaccccgg

SEQ ID NO: 394342 - DNA, 529 bp, Homo sapiens
  misc_feature: GZ8MTXP02H3ITR.44.12.B01.1.454.CMB.2.raw
  modified_base (318)..(318): a, c, t, g, unknown or other
  modified_base (364)..(364): a, c, t, g, unknown or other
  modified_base (398)..(398): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtccctcacctgcactgtctctggtgctccatcagcagtagtagttactactggggctggatccgccagcccccagggaagggctggagtggattggggagtatctattatagtgggancactactacaacccgtcctcaacgagtcgagtcaccatatcagtanaccacgtccaaagaaccagttcctaccctgaaanctgagctactgtgaccgcgcggacacggccgtgtattactgtgcgagagtagggctagttcgtcaactactactttgaccacgtcggggccagggaaccctggtccacgtctcctcacgcctaccaaccgg

SEQ ID NO: 394343 - DNA, 567 bp, Homo sapiens
  misc_feature: GZ8MTXP02IU0ZU.44.12.B01.1.454.CMB.2.raw
  modified_base (327)..(327): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagcccttcggagaccctgtcccctcacctgcactgtctctggtgctccatcagcagtagtagttactacgtggggctggatccgccacgcccccgaggggaacggggctggagtggattggggagtatctattataggtgggancacctactacacccgtcctcaagagtcgagtcaccatactcagtagaccacgtccaaacgaaccagttcctccagaagctgacgctctgtcgaccgccgacggacgaccggtccgtagttaacttcgtggtcgcggagaggtaggctagtttacgcaacctaaacttactttcgacccgtacgtcggggccaacggggtaccctgggtccacccgtctcctcacggtcctacccaaccgg

SEQ ID NO: 394344 - DNA, 518 bp, Homo sapiens
  misc_feature: GZ8MTXP02IR2VI.44.12.B01.1.454.CMB.2.raw
  modified_base (356)..(356): a, c, t, g, unknown or other
  modified_base (406)..(406): a, c, t, g, unknown or other
  modified_base (508)..(508): a, c, t, g, unknown or other
  modified_base (510)..(510): a, c, t, g, unknown or other
  modified_base (512)..(512): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactactggggctggatccgccagcccccaggaagggctggagtggattgggagtatctattatagtggagcactactacaacccgtcctcaagagtcgagtcaccatancagtagacacgtaccaaagaaccagttcctccctagaacgctagagctcngtcgaccgccgcggactacggcctgttatactgtgcgagagtagggcagttcgcaacctaactctttgaccagtcgggccagggaccctggtcacgtctccncncncacacg

SEQ ID NO: 394345 - DNA, 561 bp, Homo sapiens
  misc_feature: GZ8MTXP02JK8P7.44.12.B01.1.454.CMB.2.raw
  modified_base (382)..(382): a, c, t, g, unknown or other
  modified_base (432)..(432): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagcccccagggaagggctggagtggattgggagtatctattatagtgggagcacctactacaacccgtcctcaacgagtcgagtcaccatatcagtagacacgtcaagaacagttcnccctagaagctgagctctgtcgaccgccgcggacacggccgtgtattacngtgcgagagtagggcaggttcgtacaacctaactacgtttcgaaccctaacgttcgggggacccaacggggaaccccttggggtaaccaacccggttctccctcgaccggtcccttaccccaaacccgg

SEQ ID NO: 394346 - DNA, 563 bp, Homo sapiens
  misc_feature: GZ8MTXP02IKHWS.44.12.B01.1.454.CMB.2.raw
  modified_base (259)..(259): a, c, t, g, unknown or other
  modified_base (286)..(286): a, c, t, g, unknown or other
  modified_base (324)..(324): a, c, t, g, unknown or other
  modified_base (355)..(355): a, c, t, g, unknown or other
  modified_base (373)..(373): a, c, t, g, unknown or other
  modified_base (376)..(376): a, c, t, g, unknown or other
  modified_base (408)..(408): a, c, t, g, unknown or other
tcagacagtatatacacgaccggtgctcgatttagtagtgtagattccgggggaggaactgctcagttaggacccagagggaaccatggaagccccagctcagcttctcttcctcctgctactctggctcccagtttcagattccagcggcgaaactgtgttgacacagtctccagccaccctgtctttgctccgggggaacagccacctctcctgcagggccgccagactgttgacaacgacttagcctggtaccaanagaagcctggccaggctcccagctccnatcatgatactccagtaggccatggcatcccagcccgnttcagtgcagtcggctgggacagtatttacntcacatctccagctaganctnagtatttgctagtttatactgtacagctcganaagaagtcggacctaccaattacttctaaccgtttcggacccttaggggaaccctaaaaggtggaacttaaactaaccgaaaacgtaacgttggtacggtactacgtaccaacctaacgttccgttacgttcttacctactttcccttacccgac

SEQ ID NO: 394347 - DNA, 571 bp, Homo sapiens
  misc_feature: GZ8MTXP02IW18W.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggagggctggagtggattgggagtatctattatagtggagcacctactacaacccgtcctcaagagtcgagtcaccatatcagtagaacacgtaccaaagaaccagttcctccctagaacgctgagctctgtcgaccgccgcggacacggccgtgtatactgtgcgagaggtagggctaggttcgtacaaccctaaacttacgtttacgaacccgtacgtacgggggacccaacgggggtaaccccctgggtcccaacccggttcctcccgtaccacggccctacccgaaacccg

SEQ ID NO: 394348 - DNA, 549 bp, Homo sapiens
  misc_feature: GZ8MTXP02HI7V9.44.12.B01.1.454.CMB.2.raw
  modified_base (364)..(364): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcgggagaccctgtcccctcacctgcactgtctctggtgctccatcagcagtagtagttactactggggctggatccgccagcccccagggaagggctggagtggattgggagtatctatatagtggagcactactacaacccgtcctacaagagtcgagtcaccatatcagtanacacgtaccaagaaaccagttctccctgaagctagagctctgtcgaccgccgcgacacggccgtgttacttacgtgtagcgagacggtagggcagttcgacaccgtaaacttactttgaccacggtcggggaccacgggtaaccctgggtaaccaccggtctacctcgacgccctaccaacccgg

SEQ ID NO: 394349 - DNA, 529 bp, Homo sapiens
  misc_feature: GZ8MTXP02HQ3VB.44.12.B01.1.454.CMB.2.raw
  modified_base (326)..(326): a, c, t, g, unknown or other
  modified_base (350)..(350): a, c, t, g, unknown or other
  modified_base (352)..(352): a, c, t, g, unknown or other
  modified_base (365)..(365): a, c, t, g, unknown or other
  modified_base (372)..(372): a, c, t, g, unknown or other
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactcacccccctctgtgtcggagtctccggggaagacggtaaccatctcctgcacccgcagcactggcagcattgccagcaactttgtgcagtggtaccagcagcgcccgggcagtgcccccacactgtgatctatgaggatacccaacgaccctcgtcggggtcccngactcggtctctggctcatcgacncnctcctcactctcnccctccncaccatctcgtacgactagaagacgtggacggacgaggctagtactactacgtgtacagttactatgaactagcacgacatactatgtaggtaggtacggacggacggacgacgacgtacgtaaccgtaccgtacgtacgacgaccgacgacgtccg

SEQ ID NO: 394350 - DNA, 542 bp, Homo sapiens
  misc_feature: GZ8MTXP02FRBVY.44.12.B01.1.454.CMB.2.raw
  modified_base (395)..(395): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagtactactggggctggatccgccagcccccgagggaagggctggagtggattgggagtatctattatagtggagcacctactacaacccgtcctcaacgagtcgagtcaccatatcagtagacaccgtccaaagaaccagttcctccctgaanctgagctctgtcgacccgccgcggacacggccgtgtattacgtgtgcgagaggtaggggcagttcgcaaccctaacttactttcgacctacgtcggggacccacggggaacccctgggtccaccgtctcctcacgccctccaacccg

SEQ ID NO: 394351 - DNA, 584 bp, Homo sapiens
  misc_feature: GZ8MTXP02HYKWC.44.12.B01.1.454.CMB.2.raw
  modified_base (353)..(353): a, c, t, g, unknown or other
  modified_base (475)..(475): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctcgtggtcgctccatcagctagtagtagttacacgtggggctggactccgccacgcccccgaggggaagggcgtggaggtggagttggggagtatctattagtaggtggagctacctacaaccacccgtcctanaacgagtacgagtcacatatctagtacactacgtaccaacgaaacctacgttaccctaccctagaaacgtctagacgtctcgttgacgacccgcgacgacgaccgcgtgttatacgtgtcgngagagtacggctagttcacaccgtaactactttcgacctaacggtcgggaaccacgggtaaccctgggaacctaaccggtcctcctacgaccgccctaccaaaccccgg

SEQ ID NO: 394352 - DNA, 554 bp, Homo sapiens
  misc_feature: GZ8MTXP02FYTRD.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagtactactgggctggatccgccagccccagggagggctggagtggattgggagtatctattatagtggagcgacctactaccaaccgtccctcaacgagtcgagtcaccatatcagtagacacgtccaaagaaccagttctccctgaaacgctgagctctgtgaccgccgcggacacggccgtgtattactgtgcgagacgtagggcagttcgtacacctaaacttcgtttcgacctacgtcgggggaccaacgggggaacccctggggtccaacccggttctccctcgaacggcccttacccgaaacccgg

SEQ ID NO: 394353 - DNA, 622 bp, Homo sapiens
  misc_feature: GZ8MTXP02INNIK.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagccccccgaggggaacggggctggagtggattggggatatctattatagtgggagcacctactaccaaccccgtcctcaagagtcgagtcacatatcagtagacaccgtaccaaagaacctagttcctaccctagaaagcgttgacgtctcgtcgtcgacccgccggcggacaccggtccgtagtacttagtgtgcgagaggttagggctaggtttccgtacaacccgtaacttacgtttacgacccgtaacggttaccgggggacccaaacgggggtaacccccttggggtaacccctaaccccggttccttccccgttaccgaacccggtccccttaccccgaaacccccggg

SEQ ID NO: 394354 - DNA, 569 bp, Homo sapiens
  misc_feature: GZ8MTXP02GKYA3.44.12.B01.1.454.CMB.2.raw
  modified_base (321)..(321): a, c, t, g, unknown or other
  modified_base (361)..(361): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggatccgccacgcccccgaggggaaggggctggagtggattgggagtatctattatagtggancacctactacaacccgtcctcaagagtcgagtcaccatancgagtacgacaccgtccaaagaaccagttcctccctagaagctgagctctagtcgaccgcccgcggaaccaccgggtccgtgttacttacgtggtgcgagtaggtagggcagttccgcaacctaacttacgtttgaacccgtaggtcggggacctaacggggaacccttggggcctaccggtctaccctcacgccctaccaaacccgg

SEQ ID NO: 394355 - DNA, 643 bp, Homo sapiens
  misc_feature: GZ8MTXP02I6N95.44.12.B01.1.454.CMB.2.raw
  modified_base (326)..(326): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtccgggcccaggactgggtgaagccttcggacgaccctgtcccctcacctgcactgtctctggtgctccatcagcagtagtagttactacgtggggctggactccgccacgcccccgagggagggcgtggagtggagtggggatatctattagtaggtggancacctactaccaacccgtcctacaacgacgtcgagtccaccatactcagtacgaccacgtaccaaacgaacctagttccctacccgtagaaacgcgtagacgtccttcgtgtaccggaacccggcccgacgggaccgaccgggtccggttagttacttaccgtgggtacggacgaggtaagggtacgggctaacggttcgtaccaacctaacttaccgtttacgaacccgtacggtcggggacccgtaacggggtaacccctggggtaaccctacccggtccttccctaccgaccgtacccctacccgaaaccccgg

SEQ ID NO: 394356 - DNA, 653 bp, Homo sapiens
  misc_feature: GZ8MTXP02F3CMM.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggatccgccacgcccccgaggggaacggggctggagtggagttgggagtatctattagtaggtgggagcaccgtactaccaacccgtcctacaacgacgtcgagtcaccaattactcgaagtacgaaccaccgtaccaaagaaaccctagtttccctccctagaacgtcgtagaacgtctctacggtacgaacccggcccgacggaaccgtaaccgggccgttacggtaactttaccgtggtacgaccggaggtaggttagggctaggttaccgtacaaacccgtaacttacgtttacgaccgtacggtcggggacccgtaacgggggaaccccttgggtaacccgtaacccggttccttaccccgactaaccgtccccgtacccgaaaccccgg

SEQ ID NO: 394357 - DNA, 529 bp, Homo sapiens
  misc_feature: GZ8MTXP02JHH0R.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaaggggctggagtggattggggagtatctattatagtgggagcacctactacaacccgtcctcaacgagtcgagtcaccatatcagtagacacgtccaaagaaccagttcctccctagaacgctgagctctgtcgaccgccgcgacacggccgtgtactactgtgcgagagtagggcagtcgcacctaactacttcgaccacgtcggggcccagggaaccctggtccaccgtctcctcacgcctcaacccg

SEQ ID NO: 394358 - DNA, 567 bp, Homo sapiens
  misc_feature: GZ8MTXP02G3I72.44.12.B01.1.454.CMB.2.raw
  modified_base (368)..(368): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagtagtagttactacgtggggctggactccgccagcccccgagggaacgggctggagtggagttgggagtatctattatagtggagcacctactacaacccgtcctcaacgagtcgagtcaccatactcagtanacacgtaccaaagaaccagttacctccctagaaacgctagacgctcgtagtcgacccgccgcgacgacggtccgtagtattactggtgacgagaggtagggctagttcgacacctaactactttcgacctacggtcgggaccacggggaaccctggtcctacccggtctacccgtcaccggtccctacccgaaacccgg

SEQ ID NO: 394359 - DNA, 587 bp, Homo sapiens
  misc_feature: GZ8MTXP02HFDZV.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccgaggggaaggggctggagtggattggggagtatctattagtaggtgggagcacctactacaaccccgtccctcaacgagtcgagtcacatatcagtagacacgtaccaaagaacctagttcctccctagaacgctggagctctgtcgacccgccgcggacaccgggtccgtgttacttacgtggtgcggagaggtaggctaggttccgtacacctaaacttacgttcgaacccgtacggtcgggggacccaacggggtaccctcggggtaacctacccggtccttcctaccgaccgtcccgtacccaacccgg

SEQ ID NO: 394360 - DNA, 565 bp, Homo sapiens
  misc_feature: GZ8MTXP02H3N27.44.12.B01.1.454.CMB.2.raw
  modified_base (208)..(208): a, c, t, g, unknown or other
  modified_base (401)..(401): a, c, t, g, unknown or other
  modified_base (418)..(418): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagacccctgtcccctnacctgcactgtctctggtgctccatcagcagtagtagttacactggggctggatccgccacgcccccaggaagggctggagtggattgggagtatctattatagtggagcactactacaacccgtccctacaacgagtcgagtcacatatcagtagacacgtcaagaccagtcctccctgaagctgagctcgngtcgaccgccgcggacncggccgtgtatactgtgcgagaggtaggctacgttcgtcaacctaactacgttttacgacccaacggttcgggacccgaacggggtacccctacggggtcctaacccggttcctccctacgaccggttcccgtacccaaacccccgg

SEQ ID NO: 394361 - DNA, 588 bp, Homo sapiens
  misc_feature: GZ8MTXP02JE2NH.44.12.B01.1.454.CMB.2.raw
  modified_base (207)..(207): a, c, t, g, unknown or other
  modified_base (359)..(359): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctnacctgcactgtctctggtgctccatcagcagtagtagttactactggggctggatccgcacgccccagggagggctggagtggagttgggagtatctatagtaggtgggagcacctactaccaacccgtcctcaacgagtcgagtcacatancagtagaccacgtaccaacgaccagttcctccctagaacgctgagtctcgagtcgaccgccgcgacgacggtccgtagtacttctggtcgacgagaggtacgggctaggttccgtacaacccgtaacttaccgttgaacccgtacggtcggggacccaacgggggtaacccctggtaaccgtacccggttcctacccgtacgaccggtaccctacccgtaaaccccggg

SEQ ID NO: 394362 - DNA, 538 bp, Homo sapiens
  misc_feature: GZ8MTXP02IV2ZN.44.12.B01.1.454.CMB.2.raw
  modified_base (388)..(388): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagcccccagggaaggggctggagtggattggggagtatctattatagtgggagcacctactacaaccccgtcctcaacgagtcgagtcaccatatcagtagacacgtccaaagaccagttcnccctgaagctagagctctgtcgaccgccgcggacacggccgtgtattactgtgcgagaggtagggcagttcgtcacctaactactttgaccacgtcggggccaacggggaacccctggtccaccgtctaccctcacgccctaccaacccg

SEQ ID NO: 394363 - DNA, 537 bp, Homo sapiens
  misc_feature: GZ8MTXP02G06M8.44.12.B01.1.454.CMB.2.raw
  modified_base (393)..(393): a, c, t, g, unknown or other
  modified_base (454)..(454): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccacgcccccgagggaacggggctggagtggattggggagtatctattataggtgggagcacctactaccacccgtcctacaacgagtcgagtcaccatatcagtagacacgtccaagaccagttccnccctagaacgctgagctctgtcgaccgccgcggacacgggccgtgtattacgtgtgcgagngtaggctagttcgcacctaactacttgaccacgtcggggccacgggaccctggtccaccgtctcctcgacgcctaccaacccg

SEQ ID NO: 394364 - DNA, 537 bp, Homo sapiens
  misc_feature: GZ8MTXP02HKCEE.44.12.B01.1.454.CMB.2.raw
  modified_base (207)..(207): a, c, t, g, unknown or other
  modified_base (409)..(409): a, c, t, g, unknown or other
  modified_base (437)..(437): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggcccaggactgggtgaagccttcggagaccctgtccctnacctgcactgtctctggtgctccatcagcagtagtagttactactggggctggactccgccacgcccccagggaagggctggagtggatgggagtatctatatagtggagcacctactacaacccgtcctacaacgagtcgagtcaccatatcagtagacacgtaccaaagaacctagttcctccctagaacgctgagctcngtgaccgcgcggacacggcctgtatacngtgcgagagtaggcagttcgacaacctaactactttgaccacgtcggggccaacggggaaccctggtccgacccgtctcctcacgccctaccgaacccgg

SEQ ID NO: 394365 - DNA, 646 bp, Homo sapiens
  misc_feature: GZ8MTXP02JZ8SP.44.12.B01.1.454.CMB.2.raw
  modified_base (322)..(322): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccacgccccgagggacgggctggagtggattgggagtatctattagtaggtggancacctactaccaacccgtcctacgaacgacgtcgacgtacacatactcagtacgaccacgtaccaaacgaacctagttccctacccgtagaacgcgtaggacgtcttacgtcggtacgacccgccggaccggaccgacgggtcccgtagttacttacgtggtacgacgaggtaggtacgggactacggttaccgtaccaaaccttaacgttaccgtttacggaacccgtacggtacgggggtacccgaaccgggggtaaccccgttgggtaaccccgtaacccggttcctaccctaccgacgttacccccacccgtaaccccgg

SEQ ID NO: 394366 - DNA, 551 bp, Homo sapiens
  misc_feature: GZ8MTXP02GKY5G.44.12.B01.1.454.CMB.2.raw
  modified_base (195)..(195): a, c, t, g, unknown or other
  modified_base (409)..(409): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcgganaccctgtcccctcacctgcactgtctctggtgctccatcagcagtagtagttactacgtggggctggactcccgccacgcccccgaggggaacgggctggagtggattgggagtatctattagtagtggagcactactacaacccgtcctacaacgagtcgagtacaccatatcagtagacaccgtccaaagaacctagttcctaccctagaancgtgagtctctcgtcgaccgccgcggacacggccgtgtattactgtgacgagacgtagggctagttcgtacaacctaacttacttgacctagtcgggaccacgggaacctggcctaccgtctccgtcacgtccctacaaccg

SEQ ID NO: 394367 - DNA, 618 bp, Homo sapiens
  misc_feature: GZ8MTXP02JI6WJ.44.12.B01.1.454.CMB.2.raw
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcggcccaggactggtgaagccttcggagaccctgtccctcacctgcactgtctctggtgctccatcagcagtagtagttactactggggctggatccgccagcccccgagggaacggggctggagtgggattggggagtatctattatagtgggagcacctactacaacccgtcctcaacgagtcgagtcaccatactcagtagacacgtccaaagaacccagttcctccctgaaacgctagacgtctctgtcgacccgccgacggaccaccgggccgtagtattacctggtgaccgaggaagtaggggcaaggtttccgacaaccctaaacttaccgtttacgaacccgtacgttacgggggacccgtaaacgggggaaacccccttggggtaaccctaaccccgggttcctaccccgttccgaaccgtcccccgttccaaaaccccccgggg

SEQ ID NO: 394368 - DNA, 631 bp, Homo sapiens
  misc_feature: GZ8MTXP02IXVGD.44.12.B01.1.454.CMB.2.raw
  modified_base (318)..(318): a, c, t, g, unknown or other
  modified_base (358)..(358): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccacgccccgagggagggctggagtggatgggatatctattagtagtggancactactacacccgtcctacaacgacgcgagtcaccatancagtacgacacgtaccaaacgaaacctagttcctacccgtagaaacgtcgtagacgtcctccgtggtacgaccccggccggaccgggaaccgaccgggtccggttagttacgttacgtgggtagaccgtaaggacggtacggggactacggtttaccgacgaaacccttaacttacgttccgaaccgtacggtccggggaccgtaaacggggtaacccctggggtaaccctacccggttcctcccgtacgaccgtcccctaccgaaaccccgg

SEQ ID NO: 394369 - DNA, 581 bp, Homo sapiens
  misc_feature: GZ8MTXP02I40MF.44.12.B01.1.454.CMB.2.raw
  modified_base (566)..(566): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccacgcccccgagggaaggggctgggagtggagttggggagtatctattataggtggagcacctactaccaacccgtcctacaagacgtcgacgtcaccattatcaagtacgacacgtccaaagaacctagttcctcctgaacgctagagctctgtcgacccgccgcggaccaccgggccgttgtacttacgtggtacgcgagaggtacgggctaggttacgtcaaccgtaacttactttacgaccctacgtcggggacccacggggtaaccctggtaaccctacccggtctccctcgacnccctaccgaacccgg

SEQ ID NO: 394370 - DNA, 578 bp, Homo sapiens
  misc_feature: GZ8MTXP02J2NX0.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccgagggaaggggctggagtggattgggagtatctattatagtgggagcacctactaccaacccgtccctacaagagtcgagtcacatatcagtagacacgtaccaagaacctagtcctacccgtagaacgtctgagctctcgtcgacccgccggacggacgtaccgggccgtaggtattacgtggttaggcgaggtaaggtacggggctaggtttccgacaaccctaacgtactttgaacccgtacgtcggggccacgggtaacccgtcggtccacccggtctcccttaccaccgccaccgaccg

SEQ ID NO: 394371 - DNA, 606 bp, Homo sapiens
  misc_feature: GZ8MTXP02HU7SZ.44.12.B01.1.454.CMB.2.raw
  modified_base (321)..(321): a, c, t, g, unknown or other
  modified_base (351)..(351): a, c, t, g, unknown or other
  modified_base (371)..(371): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggatccgccacgcccccgagggaacgggctggagtggagttgggagtatctattagtagtgganctactactaccaaccccgtcctacgaacgngtacgagcacatatcagtanacacgtaccaaagactacgttcctaccgtagaagctagactctcgtgtcgaccgccgacggaccgacgggtccgttagttacttacgtggtcggacgaggagtacggggctaggttccgtacctaccgtaacttaccgtttacgaccgtacggtacggggacccgtaacggggtaacccctggttaacccgacccggttcctacccgtcgaccgtaccccgtacccgaaacccgg

SEQ ID NO: 394372 - DNA, 569 bp, Homo sapiens
  misc_feature: GZ8MTXP02H1YU7.44.12.B01.1.454.CMB.2.raw
  modified_base (325)..(325): a, c, t, g, unknown or other
  modified_base (397)..(397): a, c, t, g, unknown or other
  modified_base (412)..(412): a, c, t, g, unknown or other
  modified_base (458)..(458): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggactccgccacggcccccgagggaaggggctggagtggattggggagtatctattataggtggganctacctactaccaaccccgtccctacaacgagtacgagtacaccatatcagtagaccacgtaccaagaaccngttcctaccctgaanctgagtctctgtcgacccgcgacggacacggtccgtgtacttacgnggtgcgaggagtaggggctagtttcgacacctaactactttgaccacggtacggggccctacggggaaccctcgggtccaccggtcctccgtcacgtccctaccaacccgg

SEQ ID NO: 394373 - DNA, 537 bp, Homo sapiens
  misc_feature: GZ8MTXP02JWE3S.44.12.B01.1.454.CMB.2.raw
  modified_base (366)..(366): a, c, t, g, unknown or other
  modified_base (371)..(371): a, c, t, g, unknown or other
  modified_base (398)..(398): a, c, t, g, unknown or other
  modified_base (439)..(439): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccacgccccccgaggggaacggggctggaggtggagttggggagtatctattatagtgggagcactactacaacccgtcctcaacgagtcgagtcacatancaganacacgtcaagaccagtctccctagaanctagagctctgtcgaccgcgcggaccacggccgtgtatacngtgcgagagtgggcagttcgtacactaactacttgaccagtcggggaccacggggtaaccctggtccaccggtctcccgtcacgccctaccgaacccg

SEQ ID NO: 394374 - DNA, 681 bp, Homo sapiens
  misc_feature: GZ8MTXP02IWG20.44.12.B01.1.454.CMB.2.raw
  modified_base (332)..(332): a, c, t, g, unknown or other
  modified_base (353)..(353): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactacgtggggctggactccgccacgcccccgaaggggaacggggctgggagtggagttggggagtatctaattagtagtgggancacctactacaccccgccctnaacgagtcgagtcacatatcagtacacacgtaccaaagaacctagtcctccctagaacgctagagtctactggtcgaccggcccgacggaccgaccgggtcccgttaggttaacttacgtgggttcgacgaagggtacgttaacggggctaacggtttccggtacctaacccgttaaaactttacccgttttacggaaaccccgttaacgggttaccgggggacccctaaaccgggggtaacccccgtttcgggggtaacccctaaacccggttccctttacccccggtaccaccccggtaccccttaacccccgaaaacccccgggg

SEQ ID NO: 394375 - DNA, 562 bp, Homo sapiens
  misc_feature: GZ8MTXP02GPPUG.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccacgcccccagggaagggctggagtggattgggagtatctattagtagtggagcaccgtactaccaacccgtcctacaacgagtcgagtcaccatatcagtagacacgtaccaaagaaccagttctccctagaacgctgagctctgtcgaccgcgcggacacggccgtgtattacgtgtgacgagaggtagggctaggttcgtacacctaaacttcgtttacgaccctacggtcggggacctaacggggaaccctggtaaccgaccgtcctaccctcacgccctaccgaaacccgg

SEQ ID NO: 394376 - DNA, 693 bp, Homo sapiens
  misc_feature: GZ8MTXP02IQRWK.44.12.B01.1.454.CMB.2.raw
  modified_base (321)..(321): a, c, t, g, unknown or other
  modified_base (412)..(412): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggatccgccacgcccccgagggacggggctggagtggagttgggagtatctattataggtggancacctactaaccaacccgtcctcaacgacgtacgacgtcactatactcagtacgacacgtaccaaagaacctacgttccaccctagaaacncgtagacgtacctcgtcgtacgacccggccggaccggaacgacccgggtccggttacgtttaacgtttacgtcgggttacgccggtaaaggtacgggttaacggggaccttaacgggtttccgtaacctaaacccgtaaaacgtttaccgtttacggaacccctaaccggtacgggggtacccccgtaaacgggggtaaaacccccgttcggtaaccccgtaaaccccggttcctttaccccgaccgtacccgtacccccgtttacccgaaaacccccggg

SEQ ID NO: 394377 - DNA, 571 bp, Homo sapiens
  misc_feature: GZ8MTXP02IM6NU.44.12.B01.1.454.CMB.2.raw
  modified_base (374)..(374): a, c, t, g, unknown or other
  modified_base (380)..(380): a, c, t, g, unknown or other
  modified_base (553)..(553): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccacggccccccgaaggggaacggggcgtggaggtggattggggagtatctattagtaggtggagcacctactaccaacccgtcctacaacgagtcgagtcacatancagtanacacgtccaaagaacctagttcctccctagaacgctagagctcgtgtcgacccgcgcggacacggccgtgtattactggtagcgagaggtaggctagttcgacaacctaaacttcgtttacgacctacggtcggggaccaacgggtaccctggtaaccacccggtctccctanaccgccctacaaacccgg

SEQ ID NO: 394378 - DNA, 603 bp, Homo sapiens
  misc_feature: GZ8MTXP02GQJWX.44.12.B01.1.454.CMB.2.raw
  modified_base (406)..(406): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaagggctggagtggattgggagtatctattagtagtgggagcgaccttactaaccaacccgtccctcaaacgagtcgagtcacatatcaagtagacacgtaccaaagaaccagttcctccctagaacnctgagctctgtcgacccgccgcggacacggtccgtgttacttacgtggtcgacgaaggacgttaggggcctaggtttcgactaaccctaaaacttaccgtttacgaacctacggtcgggggacccaacgggggtaaccccttggggaacccaacccggttcttcccctacgacggtcccccttaccgaaaaccccgg

SEQ ID NO: 394379 - DNA, 650 bp, Homo sapiens
  misc_feature: GZ8MTXP02JLVE2.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccacgcccccgagggagggctggagtggattgggagtatctattagtagtgggagcacctactaccaacccgtccctacaacgacgtcgagtcacctatactcgaagtagaccaccgtaccaaacgaaaccctaggtttacctacccgtagaaacgcgttgaacgtctcgtagtcgacccgccgcggaccgacgggtccgtagttacgttacgtggttacggaccggtaaggaggtacggggactacggtttaccggtacctaacccgtaaactttacgtttaccgaacccgtacggttacgggggacccgaacggggtaaccccgtcgggtaacccgtaacccggttccttacccgttcgaaccggcccttaccgaaacccccgg

SEQ ID NO: 394380 - DNA, 537 bp, Homo sapiens
  misc_feature: GZ8MTXP02I0RN5.44.12.B01.1.454.CMB.2.raw
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagcccccagggaagggctggagtggattgggagtatctattatagtggagcacctactacaacccgtcctacaacgagtcgagtcaccatatcagtagacacgtccaagaaccagttctccctgaacgctagagctctgtcgaccgccgcggacacggccgtgtattactgtgacgagaggtagggcaggttcgtcaacctaacttactttgacccaacgtcggggcctacggggaaccctggtccaccgtctccgtcacgccctccaaccg

SEQ ID NO: 394381 - DNA, 589 bp, Homo sapiens
  misc_feature: GZ8MTXP02I2I46.44.12.B01.1.454.CMB.2.raw
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactacgtggggctggatccgccacgcccccgagggaagggctggagtggattgggagtatctattatagtggagcactactacaacccgtcctacaacgagtcgagtcacatatcagtacgacacgtaccaagaaccagttctaccctagaacgctagagtctcgtgtcgaccgcgacgacaccggcctgtattactgtgacgagagtgggactacggttcgtacaaccgtaacttacgtttcgaacccgaacgttccgggggacctaaccggggaaaccccttcgggtaacccgtaaccccgttcctacccgtccgaacgcccccgttacccgaaaccccgg

SEQ ID NO: 394382 - DNA, 572 bp, Homo sapiens
  misc_feature: GZ8MTXP02IVYBY.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggactccgccacgcccccgagggaagggctggagtggagttgggagtatctattagtaggtgggagcacctactaaccaaccccgtcctacgaacgagtacgagtcaccataatcaagtacgaccacgtaccaaagaaaccagttaccaccctagaacgctagacgtctctggtcgacccggccgacggaccgacggtccgtagttaacttacgtgtgacgaggtaggtagggctaggttcgacaacctaactacttgaccagtcgggaccacggaccctgtccgaccgtctccctacacgccctaccaacccg

SEQ ID NO: 394383 - DNA, 561 bp, Homo sapiens
  misc_feature: GZ8MTXP02HZ0H4.44.12.B01.1.454.CMB.2.raw
  modified_base (394)..(394): a, c, t, g, unknown or other
  modified_base (448)..(448): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggatccgccacgcccccgagggaaggggctggagtggattggggatatactatatagtggagcacctactaccaaccccgtcctacaacgagtcgagtcacatactcagtagacacgtaccaagaaccagttccncccgtagaacgctgagctctgtcgaccgccgcggacgcggccgtagtattacgngtgacgagagtaggctagttcgtacacctaactactttacgacctacgtcggggaccacggggaaccctgggtaacctaccgtcctcctacgaccgtaccctaccgaacccgg

SEQ ID NO: 394384 - DNA, 586 bp, Homo sapiens
  misc_feature: GZ8MTXP02H8H6D.44.12.B01.1.454.CMB.2.raw
  modified_base (339)..(339): a, c, t, g, unknown or other
  modified_base (364)..(364): a, c, t, g, unknown or other
  modified_base (389)..(389): a, c, t, g, unknown or other
  modified_base (400)..(400): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctccagatgggtcctgtcccagctgcagctgcagggagtcgggcccaggactgggtgaagccttcggagacccctgtcccctcacctgcactgtctctggtgctccatcagctagtagtagttactactggggctggatccgccacgcccccagggagggctggagtggattgggagtatctatatagtggagcactactacaaccgtccctnaacgagtcgagtcacatatcagtanacacgtccaagaccagttcctcccngagctgatctntgtcgaccgccgcgacgcggccgtgttatacgtgtgcgagagtagggctagttcgacgaacctaacgttacttttcgaccctaacggttcgggggacccgtaacgggggtaaaccccttcggggtaacccgtaacccggttaccttcccgttaccgaaccggcccctttaccccgaaacccccggg

SEQ ID NO: 394385 - DNA, 566 bp, Homo sapiens
  misc_feature: GZ8MTXP02HAC6E.44.12.B01.1.454.CMB.2.raw
  modified_base (358)..(358): a, c, t, g, unknown or other
  modified_base (364)..(364): a, c, t, g, unknown or other
  modified_base (386)..(386): a, c, t, g, unknown or other
  modified_base (396)..(396): a, c, t, g, unknown or other
  modified_base (405)..(405): a, c, t, g, unknown or other
  modified_base (422)..(422): a, c, t, g, unknown or other
  modified_base (437)..(437): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactactggggctggatccgccagcccccagggaagggctggagtggattgggagtatctattatagtggagcactactacaacccgtcctacaagagtcgagtcaccatancagtanacacgtccaaagaaccattccnccctagaacnctgagctcngtacgaccgccgcgacncggcctgtacttacnggtgcgagaggtagggctagttcgtacacctaacttacttacggaccctaacggtcgggggaccacgggggtaaaccccttggggtaacctaccggtcctacctacgacggtcccctaccgaaccccgg

SEQ ID NO: 394386 - DNA, 561 bp, Homo sapiens
  misc_feature: GZ8MTXP02JA87B.44.12.B01.1.454.CMB.2.raw
  modified_base (431)..(431): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaagggctggagtggattgggagtatctattatagtggagcacctactacacccgtcctcaacgagtcgagtcacatatcagtagacacgtaccaagaaccagttctcctgaagctgagctctgtcgaccgccgcgacacggccgtgtattacngtgcgagaggtagggctaggtttcgaccacctaaacttacgtttacgaccctaacggtcgggggacccaacggggaaccccttggggtcctaacccggtcctcccgtcaccggcccttaccaaaccccgg

SEQ ID NO: 394387 - DNA, 514 bp, Homo sapiens
  misc_feature: GZ8MTXP02GGNLX.44.12.B01.1.454.CMB.2.raw
  modified_base (292)..(292): a, c, t, g, unknown or other
  modified_base (334)..(334): a, c, t, g, unknown or other
  modified_base (442)..(442): a, c, t, g, unknown or other
  modified_base (464)..(464): a, c, t, g, unknown or other
  modified_base (513)..(513): a, c, t, g, unknown or other
tcagacagtatatacacgaccggtgctcgatttagtagtgtagattccgggggaggaactgctcagttaggacccagagggaaccatggaagccccagctcagcttctcttcctcctgctactctggctcccagtttcagattccagcggcgaaactgtgttgacacagtctccagccaccctgtcctttgtctccgggggaacagccaccctctcctgcagggccggccagactgttgacaacgacttagcctggtaccaacagaagcctggccaggctcccaggctcctnatctatgatcttccagtaggccactggcatccccagccccgnttcagtgcaggtgggtctgggacagtagtttactctcacccatcctccagcctagacgcctgaatatttgctagtttatactgtcagctcgacaagagtcgctcaatntcacttcgcctgggacctaagnggatagtacaaacgactagtcgctagcaccaatctctctctctcctccnc

SEQ ID NO: 394388 - DNA, 572 bp, Homo sapiens
  misc_feature: GZ8MTXP02G4NCF.44.12.B01.1.454.CMB.2.raw
  modified_base (376)..(376): a, c, t, g, unknown or other
  modified_base (400)..(400): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactactggggctggatccgccacgcccccgaggggaaggggctggagtggattggggagtatctattataggtgggagcacctactaaccaacccgtccctacaacgacgtcgagtcacatatcagtanacacgtaccaaagaaccagttccncccgtagaagctagagtctcgtgtcgaccgccgacggaccacggcgtgtattacgtgtgcgagaggtaggctagttcgacaacctaacttacttcgaccctagtcggggacccacgggtaaccctggtaacccgacccgtcctccgtccgacggtcccctaccgaaacccgg

SEQ ID NO: 394389 - DNA, 588 bp, Homo sapiens
  misc_feature: GZ8MTXP02JQKKQ.44.12.B01.1.454.CMB.2.raw
  modified_base (362)..(362): a, c, t, g, unknown or other
  modified_base (387)..(387): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactactggggctggatccgccagcccccgagggaacgggctggagtggattgggagtatctatagtagtggagcactactaccacccgtcctacaacgagtcgacgtacacatancgagtagacacgtcaagacagttcnccctgaacgctgagctctgtacgaccgcgcgacacggcgtgtacttacgtgtgacgagaggtacggcagttccgacacccgtaaacgttacgtttcgaaacccgtacgttacgggggacccgaaacggggtaaccccgttggtaacccgtaaacccggttcctacccgtcgtaaccgtccccgttaccgaaaacccccggg

SEQ ID NO: 394390 - DNA, 532 bp, Homo sapiens
  misc_feature: GZ8MTXP02IO6FA.44.12.B01.1.454.CMB.2.raw
  modified_base (367)..(367): a, c, t, g, unknown or other
  modified_base (390)..(390): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactactggggctggatccgccagcccccaggaaggggctggagtggattgggagtatctattatagtgggagcacctactacaacccgtcctacaacgagtcgagtcaccatatcagtanacacgtaccaagaaccagttccnccctgaaacgctgagctctgtcgaccgccgcggacacggccgtgttatacgtgtgcgagagtagggctagttcgcaacctaactactttgaccacgtcgggccacgggaaccctggccacgtctcctcacgcctaccaaccg

SEQ ID NO: 394391 - DNA, 548 bp, Homo sapiens
  misc_feature: GZ8MTXP02JXMKL.44.12.B01.1.454.CMB.2.raw
  modified_base (427)..(427): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccgagggaaggggctggagtggattggggagtatctattataggtggagcacctactaccaacccgtcctacaacgagtcgagtcacatatcagtagacacgtccaagaaccagttcctcctagaacgctgagctctgtcgaccgccgcggaccncggccgtgtattactgtgcgagagtgggctagtcgtcaacctactacttcgacctacgtcggggccgacggggaaccctggtaaccgaccgttcctcctcgaccgtccctacccaacccgg

SEQ ID NO: 394392 - DNA, 570 bp, Homo sapiens
  misc_feature: GZ8MTXP02JMMF6.44.12.B01.1.454.CMB.2.raw
  modified_base (445)..(445): a, c, t, g, unknown or other
  modified_base (459)..(459): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctcatcagcagtagtagttactacgtggggctggactccgccacgcccccgaggggaggggctgggagtgggagttggggagtatctattagtaggtgggagcacctactaccaacccgtccctacaacgagtcgacgtcacatatcaagtacgacacgtaccaaagaacccagttaccctccctagaagctagagctctgtcgaccgccgacggacncggcgtgtattacngtgcgagagtaggctagttcgcacctaacttctttacgaccctagtcggggacctacggggaaccctgggtcctaccggtcctccgtacgacgaccctaccgaaaccccgg

SEQ ID NO: 394393 - DNA, 569 bp, Homo sapiens
  misc_feature: GZ8MTXP02FV1PB.44.12.B01.1.454.CMB.2.raw
  modified_base (344)..(344): a, c, t, g, unknown or other
  modified_base (363)..(363): a, c, t, g, unknown or other
  modified_base (369)..(369): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctcgtggtgctccatcagcagtagtagttactacgtggggctggactccgccacgcccccgagggaagggctggagtggatgggagtatctatagtaggtggagcacctactaccaccgtcctanaacgagtcgagtcacatancagtanacaccgtaccaaagaacctattacctccctagaagctgacgtctctgtcgaccgccgcgacgacggccgtagtacttactgtgcgagaggtagggctagttcgacaacctaacttactttacgacctacggtcggggaccaacggggacccctgggtaacctaccggtcctaccctaccgacgaccctaccaaaccccgg

SEQ ID NO: 394394 - DNA, 551 bp, Homo sapiens
  misc_feature: GZ8MTXP02GOS01.44.12.B01.1.454.CMB.2.raw
  modified_base (316)..(316): a, c, t, g, unknown or other
  modified_base (336)..(336): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccagcccccaggaggggctggagtggagttgggagtatctattatagtggancactactacaaccgtccctnaacgagtcgagtcaccatatcagtacgacaccgtaccaagaaaccagttctccctagaagctgacgctctgtcgaccgcgcggacacggccgtgtattacgtgtgcgagacgtgggcagttcgcacctaactacgtttgacctacgtcggggaccgaacgggtaacccgtcggtccgaacccggtctaccctcgaacgtcccctaccgaacccgg

SEQ ID NO: 394395 - DNA, 616 bp, Homo sapiens
  misc_feature: GZ8MTXP02G597B.44.12.B01.1.454.CMB.2.raw
  modified_base (323)..(323): a, c, t, g, unknown or other
  modified_base (347)..(347): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggatccgccacgcccccgaggggaagggctggagtggattggggagtatctattagtagtgggancaccgtactaccaacccgtcctanaacgagtcgagtcaccatactcagtagaccacgtaccaagaacctagttactccctagagctagagctcgtgtacgccgcgcggacaccgggccgttgtacttactggtgacgagtaggtagggctaggttccgtacaacccgtaacttaccgtttagaacccgtacggttacgggggacccaaacgggggtaaacccccttgggggtaaccctaacccggttcccttacccggttaccgaccgtacccccttacccggaaaaccccgg

SEQ ID NO: 394396 - DNA, 610 bp, Homo sapiens
  misc_feature: GZ8MTXP02GOA24.44.12.B01.1.454.CMB.2.raw
  modified_base (401)..(401): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactacgtggggctggatccgccacggcccccgaggggaacggggctggagtggagttggggagtatctattagtaggtggagcaacctactaaccaacccgtcctacaacgagtcgagtcaccatatcagtagacacgtcaaagaaccagttcnccctagaaacgctagacgtctctagtcgacccgccgacggaccaccgggtccgtagttacttacgtgggtcgaccgaggaggttacggggctacggtttccgacaaccctaaacttaccgtttcgaaccgtacgtacgggggacccacgggggtaacccctcgggtaaccgaccccgttcttcccacgaccgccctacccgaaacccgg

SEQ ID NO: 394397 - DNA, 604 bp, Homo sapiens
  misc_feature: GZ8MTXP02JVSM4.44.12.B01.1.454.CMB.2.raw
  modified_base (365)..(365): a, c, t, g, unknown or other
  modified_base (377)..(377): a, c, t, g, unknown or other
tcagacagtatatacacgaccggtgctcgatttagtagtgtagattccgcgggggcttactgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctcatcagcagtagtagttactactggggctggatccgccagcccccgaggaaggggctggagtggattgggagtatctattatagtggagcacctactacaacccgtccctcaacgagtcgagtccacatatcagtanacacgtaccaanaccagttcctcccgtagaagcctgagtctctgtcgacccgcccgacggaccgaccgggccgtgtacttacgtggtgacgtaggaaggtggggcacggttacgtcaacctaaaccttacgtttacgacccgtacggttcgggggacccaacgggggtaaacccctggggtaaccctaacccggttccctacccgttccgaaccggtcccctacccgaaaacccccggg

SEQ ID NO: 394398 - DNA, 698 bp, Homo sapiens
  misc_feature: GZ8MTXP02IQAV9.44.12.B01.1.454.CMB.2.raw
  modified_base (325)..(325): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagcccttcggacgaccctgtcccctcacctgcactgtctcgtggtgctcatcagcagtagtacgttactacgtggggctggactccgccacgccccgagggacgggctggagtggattggggatatctattagtaggtggancacctactaccaaccccgtcctacaacgacgtcgacgtccacctatactcagtaacacctaccgtaccaaacgtaaaccctacgttaccctacccgttaggaaacgtcgtacggaacgtccttccgtacgggttaccggaaccccgcccgggaccgggaacccgtacccggggtaccgttacggttactttaccgttgggtacgaccggtaagggtacgggttaggggcgtacggttaccgtaccaacccttaaaccttacgtttaccggaacccgtaccggtacgggggtacccgtaacgggggacccccttagggtccccgaacccggtttccctacccttaccggaccgtaccccgtacccgaaacccgg

SEQ ID NO: 394399 - DNA, 641 bp, Homo sapiens
  misc_feature: GZ8MTXP02JDC5W.44.12.B01.1.454.CMB.2.raw
  modified_base (470)..(470): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccggctgcagctgcaggagtcgggcccaggactggtgaagccttcggagaccctgtccctcacctgcactgtctctggtgctccatcagcagtagtagttactacgtgggctggactccgccacgcccccgaggggaacggggtctaggagtggagtttgggagtatctattagtaggtgggagcctacctactaccaacccgtcctacgaagacgtacgagtcaccatatcagtagacacgtaccaagaacctagttctccctagaacgctagagtctcgtgtcgacccgccgcgaccgtacgggccgttagttacgtttacgnggttacggcgaaggtagggtacggggtctaacggtttccgacctaaaccctaaaccgttacgtttacgacccgtacggtacgggggacccgtacgggggtaaaccccctggggttaacccaaccggttcctacccgttccgaccgtccctacccggaaccgtaaacccggg

SEQ ID NO: 394400 - DNA, 584 bp, Homo sapiens
  misc_feature: GZ8MTXP02JHM5I.44.12.B01.1.454.CMB.2.raw
  modified_base (380)..(380): a, c, t, g, unknown or other
  modified_base (403)..(403): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctcatcagcagtagtagttactacgtggggctggatccgccacgcccccgaggggaacggggctgggagtggagttggggagtatctattagtaggtgggagctacctactaccaaccccgtccctacaacgagtcgagtcaccatatcagtanacacgtaccaagaaccagttccncctagaagctagagctctgtcgaccgccgacggacgaccggccgtagtacttacgtggtagcgagaggtagggctaggttcgacaacctaacttacttacgaccgtacgtcggggacccgaacggggtacccctagggccctacccggttcctaccctccgaccgtccctaccgaacccgg

SEQ ID NO: 394401 - DNA, 529 bp, Homo sapiens
  misc_feature: GZ8MTXP02FW870.44.12.B01.1.454.CMB.2.raw
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagtagtagttactactggggctggatccgccagcccccgagggaaggggctggagtggattggggagtatctattatagtgggagcacctactacaacccgtccctcaacgagtcgagtcaccatatcagtagacacgtcaagaaccagttctccctgaaagctgagctctgtcgaccgccgcggacacgggccgtgtattactgtgcgagagtagggcagttcgtcaaccaactactttgaccacgtcgggccacgggaccctggtcaccgtctccgtcacgcctccaaccg

SEQ ID NO: 394402 - DNA, 600 bp, Homo sapiens
  misc_feature: GZ8MTXP02IE2TT.44.12.B01.1.454.CMB.2.raw
  modified_base (208)..(208): a, c, t, g, unknown or other
  modified_base (368)..(368): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctnacctgcactgtctctggtgctcatcagcagtagtagttactactggggctggatccgccacgcccccgagggaacgggctggagtggagttgggagtatctatagtagtggagcacctactacaacccgtcctacaacgagtcgagtcacatatcagtanacacgtaccaagaaacctagtcctcccagaacgctagacgtctacgtgtcgaccgcgacgacacggtccgtgtactacgtggtgacgagaggtacggcgtacgttcgtacaaaccctaacgttacctttaggaccctacggtcggggtacccgacggggtaaaccccgttcgggtaacccgtaacccggttccctacccgtaccgaccgtaccccttacccgaaacccccgg

SEQ ID NO: 394403 - DNA, 527 bp, Homo sapiens
  misc_feature: GZ8MTXP02IMIP2.44.12.B01.1.454.CMB.2.raw
  modified_base (319)..(319): a, c, t, g, unknown or other
  modified_base (338)..(338): a, c, t, g, unknown or other
  modified_base (397)..(397): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtcggcggctcccagatgggtcctgtcccagctgcagctgcaggagtcgggcccaggactggtgaagcccttcgggagaccctgtcccctcacctgcactgtctctggtgctccatcagcagtagtagttactactggggctggatccgccagcccccagggaagggctggagtggattgggatatctattatagtggancacctactacacccgtccncaagagtcgagtcacatatcagtagacacgtccaagaccagttctccctgaacgctganctctgtcgaccgccgcgacacggccgtgtacttactgtgcgagagtggcagttcgcacctaactactttcgacctacgtcgggccgaacggaccctggtcacccggtctccgtcacgccctcccgaaccg

SEQ ID NO: 394404 - DNA, 556 bp, Homo sapiens
  misc_feature: GZ8MTXP02HOHRQ.44.12.B01.1.454.CMB.2.raw
  modified_base (322)..(322): a, c, t, g, unknown or other
  modified_base (454)..(454): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcgggacgaccctgtcccctcacctgcactgtctctggtgctccatcagcagtagtagttactactggggctggatccgccacgcccccgagggaaggggctggagtggattgggatatctattagtagtggancactactacaccccgtcctacaacgagtacgagtcaccatatcagtagacacgtaccaagaacctagtcctaccctgaaacgctagacgtctactgtcgaccgcgcggacaccggctgttatctgcgcgagngtaggcagttcgacacctaaactctttcgacctacgtcgggaccaacgggaaccctggtaaccgtaccgtccgtccctacgaccgtcccgtacaaaccccgg

SEQ ID NO: 394405 - DNA, 571 bp, Homo sapiens
  misc_feature: GZ8MTXP02IJ3P8.44.12.B01.1.454.CMB.2.raw
  modified_base (419)..(419): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctcatcagcagtagtagttactacgtggggctggactccgccacgcccccgagggacgggctggagtggagttgggagtatctattagtaggtggagcaacctactaaccaaccccgtcctacaacgacgtaccgagtaccactatactcagtaacgaccaccgtaccaagaacctacgttacctccagacnctagagctctgtacgaccgcgcgacgaccggcgtagtattacgtgtagcgagtagtaggctagttcgacaacctacttactttacgacctacggtcgggaccacgggtacctggtaaccgaccgtctccgtcaccgtaccctaccgaacccg

SEQ ID NO: 394406 - DNA, 650 bp, Homo sapiens
  misc_feature: GZ8MTXP02J2NQZ.44.12.B01.1.454.CMB.2.raw
  modified_base (368)..(368): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggatccgccacgcccccgagggagggctggagtggattgggagtatctattagtagtggagcacctactaccaacccgtcctacaacgagtcgagtcacatatcagtanacacgtaccaagaaaccctgttcctacccgtagaaacgtcgttagagtcttctcggttacggaaccccggcccggaccgggacccgaccgggtcccggttacggttaactttaccgtggttacggcgagggtaggttacgggggcttaacggtttccgtaccaaccctaaacgttacgtttcggaaacccgtacggttcgggggacccaacgggggtaaacccccttggggtaaccccaacccggttcctcccgtacaccggccccttacccgaaaccccgg

SEQ ID NO: 394407 - DNA, 547 bp, Homo sapiens
  misc_feature: GZ8MTXP02GZSQV.44.12.B01.1.454.CMB.2.raw
  modified_base (319)..(319): a, c, t, g, unknown or other
  modified_base (445)..(445): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtccctggtggctccatcagcagtagtagttactactggggctggatccgccagcccccagggaaggggctggagtggattgggagtatctattatagtgggancacctactacaacccgtcctcaagacgtcgagtcaccatatcagtagacacgtacccaagaaccagttctaccctgaaagctgagctctgtgaccgccgcgacacggccgtgtatactgtgcgagngtaggcagttcgacacctaactacgtttcgaccacgtcgggggaccacggggaaccctgggtaccaaccggttcctacctcacgccctaccaccgaaccggg

SEQ ID NO: 394408 - DNA, 688 bp, Homo sapiens
  misc_feature: GZ8MTXP02ILLD2.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggactccgccacgcccccgagggaaggggctggagtggagttggggagtatctaattagtaggtgggagcaacctactaccaaccccgtcctacaacgagtcgagtcacatatcagtagacacgtaccaaagaacctagttcctaccctagaacgctagacgtacttcgtaggtcgaccccggccgccgggaaaccgtaccggggtccgttacggtttaagttacccgttgggttcggaccgggtaaggtaaggggttaacgggggtactaacggtttcgggtaccctaaaacccgttaaaccgttaccgttttacggaaccccgtaacgggttaccgggggacccgtaaacggggtaaaccccgttggtaacccgtaaccccggttaccttccccgacgtaccgacccccgttacccgaaaaccccggg

SEQ ID NO: 394409 - DNA, 584 bp, Homo sapiens
  misc_feature: GZ8MTXP02ITMP0.44.12.B01.1.454.CMB.2.raw
  modified_base (247)..(247): a, c, t, g, unknown or other
  modified_base (271)..(271): a, c, t, g, unknown or other
  modified_base (289)..(289): a, c, t, g, unknown or other
  modified_base (466)..(466): a, c, t, g, unknown or other
  modified_base (479)..(479): a, c, t, g, unknown or other
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactcaccccccctctgtgtcggagtctccggggaagacggtaaccatctcctgcacccgcagcactggcagcattgccagcaactttgngcagtggtaccagcagcgccgggnagtcgcccccacactgtnatctatgaggactaccccaacgcccctcgtcggggtccctgattcggttctcgtcggcctccgatcgacacgcctcctccaactcctcgcccctcctacaccctatcctcgtcggaactgaaacgactggaaggaccgtaggctagaacttacctagtcggtactagttctttaagngaatacgactaanactaatactagttacggttaggttacggttacgggtacggggacggaaccgtacgtacgtacggtaaccgtaccgtacggtacgaccgaccgaccgtaccgtccg

SEQ ID NO: 394410 - DNA, 535 bp, Homo sapiens
  misc_feature: GZ8MTXP02HLZH8.44.12.B01.1.454.CMB.2.raw
  modified_base (371)..(371): a, c, t, g, unknown or other
  modified_base (397)..(397): a, c, t, g, unknown or other
  modified_base (437)..(437): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggactccgccacgcccccgagggaaggggctggagtggattgggagtatctattatagtgggagcacctactaccaacccgtcctacaagacgtcgagtcaccatatcagtanacacgtccaagaccagtctcctgaanctgagtctctgtcgaccgccgcgacacggcgtgtattacngtgcgagagtagggcagttcgcaaccgtacttacgttgaccacgtcgggccgacgggtaaccctggtccaccgtctaccctcaccgcctacaacccgg

SEQ ID NO: 394411 - DNA, 543 bp, Homo sapiens
  misc_feature: GZ8MTXP02GF65T.44.12.B01.1.454.CMB.2.raw
  modified_base (155)..(155): a, c, t, g, unknown or other
  modified_base (174)..(174): a, c, t, g, unknown or other
  modified_base (196)..(196): a, c, t, g, unknown or other
  modified_base (221)..(221): a, c, t, g, unknown or other
  modified_base (250)..(250): a, c, t, g, unknown or other
  modified_base (275)..(275): a, c, t, g, unknown or other
  modified_base (384)..(384): a, c, t, g, unknown or other
  modified_base (447)..(447): a, c, t, g, unknown or other
tcagacagtatatacacgaccggtgctcgatttagtagtgtagattccgcggggggtagctcaggaagcagagcctggagcatctccactatggcctgggctccactacttctcaccctcctcgctcactgcacaggttcttgggccaattttangctgactccaccccccctntgtgtcggagtctccggggaanacggtaaccatctcctgccacccgnagcactggcagcattgccagcaactttgngcagtggtaccagcagcgcccgggnacgtcgcccccacactgtgatctatgagactacccaacgaccctcgtcggggtccctgactcggttctcgtcggcctccatcgacacgctcctcaactctcgccctccncaccactctctggactagaacgctggaggaccgaggcctgaactactactgtacagttcttangaatgcagacaatctaagtgtacggtattcgggaggaacggacctaagcttacggaaccgtccgtaaggtacccacgaccgacggtcctaccccgg

SEQ ID NO: 394412 - DNA, 544 bp, Homo sapiens
  misc_feature: GZ8MTXP02IE1N7.44.12.B01.1.454.CMB.2.raw
  modified_base (206)..(206): a, c, t, g, unknown or other
  modified_base (359)..(359): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtccctnacctgcactgtctctggtgctccatcagcagtagtagttactactggggctggatccgccagcccccaggagggctggagtggattgggagtatctattatagtggagcactactacaacccgtcctcacgagtcgagtcaccatatcagtanacacgtccaaagaccagttctacctgaagctgagctcgtgtcgaccgcgcgacacggccgtgttattactgtgcgagaggtagggctagttcgtacaccctaacttactttgaacctacgttcggggacccacggggtaaccctgggtaacctacccgtctcccgtcaccgcctacccaacccgg

SEQ ID NO: 394413 - DNA, 532 bp, Homo sapiens
  misc_feature: GZ8MTXP02HP00Z.44.12.B01.1.454.CMB.2.raw
  modified_base (375)..(375): a, c, t, g, unknown or other
  modified_base (518)..(518): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggatccgccacgcccccgagggaaggggctggagtggattggggagtatctattagtaggtgggagcacctactaccaacccgtccctacaagacgtcgacgtcacatatcagtaanaccacgtaccaagaaccagttcctaccctgtaacgctgagctctgtcgaccgcgcggacacggcgtgttatactgtgcgagagtggctagtcgtacactactacttgaccagtcgggccacggtacctggtccacgtctcctnacgtcctacaaccg

SEQ ID NO: 394414 - DNA, 617 bp, Homo sapiens
  misc_feature: GZ8MTXP02JRJG1.44.12.B01.1.454.CMB.2.raw
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccacgcccccgagggaagggctggagtggattgggagtatctattatagtggagcacctactaccaacccgtccctacaacgagtcgagtacaccatatcagtagacacgtaccaaagaaccagttcctccctagaacgctagacgtctcgtgtcgacccgccgacggaccgacggccgtagtacgttactggtgacgaggaggtacggggctacggttcgacaacccgtaacgttaccgtttacgacccgtacgttacgggggacccgtaaccggggtaacccgtttcgggaaccctaaccccggtccttaccccgtaccgaacccggtccccctacccgaaacccccgg

SEQ ID NO: 394415 - DNA, 554 bp, Homo sapiens
  misc_feature: GZ8MTXP02JQBGH.44.12.B01.1.454.CMB.2.raw
  modified_base (447)..(447): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggatccgccacgcccccagggaagggctggagtggattgggagtatctattagtagtggagcacctactaccacccgtcctacaacgacgtcgagtcaccatactcagtagacacgtccaagaaccagttcctccctgaacgctgacgtctcgtgtcgaccgccgcggacacggtccgtgtacttacgnggtgacgaggagtaggggctaggttcgacacctaacttactttacgacctacgtcggggaccgacgggaaccctggtccaccgtctacctcacgtcccacaacccgg

SEQ ID NO: 394416 - DNA, 618 bp, Homo sapiens
  misc_feature: GZ8MTXP02GZRKZ.44.12.B01.1.454.CMB.2.raw
  modified_base (412)..(412): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccacgcccccgagggagggctggagtggatgggagtatctattagtaggtggagccacctactaccgaaccccgtcctacaacgagtacgacgtacaccatatcagtacgacacgtaccaacgacctacgttcctccctagaacncgtgacgtctcctggtccgaacccggccgccggacgacccgggtccgtagtcttacgtgtacgacgagtacggtaggctacgttcgacaaccgtaactacgttcgaccgtacgtcggggacccgtaacggggaaccccgttcggtaacccgtaacccgttcccgttacccgtaccgtaccgtaccccgttaccaaaacccccgggg

SEQ ID NO: 394417 - DNA, 616 bp, Homo sapiens
  misc_feature: GZ8MTXP02JM01R.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccacgcccccgagggaggggctggagtggagttgggagtatctattataggtggacgcacctactaccaacccgtcctacaacgagtcgagtcacatatcagtagacacgtaccaaagaccagttacctcctagaacgctgacgctcgtcggtacgacccgccggaccggacgaccgggtccgtagtacttacggtgtaggcgagagggtacgggctaggttacgacaacccgtaacttacgtttcgaacccgtacggttcgggggaacccgtaacggggtaccccgtacgggtccctacccggttaccctcccgttaccgaccggtaccccttacccgaaaccccggg

SEQ ID NO: 394418 - DNA, 547 bp, Homo sapiens
  misc_feature: GZ8MTXP02F90L8.44.12.B01.1.454.CMB.2.raw
  modified_base (366)..(366): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcgggagaccctgtcccctcacctgcactgtctctggtgctccatcagcagtagtagttactactggggctggatccgccagcccccagggaagggctggagtggattggggagtatctattataggtgggagcaccgtactacaacccgtccctacaacgagtcgagtcaccatancagtagacacgtaccaaagaacctagttcctaccctagaacgctgagtctactgtcgaccgccgcggacacggccgtgtatactgtgacgagaggtaggcagttcgcaacctacttacttcgactacgtcgggccaacggggaaccctggcctaccgtctccgtcacgcctaccaacccgg

SEQ ID NO: 394419 - DNA, 614 bp, Homo sapiens
  misc_feature: GZ8MTXP02HUURK.44.12.B01.1.454.CMB.2.raw
  modified_base (219)..(219): a, c, t, g, unknown or other
  modified_base (367)..(367): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggccaggactggtgaagccttcggagaccctgtccctcacctgcactgtctntggtgctccatcagcagtagtagttactacgtggggctggactccgccacgcccccgagggagtggctggagtggagttgggagtatcttattagtaggtgggagacacctactaccgaccgtccctacaagacgtcgagtcaccatntacagtagacactacaaagaaccagttcctaccctagacgctagacgtcttctgtacgacccgccgacggacgaccggccgttagtacttacgtcgtgaccgaggaggtacgggactacgttccgtaccaaccgtaaacgtttaccgttcgaaacccgtacggtaccgggggtaaccgtaacggggaacccccgttgggtacccctaaccggttcctacccggtccaaccggtcccctaaaccccgg

SEQ ID NO: 394420 - DNA, 603 bp, Homo sapiens
  misc_feature: GZ8MTXP02HJMXE.44.12.B01.1.454.CMB.2.raw
  modified_base (285)..(285): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccacgcccccgaggagggcnggagtggatgggagtatctatatagtggagcacctactaccaacccgtccctacaacgagtcgagtcaaccatatcgagtaagacaacgtccaaagaaccagttacctccctagaaagctgaacgtctctgtacgaccgccgacggacacccgggtccgtgttaacttaccgttggtagccgaggagggttagggctacggtttcgaccgtaaaccctaacttacgtttacgaacccttaacggcgggggtcccaaacgggggtaacccctggggtccctaaccggtccctcctaccacggtccctaccgaaacccgg

SEQ ID NO: 394421 - DNA, 561 bp, Homo sapiens
  misc_feature: GZ8MTXP02G80XL.44.12.B01.1.454.CMB.2.raw
  modified_base (338)..(338): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcggcccaggactggtgaagccttcggagaccctgtcccctcacctgcactgtctctggtgctccatcagcagtagtagttactactggggctggactccgcacgccccgaggagggctggagtggagtgggatatctagttataggtggagcgactactaacacccgtcctanaacgagtcgagtcacatatcagtacacacgtacaaagaaccagttctccctagaagctgagtctcgtgtcgaccgcgccgacaccggtcctagttacgtactgtgcgtagagtaggctagttacgactaacctaactacgtttcgaacctcggtacgggaccaacgggtaacccgtcggtaaccgtaccgtccgttccacgtacgacccttacgaaaccccgg

SEQ ID NO: 394422 - DNA, 550 bp, Homo sapiens
  misc_feature: GZ8MTXP02FMYOT.44.12.B01.1.454.CMB.2.raw
  modified_base (367)..(367): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggatccgccacgcccccgagggaagggctggagtggattgggatatctatatagtggagcacctactaccaacccgtcctacaacgagtcgagtcaccatatcagtanacacgtaccaaagaaccagttcctccctagaaagtctaggagtctcgtcgtcgaccgccgacggacgaccggccgtgtattacgtgtgcgagacggtagggcagttcgacaacctaacttacttgacctacgtcggggacccgacggaccctggtccaccgtctcctcacgcctaccgaaccg

SEQ ID NO: 394423 - DNA, 586 bp, Homo sapiens
  misc_feature: GZ8MTXP02F2BOB.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccaggaaggggctggagtggattggggagtatctattagtaggtgggagcaacctactaccaacccgtcctcaacgagtcgagtcacatatcagtagacacgtccaaagaaccagttcctcccgtagaaacgtctaggacgtctctcgtcgacccggccggcggaccgacgggccgttagtacttacgtgtgcgagaggtgggcagttcgacacctaactacgtttcgaaccgtacggtcggggaccaacggggaaccccttgggaaccgtaacccggtccttccgtaccgacgtcccgttacccgaaacccgg

SEQ ID NO: 394424 - DNA, 540 bp, Homo sapiens
  misc_feature: GZ8MTXP02H3A50.44.12.B01.1.454.CMB.2.raw
  modified_base (441)..(441): a, c, t, g, unknown or other
  modified_base (445)..(445): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttggagaccctgtcccctcacctgcactgtctctggtgctccatcagcagtagtagttacactggggctggatccgccagcccccaggaaggctggagtggattgggagtatctattatagtggagcacctactaacaaaccccgtccctcaaacgagtcgagtcacatatcaagtagacacgtaccaaagaaccagttacctcccagaaagctagagctctgtcgaccgccgcgaactcggccgtgtaattacngtgngagagtagggcagttcgacaaccaactaactttgaacctacgtcgggaccaaggggaaccctggtaaccaaccgtctccacgaccgccaccaccg

SEQ ID NO: 394425 - DNA, 631 bp, Homo sapiens
  misc_feature: GZ8MTXP02FX62Q.44.12.B01.1.454.CMB.2.raw
  modified_base (351)..(351): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagtactacgtggggctggactccgccacggcccccgaggggaaggggctggaggtggagttggggagtatctaattagtagtgggagcacctactaccaacccgtcctanaacgacgtcgagtcaccatactcagtacgacaccgtaccaaacgaaacctacgttcctcccgttagaaacgcttagagtcctcgtaggtcgacccggccgcggaaccgacggtccgtagttacgttacgtggtagaccgaggtacggtacgggactagttaccgactaacctaaacgttaccgtttacgaaccgtacggtcggggacccgaaacgggggtaaccccttggtaacccgtacccggtcctacccgtcgaccggtcccctacccgaaacccgg

SEQ ID NO: 394426 - DNA, 533 bp, Homo sapiens
  misc_feature: GZ8MTXP02G84OU.44.12.B01.1.454.CMB.2.raw
  modified_base (443)..(443): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtccctcacctgcactgtctctggtgctccatcagcagtagtagttactactggggctggatccgccacgcccccagggaagggctggagtggattggggagtatctattataggtggagcacctactacaacccgtcctacaacgagtcgagtcaccatatcagtagacaccgtccaaagaaccagttcctccctgaaacgctgagctctgtcgaccgccgcggacacggccgtgtattacngtgcgtagagtgggctagttcgtacaccgtaactacttgacccagtcgggaccacgggaccctggtcacgtctctcacgcctacaacccg

SEQ ID NO: 394427 - DNA, 562 bp, Homo sapiens
  misc_feature: GZ8MTXP02FTQ50.44.12.B01.1.454.CMB.2.raw
  modified_base (446)..(446): a, c, t, g, unknown or other
  modified_base (452)..(452): a, c, t, g, unknown or other
tcagacagtatatacacgaccggtgctcgatttagtagtgtagattccgcgggggcgtttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctcgtggtgctccatcagcagtagtagtactacgtggggctggatccgccacgcccccgagggaacggggctggagtggagtgggagtatctattagtagtggagcacctactacaaccgtcctcaagagtcgagtcaccatatcagtagaacacgtaccaaagaaccagttcctccctagaacgctgagctctgtcgaccgccgcgacacggccgtgtatactgnacgagngtaggcagttcgtacaaccgtaacttacgtttacgaccgtacgtcggggtaccgaacggggaacccctggtaacccgaccggtcctaccgtcaccgccctaccaacccgg

SEQ ID NO: 394428 - DNA, 490 bp, Homo sapiens
  misc_feature: GZ8MTXP02GSYWF.44.12.B01.1.454.CMB.2.raw
  modified_base (377)..(377): a, c, t, g, unknown or other
  modified_base (389)..(389): a, c, t, g, unknown or other
  modified_base (397)..(397): a, c, t, g, unknown or other
  modified_base (415)..(415): a, c, t, g, unknown or other
  modified_base (425)..(425): a, c, t, g, unknown or other
  modified_base (434)..(434): a, c, t, g, unknown or other
  modified_base (452)..(452): a, c, t, g, unknown or other
  modified_base (458)..(458): a, c, t, g, unknown or other
  modified_base (470)..(470): a, c, t, g, unknown or other
  modified_base (477)..(477): a, c, t, g, unknown or other
  modified_base (479)..(479): a, c, t, g, unknown or other
  modified_base (485)..(485): a, c, t, g, unknown or other
  modified_base (487)..(487): a, c, t, g, unknown or other
tcagacagtatatacacgaccggtgctcgatttagtagtgtagattccgcggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagtactactggggctggatccgcagcccccaggaagggctggagtggattgggagtatctatatagtggagcactactacaaaccgtcctcaagagtcgagtcaccatatcatagacacgtccaaagaaccagttcnccctgaaagctnagctctgngacgcgcgacgacgccgngtatatgtgngagagaggngagtcgtcacaacacttntacacnggcgacgaaccncgcgacncnctcacncncac

SEQ ID NO: 394429 - DNA, 711 bp, Homo sapiens
  misc_feature: GZ8MTXP02HBVAY.44.12.B01.1.454.CMB.2.raw
  modified_base (327)..(327): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtccctcacctgcactgtctctggtgctccatcagcagtagtagttactacgtggggctggactccgccacgccccgaggggagggcgtggagtggattggggagtattcgtattagtaggtggganctacctacctaccaaccccgtacctacaacgtacgtccgagtaccaccagtactcagtacgaaccgaccgttaccaaacgaacctacgttccctaccctagtaacgctagacgtctctagtcggacccgccgacgggaacccgaccggggtccgttaggttaacgtttaccgtgggttagccggaaagggtacggtacgggggtactaacgggtttacgtaacccaaccgttaaaaccgttccgttttaaccgggaccccggttaaacgggtcccgggggttaacccgaaaaccgggggttaaccccttaccgggggtaaccctaacccggtttacccttccccggtaacccgaccccggtacccccgtaacccggaaacccgg

SEQ ID NO: 394430 - DNA, 637 bp, Homo sapiens
  misc_feature: GZ8MTXP02HDU96.44.12.B01.1.454.CMB.2.raw
  modified_base (329)..(329): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactacgtggggctggactccgccacgcccccgaggggagggctggaggtggagttggggagtatactattagtaggtggganacacctactacctacccgttctacaagagtcgacgtcacatatcagtagaccacgtaccaaacgacctacgttcctaccgtagaagtcgtagacgtcttacgtcgtacgacccgccggaccggaccgaccgggtacccgttaggtttaacttacgtggttacggacggtaacggtaggtacggggctaaccggttccgtaccaaacccttaaacgttaccgtttacgacccgtacggtaccgggaccgtaacggggtaccctcggtcccacccgttcctaccctcgaccgtcccctaaccgaacccgg

SEQ ID NO: 394431 - DNA, 648 bp, Homo sapiens
  misc_feature: GZ8MTXP02GC02P.44.12.B01.1.454.CMB.2.raw
  modified_base (175)..(175): a, c, t, g, unknown or other
  modified_base (253)..(253): a, c, t, g, unknown or other
  modified_base (281)..(281): a, c, t, g, unknown or other
  modified_base (380)..(380): a, c, t, g, unknown or other
tcagacagtatatacacgaccggtgctcgatttagtagtgtagattccgcggggggtagctcaggaagcagagcctggagcatctccactatggcctgggctccactacttctcaccctcctcgctcactgcacaggttcttgggcctaattttatgctgactccaccccccctntgtgtcggagtcgtccggggaagacggtaaccatctcctgccacccgcaggactggcagcattgccagctaactttgngcagtggtaccagcgagccgccccgggnacggtccgcccccaccactgtgatctatggagactaaccccaacgtaccctcggtcggggtccctggtacttcggtctcgtggtcccctccgatcgacncgtccctcctccacctcgtcctacccctcccctacaccgtcttcctacgtacggactacgaaacgtaccgtagggacgggaacggagggtacctacgtaaccttaccgtaacgttcgtaccgtagttacttagtacgttaagtaacgcaagacctaaagtctaagttggtaggttacggttcggggacgggtaacgggaccgtaacgtccgtcgaacccgtcgtacggtaccgaccggacccgaacggtcccgtacccggtcccccgg

SEQ ID NO: 394432 - DNA, 671 bp, Homo sapiens
  misc_feature: GZ8MTXP02H89JT.44.12.B01.1.454.CMB.2.raw
  modified_base (325)..(325): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggactccgccacgcccccgaaggggacgggcgtggagtggattggggagtatctatagtaggtggancacctactaccaaccccgtcctacaacgagtcgacgtacacctatactcgagtaacgaacctaccgtaccaaacgtaaacctacgttcctacccgtaggaaacgtcttacggaacgtcctacgttcggtaccggaaccccggccggccggaaccgtacccgggtcccgttagttacgttacgttcggtaggacgagggtaaggttacggggacgtacggtttacggacctaacccgtaaacttaccgtttagacccgtaacggtcgggggacccgaaacgggggtaacccctggggtccctaaccggttccctaccctaccgaccgtacccctacccgaaacccgg

SEQ ID NO: 394433 - DNA, 532 bp, Homo sapiens
  misc_feature: GZ8MTXP02GIE38.44.12.B01.1.454.CMB.2.raw
  modified_base (357)..(357): a, c, t, g, unknown or other
  modified_base (365)..(365): a, c, t, g, unknown or other
  modified_base (385)..(385): a, c, t, g, unknown or other
  modified_base (394)..(394): a, c, t, g, unknown or other
  modified_base (519)..(519): a, c, t, g, unknown or other
  modified_base (523)..(523): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctcatcagcagtagtagttactactggggctggatccgccacgcccccagggaaggggctggagtggattgggagtatctattatagtggagcacctactacaacccgtcctcaagagtcgagtcaccanatcagtanacactcaaagaaccagttcnccctgaaanctgagctctgtcgaccgccgcggacacggccgtgtattactgtgcgtagagtagggcaggttcgtacaactaacttacttagaccacgtcgggccaacgggtaccctggtccgaccgtctacccncacncccacaacg

SEQ ID NO: 394434 - DNA, 591 bp, Homo sapiens
  misc_feature: GZ8MTXP02HD029.44.12.B01.1.454.CMB.2.raw
  modified_base (314)..(314): a, c, t, g, unknown or other
  modified_base (365)..(365): a, c, t, g, unknown or other
  modified_base (457)..(457): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctcatcagcagtagtagttactactggggctggactccgccacgcccccgagggaggggctggagtggatgggatatctatagtagnggagcactacaccacccgtcctacaagagtacgagtacaccatatcagtanaaccacgtccaaagaaccagttccaccctagaacgctagaagtctctgtacgacccgccgaccgacgaccggccgtagttagttacgttggngtacggaggaggtaggcgtagttccgtaccaacgtaacttacgtttcgaaaccctacggtacgggacccgacgggtaacccctgggtaacccgtaccgtcctccctaccgacgacccccttaccgaaaccccgg

SEQ ID NO: 394435 - DNA, 544 bp, Homo sapiens
  misc_feature: GZ8MTXP02GTWVJ.44.12.B01.1.454.CMB.2.raw
  modified_base (359)..(359): a, c, t, g, unknown or other
  modified_base (365)..(365): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccgagggaacggggctggagtggattgggagtatctatatagtggagcacctactacaacccgtcctcaacgagtcgagtcacatancagtanacacgtccaaagaaccagttacctccctagaagctgagctctgtcgaccgccgcgacacggccgtgtatactgtgcgagagtaggcagttcgtcaacctaactacttagaccacgtcggggaccgaacggggaaccctgggtaaccacccggtctccctacgacgccctaccaacccgg

SEQ ID NO: 394436 - DNA, 608 bp, Homo sapiens
  misc_feature: GZ8MTXP02JFWCZ.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggatccgcacgcccccgagggagggctggagtggattgggagtatctattataggtgggagcacctactaccaaccccgtccctacaacgtagtcgagtcacatatcagtagacacgtccaagaaccagttcctccctagaagctgagctctgtcgacccgccgcggacgcggtccgtgttacttacgtgtgacgaggacggtaggggctaggtttccgtacgaaccctaaacgttacctttacggaaccctacggttccgggggacccgtaaccggggtaaccccgttcgggtaacccgtaacccggtttcctcccgttacaccggtcccccttacccgaaaccccgg

SEQ ID NO: 394437 - DNA, 548 bp, Homo sapiens
  misc_feature: GZ8MTXP02FM97N.44.12.B01.1.454.CMB.2.raw
  modified_base (303)..(303): a, c, t, g, unknown or other
  modified_base (360)..(360): a, c, t, g, unknown or other
  modified_base (434)..(434): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaagggctggagtggattgggagtanctatatagtggagcactactacaccgtcctcaacgagtcgagtcaccatatcagtanacacgtccaaagaccagttcctcctagaagctagagctctgtcgaccgccgcggaccacggccgtagtattacngtgcgagagtagggcagttctcgacctaaactactttgaccgtacgtcggggaccgtaacggggaacccttgggaaccacccggttctacccttcaacgccctaccaaacccgg

SEQ ID NO: 394438 - DNA, 591 bp, Homo sapiens
  misc_feature: GZ8MTXP02JDJN4.44.12.B01.1.454.CMB.2.raw
  modified_base (358)..(358): a, c, t, g, unknown or other
  modified_base (364)..(364): a, c, t, g, unknown or other
  modified_base (389)..(389): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagtagtagttactactggggctggatccgccacgcccccgagggagggctggagtggattgggagtatctattataggtggagcactactacacccgtcctcaagacgtcgagtcacatancagtanacacgtaccaaagaacctagttccnccctagaacgctgagctcgtgtcgaccgccgcggacaccgggtccgtagttacttactggtgacggaggaggtacgggctaggtttcgacaaccctaacgtttacgtttacggaaccgtacggtacgggggaccctaacggggaaccccttggggtaacccacccggttctcccgtacaccggacccttaccaaaccccggg

SEQ ID NO: 394439 - DNA, 629 bp, Homo sapiens
  misc_feature: GZ8MTXP02HFNOY.44.12.B01.1.454.CMB.2.raw
  modified_base (383)..(383): a, c, t, g, unknown or other
  modified_base (413)..(413): a, c, t, g, unknown or other
  modified_base (473)..(473): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggactccgccacgcccccgagggaacggggctgggagtggagttggggagtagtctattagtaggtgggagcaccgtactaaccaaccccgtcctacaacgagtaccgagtcaccatatcagtanacacgtaccaagaccattctccctgaaacnctagagcctctcgtcgaacccgccggcgaccgaccggtccgtgttacttacgtggtacgnggtacggaggtagggaccgtacggtttcgtaccaaacccgttaacttaccgttttacgaacccgtacggttacgggggcccgtaaaaccgggggtccccttacggggcccgtaaccggtcccttcctacccgaccgtccccctaccgaaaccccgg

SEQ ID NO: 394440 - DNA, 609 bp, Homo sapiens
  misc_feature: GZ8MTXP02GB22C.44.12.B01.1.454.CMB.2.raw
  modified_base (325)..(325): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcgggagaccctgtcccctcacctgcactgtctctggtgctccatcagcagtagtagttactacgtggggctggactccgccacgcccccgaggggaggggctggagtggattgggagtatctattataggtgggancacctactaccaacccgtccctacaacgacgtcgacgtcaccatatcgagtacgacacgtacccaaagaaccagttcctccctagaacgtctgagctactgtcgaccgccgacggaccacggccgtagtattacgtggtagcgagaggtaggcgtagtcgtacaacccgtaacttacgtttacgacccgtacggtcggggacccgtaacggggaaccccgtgggtaacccgaacccgttccgtaccccgttaccgaaccggtccccgttacccgaaacccccgg

SEQ ID NO: 394441 - DNA, 634 bp, Homo sapiens
  misc_feature: GZ8MTXP02IU5PX.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggactccgccacggccccccgaggggaaggggctgggaggtgggagttggggagtagtcttattagtaggtgggagcgacctactaacctaaccccgtccctacaacgagtacgacgtacaccatatcgagtacgacaccgtaccaaagaaacctacttcctaccctagaacgctagacgtctcgtggtcgacccgccgacggacgaccggtccgtagttacgttacgtaggtcgacggaaggtacggttacggggctacggttccgtacaaacccgtaacgttaccgtttacgaacccgtacggtcgggggacccacggggtaaccccgtggtaacccgaccgtccgtccctcgaccgtccctacccgaacccgg

SEQ ID NO: 394442 - DNA, 586 bp, Homo sapiens
  misc_feature: GZ8MTXP02FTMUT.44.12.B01.1.454.CMB.2.raw
  modified_base (364)..(364): a, c, t, g, unknown or other
  modified_base (370)..(370): a, c, t, g, unknown or other
  modified_base (430)..(430): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggacgaccctgtcccctcacctgcactgtctctggtgctcatcagcagtagtagttactacgtggggctggatccgccacggcccccgaggggaaggggctgggaggtggattggggagtatctattataggtggagcacctactacaccgtcctcaagagtcgagtcacatancagtanacacgtaccaaagaaccagttcctccctagaacgctgacgctctgtcgaccgccgcgacncggccgtgtattacctgtgcgagaggtaggctagttccgtacacccgtaaacttactttcggaaccctacggtacgggggacccgtaacggggaaccccttcggtaaccgaccccggttctaccccgttcgaccgtccccgttacccaaaccccgg

SEQ ID NO: 394443 - DNA, 631 bp, Homo sapiens
  misc_feature: GZ8MTXP02FLFFL.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcgggagaccctgtcccctcacctgcactgtctctggtgctccatcagcagtagtagttactacgtggggctggactccgccacggcccccgaggggaacgggcgtggagtggagttggggattatctattagtaggtggacgccaccttaacctaaccaaccccgtccctagaacgtagtcgagtcacatatcgagtacacaccgtaccaaagacctagttcctacccgtagaacgctgacgtctactgtccgaccgccggcggaaccgaccgggtcgttagttacttacgtggtagaccgtaggtacgggtagggctacggttaccgacaacctaacttacgtttacgaccctacgggacgggacccgtaaccggggacccgttggtaacccgtacccggttcctacccgtcgaacccgccccgtaccgaaacccccggg

SEQ ID NO: 394444 - DNA, 609 bp, Homo sapiens
  misc_feature: GZ8MTXP02FS679.44.12.B01.1.454.CMB.2.raw
  modified_base (456)..(456): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctcgtggtgctccatcagcagtagtagttactagtggggctggactccgccacgcccccgagggagggctggagtggatgggatatctattatagtggagcacctactaccacccgtcctacaacgagtcgagtcaaccatactcagtagaccacgtccaaagaaacctagttcctccctagaagtctgagtctctgtcgacccgccgcgacgacggcgtagtattactggtcgacgnggacggtaggggtactacggttcctaccgaaaccctaacgttaccgtttacggaaccctacgggttccggggacccgtaaacgggggaaccccgtttcggggaacctaaccccggttccttaccctccaaacgtcccctacccgaaaccccgg

SEQ ID NO: 394445 - DNA, 542 bp, Homo sapiens
  misc_feature: GZ8MTXP02HW0GR.44.12.B01.1.454.CMB.2.raw
  modified_base (323)..(323): a, c, t, g, unknown or other
  modified_base (369)..(369): a, c, t, g, unknown or other
  modified_base (396)..(396): a, c, t, g, unknown or other
  modified_base (401)..(401): a, c, t, g, unknown or other
  modified_base (422)..(422): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagcccttcgggagacccctgtcccctcacctgcactgtctctggtgctccatcagcagtagtagttactactggggctggatccgccagcccccgagggaaggggctggagtggattgggagtatctatagtagtggancgacctactacaacccgtcctcaagagtcgagtcacatatcagtanacacgtaccaagacagtctccctgaanctganctctgtcgaccgccgcggacncggccgttgtaacttacgtgtgcgagaggtaggctagtcgtcaacctacttactttgacctaggtcgggccacgggaaccctggtcctaccgtcctcctacaccgtcctaccgaacccgg

SEQ ID NO: 394446 - DNA, 526 bp, Homo sapiens
  misc_feature: GZ8MTXP02FLNPD.44.12.B01.1.454.CMB.2.raw
  modified_base (370)..(370): a, c, t, g, unknown or other
  modified_base (425)..(425): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccgagggaaggggctggagtggattggggagtatctattatagtgggagcaccgtactacaacccgtccctcaacgagtcgagtcaccatatcagtanacacgtccaagaaccagttctccctgaagctgagctctgtcgaccgccgcggacncggccgtgtattactgtgcgagagtaggcagtcgtcacaactacttgaccacgtcgggccgacgggaccctggtccaccgtctcctcacgcctccaacccg

SEQ ID NO: 394447 - DNA, 633 bp, Homo sapiens
  misc_feature: GZ8MTXP02GF1ZN.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtatactacgtgggctggatccgccacgcccccgagggaagggctggagtggattgggagtatctattagtaggtggagcaccgtactaccaacccgtcctacaagacgtcgagtacaccatatcagtagacacgtaccaaagaacctagttcctccctagaaacgctagagtctcgtgtacgaccgaccgcggaaccacgggccgtaggttaacttaccgtgggtagaccgaaggacggtaacggggctacggttaccgtacgaacctaaacttacgtttacggaacccgtaaccggttcgggggacccgtaaacggggtaacccccgttgggtaaccctaacccggttccgttacccctaccgaccggtaccccttaccccgaaaacccggg

SEQ ID NO: 394448 - DNA, 544 bp, Homo sapiens
  misc_feature: GZ8MTXP02GNIUZ.44.12.B01.1.454.CMB.2.raw
  modified_base (317)..(317): a, c, t, g, unknown or other
  modified_base (385)..(385): a, c, t, g, unknown or other
  modified_base (393)..(393): a, c, t, g, unknown or other
  modified_base (399)..(399): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggaagggctggagtggattggggatatctattatagtggancacctactacaacccgtcctcaacgagtcgagtcaccatatcagtagacacgtccaagaaccagttcnccctgaanctaganctctgtcgaccgccgcgacacggccgtgtattactgtgcgagagtaggcagtcgtacaccgtaaactactttgaaccacgtcggggaccaacggggtaaccctgggtaaccaccggttctccctcaacgtccctaccaaacccgg

SEQ ID NO: 394449 - DNA, 521 bp, Homo sapiens
  misc_feature: GZ8MTXP02G7SMD.44.12.B01.1.454.CMB.2.raw
  modified_base (318)..(318): a, c, t, g, unknown or other
  modified_base (365)..(365): a, c, t, g, unknown or other
  modified_base (384)..(384): a, c, t, g, unknown or other
  modified_base (396)..(396): a, c, t, g, unknown or other
  modified_base (506)..(506): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactactggggctggatccgccacgcccccagggaagggctggagtggattgggagtatctatatagtggancactactacaacccgtcctcaacgagtacgagtcacatactcagtanacacgtcaagaaccagtcncctgaagctganctctcgtcgaccgcgcgacaccggcgtgtatactgtgcgagagtaggctagtcgacactaactacttgaccacgtcgggccacgggaccctggtccaaccgtctcccgtnacgcctccaacccgg

SEQ ID NO: 394450 - DNA, 626 bp, Homo sapiens
  misc_feature: GZ8MTXP02J01ZK.44.12.B01.1.454.CMB.2.raw
  modified_base (154)..(154): a, c, t, g, unknown or other
  modified_base (173)..(173): a, c, t, g, unknown or other
  modified_base (196)..(196): a, c, t, g, unknown or other
  modified_base (280)..(280): a, c, t, g, unknown or other
  modified_base (299)..(299): a, c, t, g, unknown or other
  modified_base (372)..(372): a, c, t, g, unknown or other
  modified_base (427)..(427): a, c, t, g, unknown or other
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttangctgactccaccccccctntgtgtcggagtcgtccggggaanacggtaaccatcctcctgccaccgcagcactggcagcattgaccaactaactttgtgcagtcggtaccagcagcggccccgggnacgtccgcccccacactgngaatctatgaggactaaccccaacgaccctcgtcggggtccctgactcggttctcgtcggcctaccatcgacngcctcctccaactcctcgccctcctaccaccattctcgaggactacgaacgtacngggacggaccggaggctacgacttacgtacttcggtactacggttcttaagtaggtaagtacgacgagtaactaagtacgtagttacgggttacggttacggtccgggaacgggtaacggaaccgtaacgtcccgtaccggtacccggtaaccgtacggtaccgaccggtaacccgaccggtcccgtaccccgtccccg

SEQ ID NO: 394451 - DNA, 485 bp, Homo sapiens
  misc_feature: GZ8MTXP02H7BLH.44.12.B01.1.454.CMB.2.raw
  modified_base (297)..(297): a, c, t, g, unknown or other
  modified_base (471)..(485): a, c, t, g, unknown or other
tcagacagtatatacacgaccggtgctcgatttagtagtgtagatttgagtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcacgcctccctggccatcactgggctccaggctgaagatggagggtnattattactgccagtcctatgacagcagcctcagtggttgggtgttcggcggaggaccaagctgaccgtcgtgggtcacgcccgaaggcctcgccccctgtccactccgtcgtccccgccctcctctatactactcgtctgacggtcgggcgtggacgaagggcgacgagtagnnnnnnnnnnnnnnn

SEQ ID NO: 394452 - DNA, 584 bp, Homo sapiens
  misc_feature: GZ8MTXP02F7TVO.44.12.B01.1.454.CMB.2.raw
  modified_base (320)..(320): a, c, t, g, unknown or other
  modified_base (437)..(437): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccacgcccccgagggaagggctggagtggattgggatatctattatagtggancacctactaccaacccgtcctacaacgagtcgagtcacatatcagtagacaccgtaccaaagaacctagttcctccctagaaacgctagacgtctcgtgtcgacccgccgcggaccncggcctagtatcgtgtgacgagaggtagggctaggttcgacaaccctaacttacgtttacgacctacggtacggggacccgaaacggggtaaccccttggtaacccgtacccggttctccctacgacgtcccctacccgaaacccgg

SEQ ID NO: 394453 - DNA, 704 bp, Homo sapiens
  misc_feature: GZ8MTXP02I6W4H.44.12.B01.1.454.CMB.2.raw
  modified_base (173)..(173): a, c, t, g, unknown or other
  modified_base (249)..(249): a, c, t, g, unknown or other
  modified_base (275)..(275): a, c, t, g, unknown or other
  modified_base (292)..(292): a, c, t, g, unknown or other
tcagacagtatatacacgaccggtgctcgatttagtagtgtagattccgcggggggtagctcaggaagcagagcctggagcatctccactatggcctgggctccactacttctcaccctcctcgctcactgcacaggttcttgggccaattttatgctgactccacccccctntgtgtcggagtcgtccggggaagacggtaaccatctcctgcacccgcagcactggcagcattgccagcaactttgngcaggtggtaccagcagcgcccgggnagtcgcccccacactgngatctatggaggactaccccgaacgtacccctcgtcggggtcccctggtacgttccggttctccgtcgggtccctacccgagtccgactacgtcccttccctaccctaaactccttccgcccccttcccctaccgtaacccctacgttcccttccgtacggggtaaccttacgggtaaaacgacttaccggggaaacgggtaacccggaaacgggtcctaacggtaaaccctttaaaccgttaccgttacggttacctaagggtttaccttttaagaggtaacttaacggccaaggtacctaaaagttcgagtttacgggtagggtttacgttacgggggacggtaacggggaacccaagtcgtacgtaacccggtcgttacggaccacgaccgaacgggtcccttacccgg

SEQ ID NO: 394454 - DNA, 585 bp, Homo sapiens
  misc_feature: GZ8MTXP02GP1FY.44.12.B01.1.454.CMB.2.raw
  modified_base (371)..(371): a, c, t, g, unknown or other
  modified_base (377)..(377): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactacgtggggctggactccgccacgcccccgaggggaacggggctggagtggagttggggagtatctattagtagtgggagcacctactaccaacccgtcctacaacgagtcgagtcacatancagtanacacgtaccaaagaacctagttcctccctagaacgctagagtctctgtcgacccgcgacggacaccggtccgtgtacttacgtgtgacgagaggtaggctagttcgacaaccctaacttaccgtttacgaccctacggtcggggacccgtaacggggaccctggtccgtaacccgtctacccgtccgactcccgtacccgaaacccgg

SEQ ID NO: 394455 - DNA, 637 bp, Homo sapiens
  misc_feature: GZ8MTXP02HACWU.44.12.B01.1.454.CMB.2.raw
  modified_base (325)..(325): a, c, t, g, unknown or other
tcagacagtatatacacgaccggtgctcgatttagtagtgtagattccgcggggactttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactacgtgggctggactccgccacgccccgagggacgggctggagtggagttgggagtatctagttagtaggtggacncacctactaaccaacccgtcctacaacgtacgtacgagtacaactataactcaagtaacgaacctaccgtaccaaaacgaacctacgttaccctccctaggaaacgctgaacgtctcgtcgtcgaacccggccgacggaccgcggtccgttagtacttacgtggtagacgaggtaggtacgggacgttacgttccgtacaacccgtaaacgtttaccgtttacgaacccgtaggtaccggggaccgtaaccggggtaacccgtggtaacccgaccggttcctacccgtacgactccccgtacgaaaccccgg

SEQ ID NO: 394456 - DNA, 577 bp, Homo sapiens
  misc_feature: GZ8MTXP02JDG3A.44.12.B01.1.454.CMB.2.raw
  modified_base (306)..(306): a, c, t, g, unknown or other
  modified_base (323)..(323): a, c, t, g, unknown or other
  modified_base (370)..(370): a, c, t, g, unknown or other
  modified_base (407)..(407): a, c, t, g, unknown or other
  modified_base (487)..(487): a, c, t, g, unknown or other
  modified_base (562)..(562): a, c, t, g, unknown or other
  modified_base (565)..(565): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctcgtggtgctccatcagcagtagtagttactactggggctggatccgcacgcccccgagggaaggggctggagtggattgggaagtntctattataggtgggancaacctacctacaaccccgtcctcaacgcgtacgagtccacactacnctagtacgaccaccgtacaaacggaaccagtttcccncccgttagaacgcttagagtctcttggtcgaccccggcgacggaccgaccgggtccgtagttattccgtgtacggcgagnggttagggctagttccgtacaacctaacttcttagaccctaggtcgggactaccggggacctggtccacgttccnccncaccgccacacg

SEQ ID NO: 394457 - DNA, 752 bp, Homo sapiens
  misc_feature: GZ8MTXP02F4ZRQ.44.12.B01.1.454.CMB.2.raw
  modified_base (326)..(326): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggacgaccctgtcccctcacctgcactgtctctggtgctccatcagcagtagtagttactacgtggggctggactccgccacgccccgaggggaagggctggagtggtagtgggagtatctattagtaggtgganccaacctacctaccaaccccgtcctacgaacgtacgtcgagtccaacgattactacgagtaacgacaaccgtaccaaaacgtaacctacgttccctacccgtagaaacgccttagacgtcctcgttaggccggacccgcccgggacggaaccgtacccggggtcccgtttaggttaacgtttacggtacgggttacggaccgggtaaggtaacggggtacggggtaccttaacgggttacccgtacccgtaaaaccctaaaccgtttaacccgtttttaccggaaaccccgtaaccggggttacccgggggacccggtaaacccgggggtaacccccgtttacgggtaacccccgttaaccccggttcccgttaacccccgttcccgaaacccgtacccccgtttaacccccgaaaacccccgggg

SEQ ID NO: 394458 - DNA, 555 bp, Homo sapiens
  misc_feature: GZ8MTXP02FK1BM.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggatccgccacgcccccgagggaagggctggagtggattggggagtatctattatagtgggagcacctactaacacccgtccctcaagagtcgagtcaccatatcagtagacaccgtaccaaagaaccagttacctccctagaagctgagtctctgtcgacccgccgcggacacggccgtagtattacgtgtgcgagaggtaggctagttcgtacaaccctaacttactttcgacctacgtcggggaccgaacgggaccctggtccaccgtctccgtcacgccctaccgaacccgg

SEQ ID NO: 394459 - DNA, 657 bp, Homo sapiens
  misc_feature: GZ8MTXP02GB2YO.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtccgggcccaggactggtgaacgccttcggacgacccctgtcccctcacctgcacttgtctcgtggtcgctccatcagcagtagtagttactacgtggggctggactccgccacgcccccgagggaagggctggagtggatgggatatctattataggtggagctacctactaccaaccccgtcctacgaacgacgtacgacgtcaaaccataacgtcaagttaacgaacgaaccgtaaccgaaaacgtaaaccctaggtttaccctcccgttaagaaagaccttagaacgtctcgtggtcgacccggaccggcggaacgacccggtccgttaggttacttacctggtacggccggtaaggacggtagggtacgtacgttcgtaccaacgtaaacctacgtttcgaaacccgtggccgggtaccgaacgggtaaccctcgggtaaccctaaccgttaccgtccctacgtaacgccccttacgaaaacccccgg

SEQ ID NO: 394460 - DNA, 544 bp, Homo sapiens
  misc_feature: GZ8MTXP02GVR17.44.12.B01.1.454.CMB.2.raw
  modified_base (173)..(173): a, c, t, g, unknown or other
  modified_base (249)..(249): a, c, t, g, unknown or other
  modified_base (274)..(274): a, c, t, g, unknown or other
  modified_base (294)..(294): a, c, t, g, unknown or other
  modified_base (404)..(404): a, c, t, g, unknown or other
  modified_base (452)..(452): a, c, t, g, unknown or other
  modified_base (456)..(456): a, c, t, g, unknown or other
  modified_base (462)..(462): a, c, t, g, unknown or other
  modified_base (464)..(464): a, c, t, g, unknown or other
tcagacagtatatacacgaccggtgctcgatttagtagtgtagattccgcggggggtagctcaggaagcagagcctggagcatctccactatggcctgggctccactacttctcaccctcctcgctcactgcacaggttcttgggccaattttatgctgactcaccccccctntgtgtcggagtcgtccggggaagacggtaaccatctcctgcacccgcagcactggcagcattgccagcaactttgngcagtggtaccagcagcgcccgggnacgtcgccccccacactgtnatctatgaggactaacccaacgaccctcgtcggggtccctgacgtcggttctcgtcggctccatcgacacgtctccctaccaactcctcgccctccctcacctatcttcnggactgaaagctggagacgaggctgaactactatgtcaggttcttaangtanagacananatatagtgtaggtaggtacggacgggacggacgacgacgtacgtaaccgtacgtacgtacgacgaccgacgtaccgtccg

SEQ ID NO: 394461 - DNA, 692 bp, Homo sapiens
  misc_feature: GZ8MTXP02GK9IG.44.12.B01.1.454.CMB.2.raw
  modified_base (321)..(321): a, c, t, g, unknown or other
tcagacagtatatacacgaccggtgctcgatttagtagtgtagattccgcgggggctttctgagagtcatggagctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctcgtggtgctcatcagcagtagtagttactacgtgggctggactccgccacgcccccgagggagggctggagtggagttgggatatctattataggtgggancacctactaccaacccgtccacaagacgtcgacgtcaaccatactcgaagtaacgacctaccgtaccaaacgtaaccctagttaccctacccgtagaaacgtccgttagacgtccgttcgtacggtaccggaccccggccggaccgggaaccgtacccggggtacccgttagttaacgtttaccggtggtacggtaccggtaacggtaggggttacgggacgttacggtttaccggacctaaacccgtaacgtttaccgtttacggaacccgtacgggttaccgggggaccccgtaaacgggggtaaccccgttcgggtacccgtaacccggtttcccgtacccgtccgaaccggtcccctaaaccccggg

SEQ ID NO: 394462 - DNA, 581 bp, Homo sapiens
  misc_feature: GZ8MTXP02H393C.44.12.B01.1.454.CMB.2.raw
  modified_base (183)..(183): a, c, t, g, unknown or other
  modified_base (208)..(208): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtnaagccttcggagaccctgtcccctnacctgcactgtctctggtgctccatcagcagtagtagttacacgtggggctggactccgccacggcccccgaaggggaagggcgtaggaggtggagttgggagtatctaattagtaggtggagtacaacctaactaccaacccgtcctacaaacgagtcgatacacatatcagtacgacacgtacaacgaacacgtacctacccagaaacgcagacgtctacgtgtacgacccgccgacggaccgacggtaccgtgttaattacgtgcgagagaggtacggcgtaagttcgacaacctaacttaacgttcgaccacgtcggaccgacgaacccgttggccaccgtccttccacgacgaccctaccgaacccgg

SEQ ID NO: 394463 - DNA, 635 bp, Homo sapiens
  misc_feature: GZ8MTXP02IJC4A.44.12.B01.1.454.CMB.2.raw
  modified_base (353)..(353): a, c, t, g, unknown or other
tcagacagtatatacacgaccggtgctcgatttagtagtgtagattccgcgggggcttactgagagtcatggacctcctgtgcaagaacatgaagcacctgtggttcttcctcctgctggtggcggctcccagatgggtcctgtcccagctgcagctgcaggagtcgggcccaggactggtgaagccttcggacgaccctgtccctcacctgcactgtctctggtgctcatcagcagtatagttactacgtggggctggactccgccacgccccgagggaacggggctgggagtggattggggagtatctaagttagtaggtgggacgcaacctactaccaacccgtccctanaacgtagtcgacgtcaccatactcgagtacgaactacgtacccaaagaacctagttcctccctagaacgctagactctctgtcgacccgccgacggaacgacccggcttagtacttacgtgtagcgtaggtacggtacggggactacggtttcggaccctaaaccgtaaactttacgtttacggaacccgtaacgggttacggggacccgaaacgggggtaaccccttcgggtaaccgtacccggtccttaccgaccgtaccgtccccgtaccgaaacccgg

SEQ ID NO: 394464 - DNA, 661 bp, Homo sapiens
  misc_feature: GZ8MTXP02JUTHU.44.12.B01.1.454.CMB.2.raw
  modified_base (445)..(445): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctcatcagcagtagtagttactactggggctggatccgccacgcccccgagggagggctggagtggattgggagtatcgtaattagtaggtggagctacctactaccaacccgtcctacgaacgacgtcgacgtcacatatcaagtagaccgacgtaccaaagaaccagttcctaccctagaacgctgagtctcgtgtacgacccgccggacggaaccncgggtccgttaggtaacttactcgggtagtacggaagggtacgggtacgggggactacgggtttccgtaccgaaacccgttaaaaccgttactttacgggaaaccccctaaacgggttcggggggaaccccctaaacgggggtaaacccccttggggaacccgttaaccccgggtccttacccgttaccgacccgtcccctaacccgaaacccggg

SEQ ID NO: 394465 - DNA, 611 bp, Homo sapiens
  misc_feature: GZ8MTXP02HPOCA.44.12.B01.1.454.CMB.2.raw
  modified_base (384)..(384): a, c, t, g, unknown or other
  modified_base (420)..(420): a, c, t, g, unknown or other
tcagacagtatatacacgaccggtgctcgatttagtagtgtagattccggggggaggaactgctcagttaggacccagagggaaccatggaagccccagctcagcttctcttcctcctgctactctggctcccagttttcagattccagcggcgaaactgtgttgacacagtctccagccaccctgtctttgtctccgggggaacagccaccctctcctgcagggccgccagctgtgacaacgacttagcctggtaaccaacagaacgcctggccaggcctcccgaggcctcctcatctatgacttacttccaggtaggccacgtggccatccccagcccgcttcgagtggctaggtcggggtctggggacaggtagtttaccnctccactatccaccagcctaagacgcctagaagttntttagcttagtttattactgtcagccgtaccgacgaaagtacgtacggtacctaccaatttacttctacgtttccggcccgtacgggaacctaaaggtggtaactaacgtaaccaaaacggtaaacgtcggtacggtacgtcgtaccacgtaacttcgtcgttacttacctacttcccgtttacccgtacc

SEQ ID NO: 394466 - DNA, 574 bp, Homo sapiens
  misc_feature: GZ8MTXP02FYRYW.44.12.B01.1.454.CMB.2.raw
  modified_base (320)..(320): a, c, t, g, unknown or other
  modified_base (366)..(366): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcgggagaccctgtccctcacctgcactgtctctggtgctccatcagcagtagtagttactactggggctggatccgccagcccccagggaaggggctggagtggattggggagtatctattatagtgggancacctactacaaccgtcctcaacgagtcgagtcaccatatcagtanacacgtccaaagaacccagttcctccctgaacgctgagtctcgtgtcgaccgccgcggacacggcgtgtattacgtgtgcgaggagtgggctagttcgtacacctaaacttctttacgacctacggtcgggggcccgtaaacggggaccccgttaggtcccgtaacccggtccttcccgtacgacggtacccctacccaaaccccggg

SEQ ID NO: 394467 - DNA, 546 bp, Homo sapiens
  misc_feature: GZ8MTXP02F83XS.44.12.B01.1.454.CMB.2.raw
  modified_base (266)..(266): a, c, t, g, unknown or other
  modified_base (324)..(324): a, c, t, g, unknown or other
  modified_base (397)..(397): a, c, t, g, unknown or other
  modified_base (406)..(407): a, c, t, g, unknown or other
  modified_base (409)..(409): a, c, t, g, unknown or other
  modified_base (412)..(412): a, c, t, g, unknown or other
  modified_base (426)..(426): a, c, t, g, unknown or other
  modified_base (433)..(433): a, c, t, g, unknown or other
  modified_base (441)..(441): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaacgtccttcggagaccctgtccctcacctgcactgtctctggtgctaccatcagcagtagtagttactacgtggggctggacnccgccacgcccccgagggagggctggagtggattgggagtatctattagtagtgggancaccgtactaccaaccgtccctacaacgagtcgaagtcaccataatcatagacacgtccaagaacctagttcncctggaacnngnctntgcgccgcgcgacncggtctntatcgtgngcgaggagtggctacgttacgacctaactacttacgtacgaccgtacggtcgggaccgtacggaccgtcggaacctaccgtacctcctcaccgacctaccgaccg

SEQ ID NO: 394468 - DNA, 638 bp, Homo sapiens
  misc_feature: GZ8MTXP02FS87T.44.12.B01.1.454.CMB.2.raw
  modified_base (325)..(325): a, c, t, g, unknown or other
  modified_base (346)..(346): a, c, t, g, unknown or other
  modified_base (350)..(350): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcgggacgaccctgtcccctcacctgccactgtctctggtgctccatcagcagtagtagttactactggggctggatccgccacggcccccgagggaagggctggagtggattggggatatctagttatagtggancacctactacacccgtcctanacgngcgagtcacatatcagtagacacgtaccaaacgaacctacgtttccacccgttagaaacgcctaggacgtccttccgtggtacgacccgcccggacggacccgaaccggggcccgttagttaacttacccgtagggttacgacggaggtagggttacgggctaggttttccgactaacccgtaaactttacgttttaggaccctacggttcgggggaccgtaacggggaacccctggggtaaccctaccgggtcctaccgtcctacggaccccttaccaaaccccggg

SEQ ID NO: 394469 - DNA, 588 bp, Homo sapiens
  misc_feature: GZ8MTXP02JE4P6.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgatggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggatcccgccacgcccccgaggggaacggggctggagtggagttggggagtatctattagtaggtgggagcaacctactaccaaccccgtccctacaacgagtacgagtcaccattatcagtaagaccacgtaccaaacgaaaccagttacctcccgtagaacgctgagctctgtcgaccgccgcgacgacggcgtgtattactggtgcgaggagtagggctaggttcgacaacctaacgttactttacgaccgtacgtcgggggacccaacggggtaacccctggtaacccgacccggtcctcccgtcacggccctacccgaacccgg

SEQ ID NO: 394470 - DNA, 633 bp, Homo sapiens
  misc_feature: GZ8MTXP02FUQ0Q.44.12.B01.1.454.CMB.2.raw
  modified_base (324)..(324): a, c, t, g, unknown or other
  modified_base (347)..(347): a, c, t, g, unknown or other
  modified_base (368)..(368): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggtccaggactgggtgaagccttcgggagaccctgtcccctcacctgcactgtctctggtgctccatcagcagtagtagttactacgtggggctggactccgccacgccccgaggggagggctggagtggagttgggatatctattagtaggtggancacctactaccaacccgtcctanaagtacgtcgagtcaccatancagtacgacacgtacaaacgaacctgttacctcccgtagaacgctagacgctcgtacggtacggacccgaccggacggaacccgaccgggtccgttagttaacgttaccgttgggtacgaccggaaggtaacggtgggtacctaggttccgaccactaaaacttcgtttacgaaccgtaacgggtcggggaaccctaacggggtacccctaggtaacccgtacccggttcctcccgtccgtaccgacccctaccgaaaaccccgg

SEQ ID NO: 394471 - DNA, 602 bp, Homo sapiens
  misc_feature: GZ8MTXP02GDX49.44.12.B01.1.454.CMB.2.raw
  modified_base (321)..(321): a, c, t, g, unknown or other
  modified_base (358)..(358): a, c, t, g, unknown or other
  modified_base (366)..(366): a, c, t, g, unknown or other
  modified_base (386)..(386): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactactggggctggatccgccacgcccccgaggggaacgggctggagtggattgggagtatctatatggtggancactactacaacccgtcctacaacgagcgagtcacanatcagtanacacgtcaaagaccagttcnccctagaacgctgaacgtctcgtagtcgaccgccggacggaccgaccgggtccgttgttacttaccgtggtcgaccgagaggttaagggctaggttaccgtacaaaccgtaaccttactttaggacccgtaacggttacggggaccgaaacggggtaacccttgggtaacccgtccggttcccttacccgacgaacggccccttaccgaaacccgg

SEQ ID NO: 394472 - DNA, 607 bp, Homo sapiens
  misc_feature: GZ8MTXP02HIXMK.44.12.B01.1.454.CMB.2.raw
  modified_base (331)..(331): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtccgggcccaggactgggtgaagccttcggagaccctgtcccctcacctgccactgtctctggtgctccatcagcagtagtagttactacgtggggctggactccgccacgcccccgagggacgggctggagtggagttggggagtatcgtattagtaaggtggacncgaacctactaaccgaaccctccctacgaacgacgtacgagtacaaccatactcgaagtagaccgaaccgtaccaaacgacctaacgttacctcctagaacgctagacgtctcgtgtccgacgcccgacggtacacggtccgtggtacttacgtggtagacgagtacggtaaggctaggttccgtacaaaccgtacttacgtttacgaccttacggcgggaccgtacggacccttaggcctaccggtctcctaccgacgtccctaccgaaacccgg

SEQ ID NO: 394473 - DNA, 669 bp, Homo sapiens
  misc_feature: GZ8MTXP02HNBU1.44.12.B01.1.454.CMB.2.raw
  modified_base (644)..(644): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcagggagtcgggcccaggactggtgaagccttcggacgaccctgtcccctcacctgcactgtctcgtggtcgctccatcagcagtagtagttactagtggggctggactccgccacgcccccgaggggaacggcgtggagtggagttgggagtatactaattagtaggtgggagctaacctaactaacctaaccccgtcctacaagagtacgacgtacacatatcaagtagacacgtacaaagaacctacgttacaccctagaaacgctaggatcgtactacgtcgaaccggcccgaggaaccgtacgggaccgttaggttaattaccgtggtaggtaccgaaggtaggttacggggactaacggtttccgacctaaacccaaaactttacgtttaccgaacccgaccggttacgggggaacccgaaccggggtaaccccgttacggtaacccgtaacccggttccccgttacctaaccggtaccncccccgttaaccgaaaacccccggg

SEQ ID NO: 394474 - DNA, 606 bp, Homo sapiens
  misc_feature: GZ8MTXP02GACZF.44.12.B01.1.454.CMB.2.raw
  modified_base (329)..(329): a, c, t, g, unknown or other
  modified_base (374)..(374): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacctgcactgtctctggtgctccatcagcagtagtagttactacgtggggctggactccgccacggcccccgaaggggaacgggcgtggagtggagttgggagtatctattatggtgggancacctacctaccgaacccgtcctacaacgacgtcgagtcacatancagagacacgtaccaaacgactacgttccaccgtagaacgctgactctctgtcgacccgccgacggaaccgaccgggtcgttacgttacttacgtggtacgacgtaggacggtagggctaggttctacgacctaaacttcgtttacgaccgtaacggcggggacccgaacggggtacccctaggtccgtaacccggttctcccctacgaccgtcccctacccgaaacccggg

SEQ ID NO: 394475 - DNA, 724 bp, Homo sapiens
  misc_feature: GZ8MTXP02JUW6R.44.12.B01.1.454.CMB.2.raw
  modified_base (308)..(308): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtgctccatcagcagtagtagttactacgtggggctggactccgccacgccccgaggggacgggctggagtggagtgggatatntaattagtaggtggagcctaccttaccgtaaccgaaccccgtccctacgaacgtacgtacgacgtaccaacctatactccgaagtaacgacctaacgtaccaaacggaaaccctacgtttccctacccgtagaaacgtctaggaaccgtcttccgtcggttaccggaccccgacccggtaccgggtaaacccgaccgggttcccggtttagggttaaacctttaccggtcggggttacgacccggtaaagggtagggttaacggggtccgtaacggtttaccgttaacccgaaaccctttaaacgtaccgttttacggacccgtaccgggttacggggacccccgaaacggggtacccccgtaggggtaaccctacccggtaccttcccgaccgacgtacccctaccgaaacccgg

SEQ ID NO: 394476 - DNA, 564 bp, Homo sapiens
  misc_feature: GZ8MTXP02I1X5Y.44.12.B01.1.454.CMB.2.raw
  modified_base (348)..(348): a, c, t, g, unknown or other
  modified_base (391)..(391): a, c, t, g, unknown or other
  modified_base (407)..(407): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcgggagaccctgtcccctcacctgcactgtctctggtgctccatcagcagtagtagttactacgtggggctggactccgccacgcccccgagggacgggctggagtggattgggatatctattatagtggagcacctactacaccccgtcctacaacgntcgagcaccatatcgagtagacaccgtccaaagacctagttcnccctagaacgctgacncttaccgtgtacgaccgccgcggacgtaccggccgtaggttacttacgtggtgcgagtaggtacgggctagttcgacacctaaacttcgtttacgaccacggtcgggaccacggggaaccctggtaaccaccgtctcctcaccgacctaccgaaccg

SEQ ID NO: 394477 - DNA, 580 bp, Homo sapiens
  misc_feature: GZ8MTXP02HW169.44.12.B01.1.454.CMB.2.raw
  modified_base (250)..(250): a, c, t, g, unknown or other
  modified_base (276)..(276): a, c, t, g, unknown or other
  modified_base (407)..(407): a, c, t, g, unknown or other
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgacctccaccccccctctgtgtcggagtctccggggaagacggtaaccatctcctgccacccgcagcactggcagcattgccagcaactttgngcagtggtaccagcaggcgcccgggnacgtcgccccccacactgtgactctatggaacggactaaccccgaaccgaccctcgtcggggtccctgtacttccggtctcgtcgcctccatcgacacgcctcctacctaacgtcctccgtcccttccccncaccctagtcctcgtcgggactaggaacgtacgtcggacggacgacggtctacgaccttactacgtgtacctagttcttagtacgagtagcagacaatcaagttgtggttagtcggacggtacggaccgagtcgcgaaccgtcgtacggtcacgccgaacggtcgtaccccgg

SEQ ID NO: 394478 - DNA, 583 bp, Homo sapiens
  misc_feature: GZ8MTXP02H680Z.44.12.B01.1.454.CMB.2.raw
  modified_base (319)..(319): a, c, t, g, unknown or other
  modified_base (327)..(327): a, c, t, g, unknown or other
  modified_base (405)..(405): a, c, t, g, unknown or other
  modified_base (465)..(465): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggtccaggactggtgaagccttcggagaccctgtcccctcacctgcactgtctcgtggtgctccatcagcagtagtagttactacgtggggctggactccgccaggccccgaggggaacggggctggaggtggagttgggagtatctattanaggtggancacctactaccaaccctcctacaacgagtcgacgtcacatatcgagtagacaccgtacaaagacctacgttcctccgngaacgctgagtctcgtgtaccgacccggccgcggaaccgacggtcgtacgttagtttacngggtagcgaggtagtggggctagttcgtacaacctaactcgtttagccgtaacggtcgggccgaacgggtaccctgggtccaccggttcctaccctcgaccgtaccctaccgaaccgg

SEQ ID NO: 394479 - DNA, 628 bp, Homo sapiens
  misc_feature: GZ8MTXP02JE6PZ.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccggatgggtcctgtcccagctgcagctgcaggagtcgggcccaggactggtgaagccttcggagaccctgtccctcacctgcactgtctctggtgctccatcagcagtagttagttactacgtggggctggactccgccacgccccgaggggagggctgggagtggtagttgggagtatcttagttagtaggtggacgcacctactaccaacccgtcctacgagacgtcgacgtccaaccgtatacttacgagtacgaaccacggtacccaaagtaaccctacgttccctccccgtagaaacgtccagacgtcttctcggtcggacccgccggacggaccacggtccgtagttacttacgtcgtaggcgaaggtagtagggctacggtttcgacctaactaacttacgttacgaccgaacggtcgggacccgacgggtaaccctcggtaccaacccggttcctccgtacctacgccccgtaaccgacccgtaaacggg

SEQ ID NO: 394480 - DNA, 744 bp, Homo sapiens
  misc_feature: GZ8MTXP02HZOBA.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggacgaccctgtcccctcacctgcactgtctcgtggtcgctccatcagcagtagtagttactacgtggggctggactccgccacgcccccgagggacggggctggagtggagttcggggatatactattagtagtgggacgctacctactaccaaccccgtcctacaacgagtccgagtacaccaattactctagtaacacgtaccgtaccgaacgaaacctacgtttccctacccgtaggaaacgtcgtagacgtccttcgtcggttaccggaccccggccgaaccgggaaccgtacccggggtaccgtttacggttaacgtttaccgttgggttaccggacggaagggacggggtttaacgggccggttaacggtttaccgtacccgtaaacccgttaaaacctttaccggtttttaaacgacccccgtaaacgggttaccgggggacccgtaaacccgggggtaaaccccgttcgggggtaacccctaaccccggtttccctacccgttacccgaaccggttcccccgttaaaccccgaaaacccccggg

SEQ ID NO: 394481 - DNA, 696 bp, Homo sapiens
  misc_feature: GZ8MTXP02JP44T.44.12.B01.1.454.CMB.2.raw
  modified_base (316)..(316): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggactccgccacgccccgagggaggctggagtggagtgggagtatctatagtgtggancacctactaccacccgtcctagaacgagtcgacgtacaccgatactcgaagtagaccacgtaccaaacgtaccacgttcctccctagaacgccgttagacgtccttcgtcggtaccgacccggcccggaccgggaaaccgtaccggggtacccgttaggttaaccgttacgttcggggtcggaccgtaagggtaacggggttacggggtcctaaccgggtttaccggaaccctaaacccgttaaaacgtttaccggttttaccggaaccccgttaccgggtcgggggacccgtaaaccgggggtaacccccttcggtaacccgtaaccccgttcccgtacccgtaccgttacccgacccccgttacccgaaacccccggg

SEQ ID NO: 394482 - DNA, 641 bp, Homo sapiens
  misc_feature: GZ8MTXP02ICYW5.44.12.B01.1.454.CMB.2.raw
  modified_base (174)..(174): a, c, t, g, unknown or other
  modified_base (253)..(253): a, c, t, g, unknown or other
  modified_base (277)..(277): a, c, t, g, unknown or other
  modified_base (297)..(297): a, c, t, g, unknown or other
  modified_base (344)..(344): a, c, t, g, unknown or other
  modified_base (412)..(412): a, c, t, g, unknown or other
  modified_base (418)..(418): a, c, t, g, unknown or other
  modified_base (425)..(425): a, c, t, g, unknown or other
tcagacagtatatacacgaccggtgctcgatttagtagtgtagattccgcggggggtagctcaggaagcagagcctggagcatctccactatggcctgggctccactacttctcaccctcctcgctcactgcacaggttcttgggcctaattttatgctgactccacccccctntgtgtcggagtcgtccggggaagacggtaaccatctcctgccacccgcagcacgtggcagcattgccagctaactttgngcagtggaccagcagccgcccggnacgtccgcccccacactgtnactctatggacggactaaccccgaacgacccctcgtacggggtcccngacttccggttctcgtccggacctccgactcggacacgtcctcccacctaactctccgccccctcccncaaccncgttccncgtcggactagaagaccgtaggacggaacgacggtctacgaaccttacctaacgttaggtcctaaggtttccttaaagtgtaaatacgacgacgtactaacgtacgtagttacggttacggttacgggtacgggacgggaaccgggaaccgtaacggtaccgtaccggtaaccgtaccgtacggtaccgaccgaacccgacccggtacccgtcccg

SEQ ID NO: 394483 - DNA, 633 bp, Homo sapiens
  misc_feature: GZ8MTXP02G4XRT.44.12.B01.1.454.CMB.2.raw
  modified_base (251)..(251): a, c, t, g, unknown or other
  modified_base (268)..(268): a, c, t, g, unknown or other
  modified_base (371)..(371): a, c, t, g, unknown or other
  modified_base (414)..(414): a, c, t, g, unknown or other
  modified_base (420)..(420): a, c, t, g, unknown or other
tcagacagtatatacacgaccggtgctcgatttagtagtgtagattccgcgggggcgtttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagtactcnggggctggactccgccngcccccgagggaaggggcgtggaggtggagtgggagtaagtctattatagtgggagcgacctacctaactacccgtcctacaacgtagcgacgtcacacttancagtagacaccgaccgagaaaccacgttactcccttgaaacgngtcggngtaccgtctcgttaacgcccgacccgccgggtaacccgcgggtacccggttcggttaattccgttagttggacgtagggacggttagggccgtagttaccgtactaccctaaacgtaacgtttctaacccggaacttcgggggacccgcgggtaaaccccgtccggtaagtcccccgtacgttcccttcccgaactcctacccccgtaaccgg

SEQ ID NO: 394484 - DNA, 675 bp, Homo sapiens
  misc_feature: GZ8MTXP02IJN6V.44.12.B01.1.454.CMB.2.raw
  modified_base (254)..(254): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcgggagaccctgtcccctcacctgcactgtctcgtggtgctcatcagcagtagtagttactagnggggctggactccgccacgccccgaggggacgggcgtaggagtggagttgggatatactaagtagtaggtggacgctaacctactaccaacccgtcctacaacgtacgtcgagtccaactataactcgaagtaacgaaccgtaccgtaaccaacgaaacctcgtttacctacccgtagaacgcgtgaacgtcttaccgtcgtaccggaccgccggtacgaacgtccggtacgttgttaacgttcgtaggttacggacgaaggtacgggttacggtacgtaacgtttaccgtaacgtaaacccttaaacgttacgtttaccggaaccgtacggtaccggggaccgtaaaaccggggtaacccttcgggtaaccgtacccggtacctcccgtacgacccggtacccctaaccgaaaccccggg

SEQ ID NO: 394485 - DNA, 674 bp, Homo sapiens
  misc_feature: GZ8MTXP02JYVFC.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagtagtagttactacgtgggctgactccgccacgccccgagggacgggctaggagtggagttgggatatctagttagtaggtagggagacctaccttacgtaaccgaaccccgtccctacgaaccgagtcgacgtaccacctatacgtcaagtacgaaccgaaccgtacccaaacgtaaaccctacgttaccctacccgttaagaacgtcgtagtacgtctacgtcggtcgaacccggcccggaccggaccggacccggtcgttagttacgttacgtggttacggacggaaggtacgggtacgggcttacggttaccgtaccaacccttaaacgttaccgtttacgaacccgtacgggtaccggggaccgaaccggggtaccccgttcggtaacccgtacccgttcctcccgttcgaacctcccgtacccgaacccgg

SEQ ID NO: 394486 - DNA, 628 bp, Homo sapiens
  misc_feature: GZ8MTXP02HKXR4.44.12.B01.1.454.CMB.2.raw
  modified_base (386)..(386): a, c, t, g, unknown or other
  modified_base (394)..(394): a, c, t, g, unknown or other
  modified_base (462)..(462): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggactccgccacgcccccgagggaagggctggagtggattgggagtatctattagagtggagcacctactacaacccgtcctacagacgtcgagtcaccatactcagtagacacgtaccaaagaaccncgttaccncccgtagaagtcctgagtctctgtcgaacccgccggacggaaccgtccgggcgttacgttattaccgngggttaggcgtaagggacggttaggggctacggttcgtaccaacccgtaacttaccgttttacggaaaccctaacgggttcgggggacccgaacgggggttaaccccctggggtaaccccaaccggttccctacccgtaccgaccggtccctacccggaaacccgg

SEQ ID NO: 394487 - DNA, 598 bp, Homo sapiens
  misc_feature: GZ8MTXP02F77G1.44.12.B01.1.454.CMB.2.raw
  modified_base (173)..(173): a, c, t, g, unknown or other
  modified_base (220)..(220): a, c, t, g, unknown or other
  modified_base (250)..(250): a, c, t, g, unknown or other
  modified_base (291)..(291): a, c, t, g, unknown or other
  modified_base (365)..(365): a, c, t, g, unknown or other
  modified_base (434)..(434): a, c, t, g, unknown or other
  modified_base (503)..(503): a, c, t, g, unknown or other
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactccaccccccctntgtgtcggagtctccggggaagacggtaaccatctcctgccacccgnagcactggcagcattgccagctaactttgngcagtgaccagcagcgcccgggcagtccgcccccacactgngatctatgagactaaccccaacgacccctcgtcggggtccctgtactcggttctcgtcggcctccgatccgacncgtcctccctaccaactctccgtcccctccctacaccctagttcctcgtacgggactaggaacgtacgngggaagggaccgtagccgtacgaacccttacgtacttcggtctaggtttaccttgacgatagcgtaaanactatgtaggttgtacggttcggtacgggacgggaacggacgacgtccgtacggtaacccgtacgtacgaccgaccggaccgtacggccctcccg

SEQ ID NO: 394488 - DNA, 585 bp, Homo sapiens
  misc_feature: GZ8MTXP02I4WV6.44.12.B01.1.454.CMB.2.raw
  modified_base (442)..(442): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccacgcccccgagggagggctggagtggagttgggatatctaattagtaggtggagcacctactaccacccgtcctacaagacgtcgagtcacctatactcagtacgacacgtaccaagaccagttacctcccgtagaacgtctagagctacgtgtacgacccgccgcggaaccncggccgtgtatacgtgtgacgtagaggtacgggctagttctacgacctaactcgtttacgacccgtacgtcggggacctaacgggggtaaccctgggtccctaaccggtcctacccgtaccgacggtccctaccgaaacccgg

SEQ ID NO: 394489 - DNA, 591 bp, Homo sapiens
  misc_feature: GZ8MTXP02GMJH7.44.12.B01.1.454.CMB.2.raw
  modified_base (206)..(206): a, c, t, g, unknown or other
  modified_base (314)..(314): a, c, t, g, unknown or other
  modified_base (328)..(328): a, c, t, g, unknown or other
  modified_base (369)..(369): a, c, t, g, unknown or other
  modified_base (374)..(374): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctnacctgcatgtctctggtgctccatcagctagtagttagtactacgtggggctggatccgccacggcccccgaagggaacggggctgggagtggaagttgggagtactntattatagtgggancactactaccaaccgtcctacaagagtcgagtcacattaangaganacacgtacaacaactacttcaccgtagaacgctagagtctcgtcgacggaccgccgacggaaccgaccgggtaccgtagttaacttacgtggtagacggaggtacggagggtcgtacggttccgtacaaacctaacgttacttacgaccgtacggtacggggaccgaacgggttaccgcggtaaccgtaccgtctccgaccgacgaccaccgaaccg

SEQ ID NO: 394490 - DNA, 715 bp, Homo sapiens
  misc_feature: GZ8MTXP02GQW6N.44.12.B01.1.454.CMB.2.raw
  modified_base (382)..(382): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggacgaccctgtcccctcacctgcactgtctcgtggtgctccatcagcagtagtagttactacgtggggctggactccgccacggccccgaagggacgggctgggagtggagttgggatatactattagtaggtggacgaccacctactaacccaacccgtcctacaacgacgtcgagtaccaccagttacncgaagtaacgaccaccgtaccaaacgtaacctacgtttccctacccgtagacgccgtagacgtctcgtgtacccgacccggccggacggaccgaccgggtccgttagttacgttaaccgtggtacggtacggaagggtaggtaccgggggtactacgggttacccgtaccgtaaaacccgttaacgtttaccgtttaccggaaaccccggttacggggaccgggggtaacccccgaaaccgggggtaaccccctttcggggtaaaccccgttcccccgggtacccttaccccgttccgacccgggtaccccctaaccccggtaaacccccggg

SEQ ID NO: 394491 - DNA, 710 bp, Homo sapiens
  misc_feature: GZ8MTXP02HXJ52.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcgctcccagatggtcctgtcccagctgcagctgcaggagtccgggcccaggactggtgaacgccttcggacgacccctgtcccctcacctgctactgtctcgtggtgcctccatcagcaagtagtagttactacgtggggctggactcccgaccacgacccccggaggggaacgggcgtggagtggagttcggggtatacgttactagttagtaggtggacactaaccctaacctacctaaccccccgtctacgaacgtacgtaccgacgtaccactatactcgagtacaccaccgtacaacgacctacgttcctacctagaacgtctagacgtctcgtgtcgcccgcgcgacgcggtccttagttacgttaccgtggacgacgaaggtacgggtacggaccttacggttacccgtaaccgtaaaccccgtttaaacgtttacccggtttaaccggaacccgttaccggggtaccccggggtaccgtaaacccgggggttaaccccttacgggtaaccccgttaaccccgggttcccttaccccgtaccgaaccccggtacccccgttaacccgaaaaccccccggg

SEQ ID NO: 394492 - DNA, 704 bp, Homo sapiens
  misc_feature: GZ8MTXP02FJ461.44.12.B01.1.454.CMB.2.raw
  modified_base (325)..(325): a, c, t, g, unknown or other
  modified_base (510)..(510): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaacgccttcggacaccctgtcccctcacctgcactgtctctggtgctccatcagcagtagtagtactacgtggggctggactccgccacggcccccgagggacgggcgtggagtggagttgggagtatctatagtaggtaggngacctacctactaccgacccgtccctacgaacgacgtcgaacgtccaactatatccaaagtacgacctacgtaaccaaacgaaccctacgtttccctacccgtagaaacgcctagaacgtctccgtgtacccggcccgccggaccggaccgtaaccggtccggtagttacgttaacgtgggttcnccggaaggtaggtacggggtctaggttccgtacctaaacccgtaaaccgttacgttttacccggaaacctacgggtaccgggggtaaaccccggtaaccgggggttaacccccgtttacgggtaacccgtaccccggtttaccctaccccgttcccgaaaccggtccccccgtttaacccgaaaacccccgggg

SEQ ID NO: 394493 - DNA, 540 bp, Homo sapiens
  misc_feature: GZ8MTXP02GGS1T.44.12.B01.1.454.CMB.2.raw
  modified_base (302)..(302): a, c, t, g, unknown or other
  modified_base (499)..(499): a, c, t, g, unknown or other
  modified_base (523)..(523): a, c, t, g, unknown or other
  modified_base (526)..(540): a, c, t, g, unknown or other
tcagacagtatatacacgaccggtgctcgatttagtagtgtagatttgagtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatccggccctcagggggtccctgacccgattctctggctccaagtctggcacctcagccctcctggccatcacgtgggcctccaggctagaagatggagggtntatttatactgcctagtcctatgacagcacgccttacagggttgggttaggggtcggtttcggggccggggaacggggaccaaggtccgtacggtacccgttcggtcgggggtaccacggccccgtaaagggcccttccggcccccgtcggtccacgttcctccgttccccgccctcccttctactactactgtcgngacgggcggctggcgaaggccganagnnnnnnnnnnnnnnn

SEQ ID NO: 394494 - DNA, 737 bp, Homo sapiens
  misc_feature: GZ8MTXP02GR3H2.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctcgtggtggctccatcagcagtagtagttactacgtggggctggactcccgccgacgcccccgagggaacggggcgtggaggtaggtagttcggggagtattactagtttagtaggtagggacgaccaaccgtactaaccaaccccgtccccgttacaacgtagtaccgtataccgaacctatactcgagtaaacgaccaaccgttaccaaacgtaaaccgtacgtttaccctaccccttagaaacgtctacggacgtaccttcgtgttaccggaaccccgccgaaccggaaccgaccggtcccgtagtttacgtaccgtgggttacggaccgtaagggtacgggttaacgggggccttagggttttaccgtaccgaacctttaaaaccgtttcgtttaacgaaacccggcggttaacgggggacccctaaacgggggtaaacccccggtttgggtaacccgtaaaccccggttttcccgtccgttaccggacccgttaccccgtacccgaaaccccgg

SEQ ID NO: 394495 - DNA, 604 bp, Homo sapiens
  misc_feature: GZ8MTXP02FG4IZ.44.12.B01.1.454.CMB.2.raw
  modified_base (319)..(319): a, c, t, g, unknown or other
  modified_base (341)..(341): a, c, t, g, unknown or other
  modified_base (403)..(403): a, c, t, g, unknown or other
tcagacagtatatacacgaccggtgctcgatttagtagtgtagattccgcgggggctttctgagagtcattgacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccacgcccccgagggagggctggagtggattgggagtatctattagtagtggancactactaccaaccgtccctanaacgagtcgagtcaaccatatcagtagacacgtaccaaagaaccagttacctccctagaacnctggatctcgtgtacgaccgcccgacgaccgaccggccgtagttacttacgtggtagcgagagtaggggctaaggttccgtacaaccctaaacgttaccttttcggaaccctacggttacgggggaccctaacgggggaaccccttcggggtaaccctacccggttcctacccgtccacgtaccccgtacccgaaacccgg

SEQ ID NO: 394496 - DNA, 717 bp, Homo sapiens
  misc_feature: GZ8MTXP02JC02D.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtccgggcccagggactgggtgaacgtcccttcgggacgtaccccttggtccccctcacccttggcctacttggtcctcgtggtcgccttccatcaggcagtagtacgttactacgtggggactggactccgccaggcccccaggggaacggggctgggagtggagtgggagtatctatagtagtggagcacctactacacccgtacctcaacgagtcagtccactactactccgagtacgaaccaaccgtaccaaaacggtaacctaacgtttccctacccgttaagaaacgtcctagtaacggtcttcgttacggtccggaaccccgacgggcccggttaaaccggaaccgggtacccggtttgttaacgtttacccgtaggggtttcccggaacgggtaggtaacggtacgggggtaactcggttaccgtacctaacgtaaacccttcggtttaggacccttacggtaccgggggccttaaccgggaccgtacggggtaaccctcccggttccttacccgccgtaccggtaccctacccgtaaaccccggg

SEQ ID NO: 394497 - DNA, 627 bp, Homo sapiens
  misc_feature: GZ8MTXP02FMYT3.44.12.B01.1.454.CMB.2.raw
  modified_base (306)..(306): a, c, t, g, unknown or other
  modified_base (318)..(318): a, c, t, g, unknown or other
  modified_base (408)..(408): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaagccgttcggagaccctgtcccctcacctgcactcgtccctggtgctcatcagcagtagtagttactacgtgggctggatcccgcgacgccccgagggaggggctggagtggattgggatatntattagagtggnacacctactaccacccgtcctacagacgtcgagtacacatactacacgtagacacgtaccaaacgtaacctagttccttcccgagaaacncgtgacgtctcgcgtacggaccccgtcgaccggaacgccggtaccgtagttaacttcgagggttgacggacgtaaggttaacgggccttaaacgggttcctacctaaaccgtaaactacgtttacgaacccgtacggtacccggggacgtaaccggggtaaccctcggtacccgaacccgtctccctacgaccgtacccgtccaaacccgtaacccggg

SEQ ID NO: 394498 - DNA, 636 bp, Homo sapiens
  misc_feature: GZ8MTXP02ISZSI.44.12.B01.1.454.CMB.2.raw
  modified_base (435)..(435): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcgctcccagatgggtcctgtcccagctgcagctgcaggagtcgggcccagggactgggtgaacgtccctttcgggacgacccttgtcccctcacctgcacttgtctctggtcgcctccatcagctagtagtagttactacgtggggctggactccgccacgcccccgagggagggctggagtggatggggagtatctattagtaggtgggacgtcaccttacctaccaaccccgtcctacaacgtacgtcgacgtaccactacttactcgtaagtaacgaccaccgtacccaagaacctacgttcctacccngaagctagacgtctcgtgtcaccgccgcggacacggtcctagtactttacgtgtcgacggacgtagggtacgggtctaaggttccgtactaaccgttaaacttacgtttacggacctaaccggttcgggggaccgaccgggtaacccgttggtaacccgtcccgttccggtacccttcgaccgtccccttacaaccccggg

SEQ ID NO: 394499 - DNA, 583 bp, Homo sapiens
  misc_feature: GZ8MTXP02HQBEL.44.12.B01.1.454.CMB.2.raw
  modified_base (219)..(219): a, c, t, g, unknown or other
  modified_base (314)..(314): a, c, t, g, unknown or other
  modified_base (565)..(565): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctccagatgggtcctgtcccagctgcagctgcagggagtcgggcccaggactggtgaagccttggagaccctgtccctcacctgcactgtctntggtgctccatcagcagtagtagttactacgtggggctggactccgccacgcccccaggggaagggctggagtggattggggagtatctaattanaggtaggagcacctaactaaccaaaccccggtccctacaaagagtacgagtacaaccaatatcaagtagacaccgtaccaaagaaacctacgttactcccagaaagctggaagtctacttgcgaacccgccgacggaccacgggccgttagttattacctgggtgacggagaggtaggctagttcgtacaacctaactactttgaacctagcggggaccacgggaaccctggtaacgaccgtcctcctacncgtacccaccgaaacccg

SEQ ID NO: 394500 - DNA, 785 bp, Homo sapiens
  misc_feature: GZ8MTXP02FLVGK.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtccgggcccaggactgggtgaacgccttcgggacgaccccttgtcccctcacctgccactgtctcgtggtgctcatcagcagtagtagtactacgtgggctggctcccgccacggcccccgaggggacgggctggacgtggagttggggagtattctagttagtaggtggacgcctaaccttaccgtaaccaaccccgtcccgtacgaacgtacgtacgacgtaccaaccgattacgcgtaagtaacgaccgtaacccgtaaccaaacgtaaaccccgttcgtttacccgtcccgttaacggaaacgtccgttaggaaccgttccgtccgttaaccgggtaccggaacccccggcccggaccgtaccccgaaacccggtaccgggccccggtttagttaacgtttaacccgtgggttacccggaaccgggttaagggtaaccggggttaagggtacccggtaaggtttccccggtaaccctaaaacccggttacccttttaacggttacccgaaccgtttaacccggggaccggggtaccccgaaaccggggttaaacccgttcggtacccctaaccccgttccgtaaccccgtccgtaaacccgtcccgtaaacccccgg

SEQ ID NO: 394501 - DNA, 677 bp, Homo sapiens
  misc_feature: GZ8MTXP02JMZN1.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtcccctcacttgcactgtctctggtgctcatcagcagtagtacgttactacgtggggctggactccgccacgcccccgagggaagggctggagtggagttgggagttatctagttagtaggtggtacgactaccttacgtaacctaaccccgtacctacaaacgacgtcgacgttcaacatatcgagtacgtaacaccgtaccaaacgaaacctacggtttacccacccgttagaacgtcttagaacgtccgttctcgggttacgaaccccgggccggaccggtaaccgaaccggggtcctaggtttacttaacgtcgggtacgtacgagggtaacggtagggtcgtagtttacccggactaaccctaaacgttaccgtttacggacccgtacggttacgggacccgtaacgggtaacccgtcgggtaacccgtacccggtccttccgacgtacccgtacccgttacgaaacccgg

SEQ ID NO: 394502 - DNA, 662 bp, Homo sapiens
  misc_feature: GZ8MTXP02FQ11G.44.12.B01.1.454.CMB.2.raw
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactggtgaacgccttcggagaccctgtcccctcacctgcactgtctcgtggtgctccatcagcagtagtagtactacgtggggctggactccgccacgcccccgagggaacgggcgtggaggtggagttgggagtatacttaagttagtaggtggacgcgaaccttaccgtaacctaaccccgtcctacgaacgtacgtacgacgtccaaccaattactcgaagtacgactaccgtacctaaacgaaccctacgttaccctcccgtagaacgtcttacgagtcctcgtcgtacggaccgccggcgaacgccggccgttagtacttacgtcggtacgcgaaggacggtaggggctaacggttccggtaccaacccgtaacttaccggtttacgaacccggtaccggtacggggacccgtaaccgggaaccccgttgtaacccgtaaccgttccctcccgtacgaccgcccgtacccgtaaaccccggg

SEQ ID NO: 394503 - DNA, 671 bp, Homo sapiens
  misc_feature: GZ8MTXP02FVXAV.44.12.B01.1.454.CMB.2.raw
  modified_base (379)..(379): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtccgggccaggactggtgaacgtccgttcgggacgaccctgtcccctcacctgcactgtcctcgtggtcgctccatcagctaagtagtagttactacgtggggctggactccgccacggccccgagggacgggcgtggagtggtatggggatatctattagtaggtggacacaccttacaccacccgtacctcaagcgtcgatcacatatcaganacacgtaccaaacgacctacgttcctaccgtagaaacgcgtgtaacgcttcgtacggtcggacccgtaccgggaccgggaaccgtaccgggccgttagttaccttacgtttagggagaccgggaggtaacgggtaacggggtcgtaaacggttccgtaaccgtaaccgtaaaccgtttaacgtttccgaaacccgtacgggtacggggacccggtaaacggggtaaccccgttcgggtaaccgtaaccccggtccttccccggtaccaccggtacccttacccgaaacccgg

SEQ ID NO: 394504 - DNA, 617 bp, Homo sapiens
  misc_feature: GZ8MTXP02GP22M.44.12.B01.1.454.CMB.2.raw
  modified_base (256)..(256): a, c, t, g, unknown or other
  modified_base (385)..(385): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagacccctgtcccctcacctgcactgtctctggtgctccatcagcagtagtacgttactacgnggggctggactccgccacgccccgagggacggggctggagtggacgttgggtagtatctaattagtaggtggacgacaaccttaacacctaaacccgtcctacaaacgacgtacgagtacaccattaanctagactaacacgtaaccgaaacgtaaccagttacctacccgtagaaacgtctagacggtctccttcggacggaaccccgccggtaccgggacgaccggtcgttacggttatacgttgagaccgaagaggtacggggtactaggtttccactacccaaaacgttacgttacacccggtaaagtcgggaccgaacggtaacctggaacctacgcttaccgcactccacaaccg

SEQ ID NO: 394505 - DNA, 660 bp, Homo sapiens
  misc_feature: GZ8MTXP02GCILU.44.12.B01.1.454.CMB.2.raw
  modified_base (293)..(293): a, c, t, g, unknown or other
  modified_base (322)..(322): a, c, t, g, unknown or other
  modified_base (347)..(347): a, c, t, g, unknown or other
  modified_base (352)..(352): a, c, t, g, unknown or other
  modified_base (375)..(375): a, c, t, g, unknown or other
  modified_base (394)..(394): a, c, t, g, unknown or other
tcagacagtatatacacgaccggtgctcgatttagtagtgtagattccgcgggggctttctgagagtcatggacctcctgtgcaagaacatgaagcacctgtggttcttcctcctgctggtggcgctcccagatgggtcctgtcccagctgcagctgcaggagtcgggcccaggactgggtagaagcccttagggacgaccccttgtcccctacacccgtggcctacgttggtaccttcgtgggttggccttacattcaaggctaggttagtagttactacggtggctggacnccgcgacgccccgaaggagggctaggagnggtatgggatagtcttaagtagtgnggacnctaccgtatacgaccctacgtanacgacgtcagtccacattnacgagtacgacgacctacgaaactacctagttcctaccgtagaacgtcttaaggacgtcgtacgtaggccgtacccggaccgaccggtaaaccgaccggtccgttaggttacttaaccggtggtaccgtacggagggacggtaaggggtactagggtttaccacgtaaacccgtactttacccgttagacccccggtagtcgggacccgtacggttaaccgcggccgttacccgacttccgacgtacctcccgtaccgaaacccgg

SEQ ID NO: 394506 - DNA, 604 bp, Homo sapiens
  misc_feature: GZ8MTXP02GR4E3.44.12.B01.1.454.CMB.2.raw
  modified_base (204)..(204): a, c, t, g, unknown or other
  modified_base (236)..(236): a, c, t, g, unknown or other
  modified_base (261)..(261): a, c, t, g, unknown or other
  modified_base (276)..(276): a, c, t, g, unknown or other
  modified_base (280)..(280): a, c, t, g, unknown or other
  modified_base (288)..(288): a, c, t, g, unknown or other
  modified_base (347)..(347): a, c, t, g, unknown or other
  modified_base (373)..(373): a, c, t, g, unknown or other
  modified_base (407)..(407): a, c, t, g, unknown or other
tcagacagtatatacacgaccggtgctcgatttagtagtgtagattccggggggaggaactgctcagttaggacccagagggaaccatggaagccccagctcagcttctcttcctcctgctactctggctcccagtttcagattccagcggcgaaactgtgttgacacagtcctccagccacctgtctttgcgtccggggaacncgccacctctacctgcagggccgcagactgtnacacgtatagcctagtaccagagancgtagcaggctccanctcncatctatnatctatagtcggctctagactactccgacgcccgtatcaggtggacctggtccggtacngggacagtaccttgactcgactaccntaccaccgtgtaccaggtacacctagaaagtttnttacgacgttagttacttactacgtacgtaacgtacgtaacgtccgttaacgtactacgtaactcgtacctaccgtccgtaccgtaggaaccgtagtacgtaataacgtaactaaacgtcgtacggtacgtaccgtacgtaccgtaactactaaccgttcgtaccttaccgtaccgtacccgttaccctaacttccg

SEQ ID NO: 394507 - DNA, 421 bp, Homo sapiens
  misc_feature: GZ8MTXP01EO2MN.17.25.C03.1.454.CMB.2.raw
  modified_base (417)..(421): a, c, t, g, unknown or other
tcagcgtagactagcacgaccggtgctcgatttagtagtgtagatttgggtttgggagggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaactgaggattgtgcaatctactactgtcaacagagttacagttcccctcgcacttttggccagggggaccaaaagttgagatcaaacgaactgtggctgccaccatctgtcttcatcttcccgccatctgactagtctacgctgagcgggctggccaaggcgcatagnnnnn

SEQ ID NO: 394508 - DNA, 505 bp, Homo sapiens
  misc_feature: GZ8MTXP01CCOM9.17.25.C03.1.454.CMB.2.raw
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacgttaaaacctatttaaatggtatcagcagaaacctggaaaacgccccagacctcctgatctctggtgcatccatctgcgaagtggcgtccatcgaggttccagtgcagtggaatctgggacagatttcaatctcacatcaccactctgcaacctgaggatgtgacaatctacgtactgtacaacagtagttacacgttcccctcgtctacgttttggccgtaaggggaccaaaggttgagatacaaacgacttgtggctgcaccatcttgttcc

SEQ ID NO: 394509 - DNA, 536 bp, Homo sapiens
  misc_feature: GZ8MTXP01EIGOV.17.25.C03.1.454.CMB.2.raw
  modified_base (299)..(299): a, c, t, g, unknown or other
  modified_base (430)..(430): a, c, t, g, unknown or other
  modified_base (521)..(521): a, c, t, g, unknown or other
  modified_base (530)..(530): a, c, t, g, unknown or other
tcagcgtagactagcacgaccggtgctcgatttagtagtgtagatttgggtttgggcgagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcactgccgacaagtcacgtacttaaactattaaatggtatcagacaagaaacctaggaaaacgccccagacctcctgatctcgtgtncatccactgtcgacgaaggtcggccgtcccagtcggtaaggttcaggtggactaggttgggattcggtaggggaactagtaatttcaattctaccaccactccaccactctgaccaacctgaggtattgtnactaatctactactgtacaacagtacttacaccgttccctcgtctacgtttcggaacgtagggactaaagttgagtattacgaaacagtgngctgcactnttcgtc

SEQ ID NO: 394510 - DNA, 525 bp, Homo sapiens
  misc_feature: GZ8MTXP01D1HSL.17.25.C03.1.454.CMB.2.raw
  modified_base (222)..(222): a, c, t, g, unknown or other
  modified_base (298)..(298): a, c, t, g, unknown or other
  modified_base (400)..(400): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccgganaagtcacggacttaaaacctatttaaatggtatcagcagaaactggaaaacgcccaagacctcctgatctctggtncatccactctgcgaagtcggcgtcccatcgagttccagtggcagtgaatcgtgggacagtatttcaatctacaccatcaccactctgacaactgaggattgnactaatctacgtactgtacaacagtattactacgttcccctcgtctacgtttcggccgtaaggggaaccaaaggttgaagaataacaaaacggttacttaggtggctgcaccttatcgttgttcc

SEQ ID NO: 394511 - DNA, 539 bp, Homo sapiens
  misc_feature: GZ8MTXP01EHBN5.17.25.C03.1.454.CMB.2.raw
  modified_base (303)..(303): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctggaaaacgccccagacctcctgatctctggtncatccatctgcgaagtggctcccatcgagttccagtggcagtgaatctgggacagtatttcaatctcaccatcaccactccgacaacctgaggtattgtgacaatctactactgtacaaacagtagttaccacgttcccctacgtctacgttttcggacccgaagggggtaacctaaaggttgaacgttagtaacaaacgaacgttggttcgctgccactattcttcgttcttaac

SEQ ID NO: 394512 - DNA, 512 bp, Homo sapiens
  misc_feature: GZ8MTXP01CAO6X.17.25.C03.1.454.CMB.2.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggcttaaaacctatttaaatggtatcagcagaaacctggaaaagccccagacctcctgatctctggtgcatccactctgcgaagtggcgtcccatcgagttccagtggcagtggaatctgggacagatttcaatctcaccatcaccactctgcaaacctgaggattgtgcaaatctactactgtacaactagagttacagttcccctcgtctactttcggcctaagggggaccttaaaggttgagtatcaaacggttaacttgtggctggcaccatccttgtttcc

SEQ ID NO: 394513 - DNA, 582 bp, Homo sapiens
  misc_feature: GZ8MTXP01DXU5P.17.25.C03.1.454.CMB.2.raw
  modified_base (223)..(223): a, c, t, g, unknown or other
  modified_base (303)..(303): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganaagtcacggacgttaaaacctatttaaaattggtatcagcagaaacctggaaaagccccaagacctcctgatctctggtncactccactctgcgaagtggctcccatcgagttccagtggcagtggaatcgtgggacagtatttcaatctcacatcaccactctgacaaacctgaaggtattgtagctaaatccttaacgttaacttgtaaccaacgtagtacgttactacgtttacccctcgtcttacgttttcggcccgaagggggtaaccttaaaggttgaaacggtaacttaaccgaaaaacggttacgttaggttcgggacttcggacctacccttattccttaaggttttccc

SEQ ID NO: 394514 - DNA, 501 bp, Homo sapiens
  misc_feature: GZ8MTXP01A1G76.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggcgttaaaacctatttaaatggtatcagcagaaacctggaaaagccccagacctcctgatctctggtgcatccactctgcgaagtggcgtcccatcgaggttccagtgcagtggaatctgggacagatttcaatctcaccatcaccactctgacaacctgaggattgtgcatctactactgtacaacagtagttacacgttcccctgtcctactttcggccgaaggggaccaaaggttgagatcaaacgcttgtggctgcacatcttgttcc

SEQ ID NO: 394515 - DNA, 539 bp, Homo sapiens
  misc_feature: GZ8MTXP01EC4O6.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacgttaaaacctatttaaatggtatcagcagaaacctggaaaagccccaagacctcctgatctctggtgcatccactctgcgaagtggcgtcccatcgagttccagtgcagtggaatctgggacagtatttcaatctcaccatcaccactctgcaacctgaggattgtgactaatctactactgtacaacagagttacacgttcccctcgtcctacgttttcggccgtaagggggtaaccaaaggtttcgaagtaacttaacaaaacggttacttaggtcgggtctcggccaccttattccttgtttcc

SEQ ID NO: 394516 - DNA, 416 bp, Homo sapiens
  misc_feature: GZ8MTXP01DQTY3.17.25.C03.1.454.CMB.2.raw
  modified_base (412)..(416): a, c, t, g, unknown or other
tcagcgtagactagcacgaccggtgctcgatttagtagtgtagatttgggtttgggagggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccatctgcaacctgaggattgtgcaatctactactgtcaacagagttacacgttcccctcgcacttttggccagggggaccaaagttgagatacaaacgactgtgctgccaccatctgtcttcatctcccgcatctgactagtctacgctgagcggctggcaaggcgcatagnnnnn

SEQ ID NO: 394517 - DNA, 521 bp, Homo sapiens
  misc_feature: GZ8MTXP01CVUNM.17.25.C03.1.454.CMB.2.raw
  modified_base (361)..(361): a, c, t, g, unknown or other
  modified_base (417)..(417): a, c, t, g, unknown or other
  modified_base (442)..(442): a, c, t, g, unknown or other
  modified_base (449)..(449): a, c, t, g, unknown or other
  modified_base (466)..(466): a, c, t, g, unknown or other
tcagcgtagactagcacgaccggtgctcgatttagtagtgtagatttgggtttgggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcaaccctaacactggtgtcacagtcgtcttcacccatccctccgggacngacttaccatgaccacgaactcctccaataaacacagcctaacatggattgaggancctgacatctgacgacacggccgtntattacngtgcgagcgtcccaagntccggttgagccttacgggcaggccggtctttgcttcgcggggccaaggggtccg

SEQ ID NO: 394518 - DNA, 600 bp, Homo sapiens
  misc_feature: GZ8MTXP01BK61K.17.25.C03.1.454.CMB.2.raw
  modified_base (222)..(222): a, c, t, g, unknown or other
  modified_base (299)..(299): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcacatcacttgccganagtcacggtacttaaactatttaaatggtatcagcaagaaacctggaaaacgccccagaccctctgatctctggtcncactcccacttctggaccgaagtcggccgttcccagtcggagttccaggtggcaggtggaatcgtggggactagtatttcaatctacaccatccaccactctacgactaaccgtgaggtattgacgactaattccttactacttagtaccaaacgtagttaacgttacctaccggtttcccctcggtccttacgttttccgggaccggtaaacgggggtaaacccttaaagggtttcgaaggtaaacctacgaaaacccgttagttcggtaacggctcgaccaccttattcgttcgtttcc

SEQ ID NO: 394519 - DNA, 554 bp, Homo sapiens
  misc_feature: GZ8MTXP01BNTEF.17.25.C03.1.454.CMB.2.raw
  modified_base (222)..(222): a, c, t, g, unknown or other
  modified_base (277)..(277): a, c, t, g, unknown or other
  modified_base (301)..(301): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccgganaagtcacggacgttaaaacctatttaaatggtatcagcaagaaacctggaaaacncccaagacctcctgatctctggtncatccactctgcgaagtggctcccatcgagttccagtggcaggtgaatcgtgggacagtatttcaatctacacatcaccactctgactaaaccgtgaggtattgtgactaaattctaactactgtacaaactagtaagttaccacgtttcccctcgtccttacgttttcgggacccgtaagggggtaacccttaaaggttgaagtaacttacgaaaacgttacttggtggctcgacaccttattcttcgttcc

SEQ ID NO: 394520 - DNA, 543 bp, Homo sapiens
  misc_feature: GZ8MTXP01B92YT.17.25.C03.1.454.CMB.2.raw
  modified_base (251)..(251): a, c, t, g, unknown or other
  modified_base (271)..(271): a, c, t, g, unknown or other
  modified_base (322)..(322): a, c, t, g, unknown or other
  modified_base (362)..(362): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattcacgtttaccncctatagtatcaactgggtncgccaggccgctggacaacgacctgagtggatgggatgggacaaccctaanactggtgtcacagtcgtcttcacccatccctaccgggacngaccttacccatcgaccacgaactcctaccaataaaccacagcctacatggattgagagcctgacagtctgaccgacgacggcctctattacctgtgcgtagcgtcccagttagtcccgggttgaacggccttaacgggcacggcgtccgttgaccttggttcgggggccttaaggggccg

SEQ ID NO: 394521 - DNA, 522 bp, Homo sapiens
  misc_feature: GZ8MTXP01EROA7.17.25.C03.1.454.CMB.2.raw
  modified_base (301)..(301): a, c, t, g, unknown or other
  modified_base (403)..(403): a, c, t, g, unknown or other
  modified_base (439)..(439): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaacgccccagacctcctgatctctggtncatccactctgcgaagtggcgtcccatcgagttccagtgcagtgaatcgtgggacagatttcaatctcaccatcaccacgtctgacaaacctgaggtattgnacaatcctaactactgtacaacgtagacgttaaccncgtttacccctcgtctacgtttcggcccgaaggggtaaccaaagttgaacgatacaaaacgattgtgctgcacatcgttgttc

SEQ ID NO: 394522 - DNA, 577 bp, Homo sapiens
  misc_feature: GZ8MTXP01EF0AV.17.25.C03.1.454.CMB.2.raw
  modified_base (223)..(223): a, c, t, g, unknown or other
  modified_base (303)..(303): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganaagtcacggacgttaaaacctatttaaatggtatcagcaagaaacctggaaaacgccccaagacctcctgatctctggtncactccactctgcgaagtcggctccatcgagttccagtggcagtggaatcgtgggacagtatttcaatctacacatcaccactctgactaaaccgtgaggtattgacgactaaattctaacgttacttgtacaaacgagtaacgttacctacgtttcccctcgtcttaccgtttcgggacccgtaagggggtaacccttaaaggttcgaaagtaacgttaaccaaaacgttacttggtaacggctcggcctaacccttattcccgttgtttccc

SEQ ID NO: 394523 - DNA, 558 bp, Homo sapiens
  misc_feature: GZ8MTXP01BL8NV.17.25.C03.1.454.CMB.2.raw
  modified_base (398)..(398): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggtcgttaaaacctatttaaatggtatcagcagaaacctggaaaagccccagacctcctgatctctggtgcatccatctgcgaagtgcgtcccatcgagttccagtggcagtggaatctgggactagatttcaatctcaccatcaccactcgtgcaacctgagtattgtanactaatactaacgtactagtacaaacgtagtacgttaccgtaccgttcccctcgtccttacgtttacggaccgtaacgggtaacgttaaaggtacgaacgtaactaacgaaacgttacgttcggtaacgtcgtaacgactacttacgttccgttcgttcc

SEQ ID NO: 394524 - DNA, 538 bp, Homo sapiens
  misc_feature: GZ8MTXP01DWDNP.17.25.C03.1.454.CMB.2.raw
  modified_base (299)..(299): a, c, t, g, unknown or other
  modified_base (401)..(401): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacttaaaacctatttaaattggtatcagcagaaacctggaaaacgccccaagacctcctgatctctggtncatccactctgcgaagtggcgtcccatcgaggttccagtggcagtggaatcgtgggacagtatttcaatctcacatcaccactccgcaacctgaggattgtnacaatctactactgtacaaacagtagttaccacgttcccctacgtctacgttttcggccgtaggggaacctaaaggttgaagttataccgaaacgttaacgttggttacggctcgcctaccattcttcgttctttcc

SEQ ID NO: 394525 - DNA, 554 bp, Homo sapiens
  misc_feature: GZ8MTXP01CSPHS.17.25.C03.1.454.CMB.2.raw
  modified_base (273)..(273): a, c, t, g, unknown or other
  modified_base (439)..(439): a, c, t, g, unknown or other
  modified_base (447)..(447): a, c, t, g, unknown or other
  modified_base (497)..(497): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtncgccaggccgctggacaacgcctgagtggatgggatggggaccgaacccctaagcgttggtgtcactagtcgtccttcacccactcccgtaccgggacaacggtaccttaccgatcgacccacgaactccctaccaataaaccacagcctacagtggagttgaggngcctgacntctgaccgacgacggccgtctattacgtgtgcgagcgtcccagctccggngacgccgttacggcacggtccggtcttcggaccttcggttcgggccgttggggcccg

SEQ ID NO: 394526 - DNA, 582 bp, Homo sapiens
  misc_feature: GZ8MTXP01APHDH.17.25.C03.1.454.CMB.2.raw
  modified_base (210)..(210): a, c, t, g, unknown or other
  modified_base (325)..(325): a, c, t, g, unknown or other
  modified_base (414)..(414): a, c, t, g, unknown or other
  modified_base (485)..(485): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgagtctctgcaggcttctggtattcacgtttacctctatagtatcaacgtgggtgcgccgaggccgcgtggaacaacgacctggagtggatgggatcgggaccaaccctaancgtggtctcacgtagtcgtcttcacccactcccgtaccgggactgaccttacatcgaccacgactccacaataaaccacacgacctaanacgtaggagttcggaagcgtctagactacgtcgtacggaccgacgaccggtccgttacttaacgttaccgngtcgacgacgtcccgtaacccacggttacgtccggagaccgccgttacggcacggtcccgttacgttcgtacgtcgggttcgggccgaagggtcccg

SEQ ID NO: 394527 - DNA, 552 bp, Homo sapiens
  misc_feature: GZ8MTXP01BCLFC.17.25.C03.1.454.CMB.2.raw
  modified_base (271)..(271): a, c, t, g, unknown or other
  modified_base (365)..(365): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggtattcacgtttacctctatagtatcaatgggtncgccaggccgctggacaacgcctgagtggatgggatgggaccaaccctaagacgtggtgtcacagtcgtccttcacccatcccgtaccgggacngacttaccatcgacccacgaactccctacaataaaccacacgacctacagtggagttgaggacgctagaccagtctgaccgacgcggccgttctattaccgtgtcgacgagtcgtaacccagacgtccgggttgacgccgttacggcacggccggtctttgaccgttcggcggggccaaggggtccg

SEQ ID NO: 394528 - DNA, 546 bp, Homo sapiens
  misc_feature: GZ8MTXP01AX7IW.17.25.C03.1.454.CMB.2.raw
  modified_base (253)..(253): a, c, t, g, unknown or other
  modified_base (272)..(272): a, c, t, g, unknown or other
  modified_base (323)..(323): a, c, t, g, unknown or other
  modified_base (330)..(330): a, c, t, g, unknown or other
  modified_base (363)..(363): a, c, t, g, unknown or other
  modified_base (395)..(395): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccnctatagtatcaactgggtncgccaggccgctggacaacgacctgagtggatgggatgggacaaccctaanactggtntcacagtcgtcttcacccatccctaccgggacngacttaccatcgaccacgactccacataaacncagcctacatggagttgaggagcctagaccagtctaggacacgacggcctactattactgtgcgacgcgtcccagactcccgggttgaacggcccttacgggcacggtccggtcctttcggacgtttcggcgggggcccttggggaacccg

SEQ ID NO: 394529 - DNA, 579 bp, Homo sapiens
  misc_feature: GZ8MTXP01ADY8L.17.25.C03.1.454.CMB.2.raw
  modified_base (223)..(223): a, c, t, g, unknown or other
  modified_base (302)..(302): a, c, t, g, unknown or other
  modified_base (312)..(312): a, c, t, g, unknown or other
  modified_base (373)..(373): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganaagtcacggacttaaaacctatttaaatggtatcagcaagaaacctaggaaacgccccagaccctcctgatctctggtncatccactcngcgaagtgccgtccatcgaggttccaggtggcagtggaatcgtgggacagtatttcaatcncacatccaccactctgactaaccgtgaggtattgacgactaattccttaacgttactggttaaccaaactaggtaacgttacctaccgtttccccctacgtccttaacgttttcgggacccgtaagggggtaacccttaaaggttcggaaagtactaacgaaacgttacttggtaacgctcgaccaccttattcgttcgtttaacc

SEQ ID NO: 394530 - DNA, 555 bp, Homo sapiens
  misc_feature: GZ8MTXP01AIUMI.17.25.C03.1.454.CMB.2.raw
  modified_base (273)..(273): a, c, t, g, unknown or other
  modified_base (368)..(368): a, c, t, g, unknown or other
  modified_base (436)..(436): a, c, t, g, unknown or other
  modified_base (451)..(451): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatggggatggggacgaaccctaacgactggtgtcacagtcgtcttcacccatcccgtaccgggacngacttaccatcgaccacgactcctaccaataaacacagcctacatggagttgaggagcctagacatcngacgacacggccctntattactgtgcgagacgtcccaagactcccgggttgacgtcccgttacgggccagggccggtccctttggaccttcggttcgggggcccgttaaggggaacccg

SEQ ID NO: 394531 - DNA, 554 bp, Homo sapiens
  misc_feature: GZ8MTXP01DLHOS.17.25.C03.1.454.CMB.2.raw
  modified_base (274)..(274): a, c, t, g, unknown or other
  modified_base (298)..(298): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatcctccctgtctgcctctgtggggtcagagtcaccatcacttgccggacaagtcacggacttaaaacctatttaaatggtatcagcagaaacctggaaacnccccagacctcctgatctctggtncatccactctgcgaagtcggcgtccatcgagttccagtggcagtggaatcgtgggacagtatttcaatctcacactcaccactctgacaaactggagtattcgagactaattcctaacttactgtaccaacgagtaacgttacctacgtttcccctgtccttacgttttcgggaccgtaagggggaaccttaaagggttcgaagtaaactacgaaaaacgttcgttaggtcggctgccaccttattccttgtttcc

SEQ ID NO: 394532 - DNA, 520 bp, Homo sapiens
  misc_feature: GZ8MTXP01AL30Z.17.25.C03.1.454.CMB.2.raw
  modified_base (267)..(267): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctaccctggctccgagctgccagatgtgacatccagatgacccagtctccatcctccctgtctgcctctgtgggggtcagagtcaccatcacttgccggacaagtcacggcgttaaaacctatttaaattggtatcagcagaaaccnggaaaagccccagacctcctgatctctggtgcatccactctgcgaagtggcgtcccatcgaggttcagtggcagtggatcgtgggcagatttcaatctcaccatcaccactccgcaacctgaggattgtgcaaatctactatcggtcaacagagttacacgttcccctcgtcacttttcggccaaggggaccaaagttgagaacttcgaaaacgtaacgttgttcggctgctaaccatcttcgttcttctaac

SEQ ID NO: 394533 - DNA, 555 bp, Homo sapiens
  misc_feature: GZ8MTXP01BCUC8.17.25.C03.1.454.CMB.2.raw
  modified_base (272)..(272): a, c, t, g, unknown or other
  modified_base (324)..(324): a, c, t, g, unknown or other
  modified_base (362)..(362): a, c, t, g, unknown or other
  modified_base (396)..(396): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatgggatgggacgaaccctaancgtggtgtcacagtcgtcttcacccatccctcgggacngacttaccatcgaccacgactcctaccataaacncagcctacatggagttgaggacgcctagaccagtctggaaccgacgaccgggcccttactattaccgtgtcgacgagcgtcccacgacgtccggttgacgtccgttacgggcacggtccgggtcctttgacgtttcgcgggggccgaaggggtaacccg

SEQ ID NO: 394534 - DNA, 600 bp, Homo sapiens
  misc_feature: GZ8MTXP01D470R.17.25.C03.1.454.CMB.2.raw
  modified_base (223)..(223): a, c, t, g, unknown or other
  modified_base (302)..(302): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtggggtcagagtcaccatcacttgccgganaagtcacggtacttaaaacctatttaaatggtatcagcaagaaacctggaaaacgccccaagacctctgatctctggtncatccatctgcgaagtggctccatcgagttccaggtgcagtggaatcgtgggacagtatttcaattctacaccatcaccactcagactaaaccgtggaggtattggtacactaaacttctaacgttactacggtacaaacgtagtaacgttacctacgtttccccctgtccttacgttttcgggccggtaacggggtaacccgttaaaggtttcggaaagtaacgttaaccgaaaaccggttaaccgttgggttcgggaccttcggtacccaccgttacgttcctttcggtttaaccc

SEQ ID NO: 394535 - DNA, 556 bp, Homo sapiens
  misc_feature: GZ8MTXP01B5BTI.17.25.C03.1.454.CMB.2.raw
  modified_base (437)..(437): a, c, t, g, unknown or other
  modified_base (446)..(446): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctctatagtatcaactgggtgcgccaggccgctggacaacgacctgagtggatgggatggggacaaccctaacacgtggtgtcacgagtcgtccttcaccctactcccgtaccgggacaacgaccttaccatcgacccacgaactccctaccaataaaccacacgcctacagtggagttgaggancctagaccngtctgaccgacgaccggccgtctattactgtcgcgagcgtcccacgacgtccggttgacgccgttacggcacggcggtcctttgcgttcggttcggggccgaaggggccg

SEQ ID NO: 394536 - DNA, 540 bp, Homo sapiens
  misc_feature: GZ8MTXP01ALARR.17.25.C03.1.454.CMB.2.raw
  modified_base (275)..(275): a, c, t, g, unknown or other
  modified_base (297)..(297): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtgtgggggtcagagtcaccatcacttgccgacaagtcacggtacgttaaaacctatttaaatggtatcagcagaaactggaaacncccagacctctgatctctggtncatccactctgcgaagtcggctcccatcgaggttccaggtgcagtggaatcgtgggactagtatttcaatctacaccactacaccactctcgacaaccgtgagtattgtgactaactctacgtactgtacaacagtacgttaccacgttacccctcgtcctacgttttcggaccgtaacggggaaccttaaaggtgaacgtactaacgaaacgacgttgtggctgccacttactcgttgttcc

SEQ ID NO: 394537 - DNA, 562 bp, Homo sapiens
  misc_feature: GZ8MTXP01AM7HX.17.25.C03.1.454.CMB.2.raw
  modified_base (286)..(286): a, c, t, g, unknown or other
  modified_base (297)..(297): a, c, t, g, unknown or other
  modified_base (466)..(466): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacttaaactatttaaatggtatcagcagaaacctggaaacgccccagacctcngatctctggtncatccactcgtgacgaagtcggcgtcccagtcgaggttccaggtggcagtggaatcgtgggactagtatttcaattcacaccatccacctacgtctagaccaacgttggacggtattgtgactaattcctaactactgtaaccaacagtacgttaccacgtttcccccngtccttacgtttccgggaccgaaggggtaacccttaaaggttgaaacgtactaacgaaacgttcttggtcggctcgacaccttagtcttcgttccc

SEQ ID NO: 394538 - DNA, 544 bp, Homo sapiens
  misc_feature: GZ8MTXP01C16GL.17.25.C03.1.454.CMB.2.raw
  modified_base (324)..(324): a, c, t, g, unknown or other
  modified_base (365)..(365): a, c, t, g, unknown or other
  modified_base (485)..(485): a, c, t, g, unknown or other
  modified_base (536)..(536): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanacgtggtgtcacagtcgtcttcacccatccctaccgggacngacttaccatcgaccacgaactccctacaataaacacagcctacatggagttgaggcgcctagacagtctgaccgacgcggccgtctattactgtcgcgagcgtcccacgagtcccgggngacgtccgttaacgggcacggccggtcctttggacttcggcgggggtccgnggggcccg

SEQ ID NO: 394539 - DNA, 553 bp, Homo sapiens
  misc_feature: GZ8MTXP01DG80K.17.25.C03.1.454.CMB.2.raw
  modified_base (273)..(273): a, c, t, g, unknown or other
  modified_base (325)..(325): a, c, t, g, unknown or other
  modified_base (337)..(337): a, c, t, g, unknown or other
  modified_base (427)..(427): a, c, t, g, unknown or other
  modified_base (453)..(453): a, c, t, g, unknown or other
  modified_base (484)..(484): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggcccgctggacaacgacctgagtggatgggatggggcaaccctaanacgtggtgtcanagtcgtcttcacccatcccgtaccgggacaagaccttaccatcgacccacgaactccctaccaataaaccacagcctacatggatgaganctagacagtctgacgacacggccgtntatactgtgcgagcgtcccagacgttccggngtacggccttacgggcacggtccgggtacctttcggacctttcggacgggggcccaagggggtaacccg

SEQ ID NO: 394540 - DNA, 640 bp, Homo sapiens
  misc_feature: GZ8MTXP01DOM1O.17.25.C03.1.454.CMB.2.raw
  modified_base (209)..(209): a, c, t, g, unknown or other
  modified_base (315)..(315): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggctnagtgagtctctgcagctctgattcacgtttacctctatagtatcaacgtgggtgcgccaggccgctggacaacgacctgagtggagtgggatgggacaaccctaanacgtggtctcacgagtcgtccttacaccctactcccgtaccgggacaacgtaccttaaccatacgaccacgaacctcctaccaaataaaccacacgacctacaagtggagttgaaggacgcctagaccagttccgtacggaaaccgaccgtaaccggtcccgtttaccttaagtttaaccgtggtcggaccgaacggtaccggttaacccccaaggttaccggttcccgggttaggaccggtcccgttaccgggcttaaccgggccggttacccgttttggtaaccgtttccggggttcgggggccccgttaagggggaaccccg

SEQ ID NO: 394541 - DNA, 557 bp, Homo sapiens
  misc_feature: GZ8MTXP01D0V6G.17.25.C03.1.454.CMB.2.raw
  modified_base (223)..(223): a, c, t, g, unknown or other
  modified_base (299)..(299): a, c, t, g, unknown or other
  modified_base (407)..(407): a, c, t, g, unknown or other
  modified_base (546)..(546): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctcgtgtgggggtcagagtcaccatcacttgccganagtcacgtacttaaaactatttaaatggtatcagcaagaaacctggaaaacgccccagaccctctgatctctggtncatccactctgcgaagtcggccgtcccatcgaggttccaggtgcagtggaatcgtgggacagtattcaatctacaccatcaccactctagacaacctgaagtatgtanacaatctaacgtactgtacaaacgtagtacgttacgacgttacccctcgtccgttaaccgttttcgggacccgtaaggggaacccttaaagttcgaagtaactacgaaaaccgttacttcggtcggctcgccaaccttntccgttcgttc

SEQ ID NO: 394542 - DNA, 544 bp, Homo sapiens
  misc_feature: GZ8MTXP01BV8KL.17.25.C03.1.454.CMB.2.raw
  modified_base (223)..(223): a, c, t, g, unknown or other
  modified_base (278)..(278): a, c, t, g, unknown or other
  modified_base (290)..(290): a, c, t, g, unknown or other
  modified_base (301)..(301): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtggggtcagagtcaccatcacttgccgganaagtcaacggtacttaaaacctatttaaatggtatcagcaagaaacctgaaaacnccccagacctcngatctctggtncatccactctgcgaagtggcgtcccagtcgagttccagtgcagtgaatcgtgggacagtatttcaatctacaccatccaccactctgactaaccgtgaggtattgagactaaattcctaactactgtaacaacagtattacctacgttcccctgtacctacgtttcggaccgtaacggggaaccttaaaggttcgaagtaactacgaaaacgacttggtggcctgaccaccatccgttgttcc

SEQ ID NO: 394543 - DNA, 520 bp, Homo sapiens
  misc_feature: GZ8MTXP01DI4AY.17.25.C03.1.454.CMB.2.raw
  modified_base (363)..(363): a, c, t, g, unknown or other
  modified_base (460)..(460): a, c, t, g, unknown or other
  modified_base (514)..(514): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtcgtcttcacccatccctccgggacngacttaccatgacccacgaaactcctccaataaacacagcctaacatggagttgagagcctagacatctgacgacacgccgtctattactgtgcgancgtcccagatccggttgacgcttacggcaggccgtctttgcttgttcgggccgngggccg

SEQ ID NO: 394544 - DNA, 523 bp, Homo sapiens
  misc_feature: GZ8MTXP01E4TTD.17.25.C03.1.454.CMB.2.raw
  modified_base (273)..(273): a, c, t, g, unknown or other
  modified_base (323)..(323): a, c, t, g, unknown or other
  modified_base (363)..(363): a, c, t, g, unknown or other
  modified_base (396)..(396): a, c, t, g, unknown or other
  modified_base (418)..(418): a, c, t, g, unknown or other
  modified_base (452)..(452): a, c, t, g, unknown or other
  modified_base (460)..(460): a, c, t, g, unknown or other
  modified_base (517)..(517): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctanactggtgtcacagtcgtcttcacccatccctaccgggacngactacatcgaccacgaactcctaccataaacncagcctacatggagttgaggancctagacagtctgacgacacggccgtctattacngtgcgagngtccccaagactccgggttgacgccttacggcaggcggctttgacttcgcggggccngggccg

SEQ ID NO: 394545 - DNA, 551 bp, Homo sapiens
  misc_feature: GZ8MTXP01AUGFP.17.25.C03.1.454.CMB.2.raw
  modified_base (294)..(294): a, c, t, g, unknown or other
  modified_base (305)..(305): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacgttaaaacctatttaaatggtatcagcaagaaacctaggaaaacgccccagaccctccngatctctggtncatccactctgacgaagtggccgtcccatcggaggttccaggtggcaggtggaatcgtgggacagtatttcaatctcaccatcaccactctgcaaccgtgaggtattgagacaattctacgtactgtacaacagtacgttactaccgttcccctcgtacctacgtttcggaccgtaacggggaaccttaaaggttcgaagtactaacgaaacgttacttgtggctcgacaccttattcttcgttcc

SEQ ID NO: 394546 - DNA, 546 bp, Homo sapiens
  misc_feature: GZ8MTXP01BP2AR.17.25.C03.1.454.CMB.2.raw
  modified_base (253)..(253): a, c, t, g, unknown or other
  modified_base (323)..(323): a, c, t, g, unknown or other
  modified_base (363)..(363): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtgcgccaggccgctggacaacgacctgagtggatgggatgggcaaccctaanactggtgtcacagtcgtcttcacccatccctaccgggacngacttaccatcgaccacgaactcctaccataaacacacgcctacatggagttgaggagcctgacatctgacgacacggcctctattactgtcgcgagcgtcccaacggactccgggttgaacgcccttaacgggcacggcggtcccttttggacctttcggcgggggtcccgaaggggaaccg

SEQ ID NO: 394547 - DNA, 573 bp, Homo sapiens
  misc_feature: GZ8MTXP01EB019.17.25.C03.1.454.CMB.2.raw
  modified_base (305)..(305): a, c, t, g, unknown or other
  modified_base (406)..(406): a, c, t, g, unknown or other
  modified_base (442)..(442): a, c, t, g, unknown or other
  modified_base (482)..(482): a, c, t, g, unknown or other
  modified_base (561)..(561): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgccggacaagtcacggtacttaaacctatttaaatggtatcagcaagaaacctaggaaaacgccccagaccctctgactctctgggtncctactcccactcgtggacgaaggttcggcccttcccagtcggtaggttccaggtggcgaggtggaatcgtggggactagtatttacaattcctacaaccntaccaacctactctacgactaaccgtggagtatgtnactaatctaactactgacaacagtacttactcgttccccngtccttacgtttcggaccgtaaggggtaaccttaaaggttgaactactaacgaaacgttacttggtgcgtcaccacttnttcttgttaacc

SEQ ID NO: 394548 - DNA, 595 bp, Homo sapiens
  misc_feature: GZ8MTXP01CTBJM.17.25.C03.1.454.CMB.2.raw
  modified_base (278)..(278): a, c, t, g, unknown or other
  modified_base (303)..(303): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctggtgggggtcagagtcaccatcacttgccggacaagtcacggtacttaaaacctatttaaattggtatcagcaagaaacctggaaaacncccagacctcctgatctcgtggtcncactccactctgacgtaagtcggcctcccagtcggtaggttccaggtggcaggtggaatcgtgggactagtatttcaatctacaccatccacctactctagaccaaaccgtgggaaggtattcgacgtaactaacttccttaacgttactcggtaaccaacgtagtacgtactaccgttcccctgtccttacgtttcggaccgtaacggggtaaccttaaaggttcgaagtaactaaccgaaaacggttcttgggtcggctaacggcctacttacttccgttaacgtttccc

SEQ ID NO: 394549 - DNA, 574 bp, Homo sapiens
  misc_feature: GZ8MTXP01EHMQU.17.25.C03.1.454.CMB.2.raw
  modified_base (375)..(375): a, c, t, g, unknown or other
  modified_base (450)..(450): a, c, t, g, unknown or other
  modified_base (480)..(480): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggagtgaagaagcctggggcctcagtgaaggtctcctgcaaggcttctggattcacgtttacctcctatagtatcaacgtgggtgcgccaggccgctggacaacgacctgagtggagtgggatcgggaccaaaccctaacacgtggtgtcacagtcgtccttccacccactcccgtaccgggaacncgtaccttaccatccgacctaacgcctaccctaccaaataaaccacacgacctacaacgtggagttaggaggacnctgaccagtcgtagcgacgaccggtccgtnttactactgtcgacgacgacgtcccagacgtccggttgacgtccgacgcgacggtccgctttcggacgttcggacggggtcccgaagggtcccg

SEQ ID NO: 394550 - DNA, 516 bp, Homo sapiens
  misc_feature: GZ8MTXP01DMYS6.17.25.C03.1.454.CMB.2.raw
  modified_base (298)..(298): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtncatccatctgcgaagtgcgtcccatcgagttccagtggcagtggaatctgggacagtatttcaatctcaccatcaccactctgacaacctgaggattgtgcaatctacgtactgtacaacagtagttacagttacccctcgtcctacgtttcggccctaaggggaacccaaaggttgagactcttaaacgacttgtggacctgacaccatcttgttcc

SEQ ID NO: 394551 - DNA, 544 bp, Homo sapiens
  misc_feature: GZ8MTXP01AL3Q5.17.25.C03.1.454.CMB.2.raw
  modified_base (301)..(301): a, c, t, g, unknown or other
  modified_base (369)..(369): a, c, t, g, unknown or other
  modified_base (382)..(382): a, c, t, g, unknown or other
  modified_base (397)..(397): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacttaaaacctatttaaatggtatcagcaagaaacctggaaaacgccccaagacctcctgatctctggtncatccactctgcgaagtcggcgtccatcgagttccagtggcagtgaatcgtgggacagtattcaatcncacatcacactcnacaactgagtattgnactaatctacgtactgtacaacagtacgttactaccgttccctcgtcttacgttcggaccgtaacgggtaaacttaaaggtagaacgtaaactaaacgaaaacgttacgttggtaacggcgtaacgacaccttactaacgttcgttc

SEQ ID NO: 394552 - DNA, 636 bp, Homo sapiens
  misc_feature: GZ8MTXP01DI126.17.25.C03.1.454.CMB.2.raw
  modified_base (224)..(224): a, c, t, g, unknown or other
  modified_base (281)..(281): a, c, t, g, unknown or other
  modified_base (286)..(286): a, c, t, g, unknown or other
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccganaagtcacggtacttaaaactatttaaatggatcagacaagaaacctaggaaaacccncccanaccctctagtactctgtgtcactactcctactcgtagacgtaacggtcgtaccgtacctagtcggtacggtcgaggtggagtagtggaacgttcggaaggactagttactttacaacttccaccaactactaccaccgtactcacgaacctaacgtgtaagtattcgacgtaactaacttaccttaacgtaacgtacgtaaccaaagtacgtaacgttaccgttacccgtttacccctcgttaccgttaccggttaccgggaacggtaacgggtaaacttaaaggtacgaaacgtaaactaacgaaacgttcgttcggtcgtactaacgacctacttcttcgttcgttcc

SEQ ID NO: 394553 - DNA, 535 bp, Homo sapiens
  misc_feature: GZ8MTXP01DACHB.17.25.C03.1.454.CMB.2.raw
  modified_base (322)..(322): a, c, t, g, unknown or other
  modified_base (417)..(417): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggatgggatgggcaaccctaanactggtgtcacagtcgtcttcacccatccctaccgagcagaccttaccatcgaccacgaactcctacaataaacacagcctacatggagtgagancctgacatctagaccgacaccggcctctaattctgtgcgagaacgtcccagtacttccgggtagcgcccgttcggcaaggccggtcctttgaccgtttcgtcgggggccgaacggggg

SEQ ID NO: 394554 - DNA, 535 bp, Homo sapiens
  misc_feature: GZ8MTXP01BHPNM.17.25.C03.1.454.CMB.2.raw
  modified_base (322)..(322): a, c, t, g, unknown or other
  modified_base (361)..(361): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcacgtttacctcctatagtatcaactgggtgcgccaggccgctggacaacgacctgagtggatgggatgggcgaaccctaanactggtgtcacagtcgtcttcacccatccctccgggacngacttaccatcgaccacgaactcctaccataaacacagcctacagtggagttgaggagcctagacagtctggacgacacggccgtctattacctgtgcgagcgtcccagatccgggttgacgccgttacggcacggcggtcctttgcgttcgttcggggccgttaaggggcccg

SEQ ID NO: 394555 - DNA, 418 bp, Homo sapiens
  misc_feature: GZ8MTXP01CKDYY.17.25.C03.1.454.CMB.2.raw
  modified_base (412)..(418): a, c, t, g, unknown or other
tcagcgtagactagcacgaccggtgctcgatttagtagtgtagatttgggtttgggagggggtcagagtcaccatcacttgccggacaagtcacggcgttaaaacctatttaaattggtatcagcagaaacctggaaaagccccagacctcctgatctctggtgcatccactctgcgaaatggcgtcccatcgaggttcagtggcagtggatctgggacagatttcaatctcaccatcaccactctgcaacctgaggattgtgcaatctacactgtcaacagagttacacgttcccctcgcactttggccaggggaccaaagttgagatacaaacgaactgtaggctgccacatctgtcttcatccttccgcatctgactgctacgctgagcggctggacaaggcgcatagnnnnnnn

SEQ ID NO: 394556 - DNA, 588 bp, Homo sapiens
  misc_feature: GZ8MTXP01BA6C1.17.25.C03.1.454.CMB.2.raw
  modified_base (302)..(302): a, c, t, g, unknown or other
  modified_base (413)..(413): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacaagtcacggacgttaaaacctatttaaatggtatcagcaagaaacctaggaaacgcccagacctcctgatctctggtncatccactctgacgaagtcggcgtcccatcgaggttccaggtgcaggtggaatcgtgggacagtatttcaattctcaccatacaccactctgaccaaacctgaggtattgngactaaattctaactactgtacaaacgtagtaacttacctacgtttaccccctgtccttaccgttttcgggacccgtaagggggtaacccttaaagggtttcgaaagtaaacttaaccgaaaacggttaaccttggttaacgggacttcggacctacccagttccttggtttccc

SEQ ID NO: 394557 - DNA, 576 bp, Homo sapiens
  misc_feature: GZ8MTXP01D0NLU.17.25.C03.1.454.CMB.2.raw
  modified_base (251)..(251): a, c, t, g, unknown or other
  modified_base (271)..(271): a, c, t, g, unknown or other
  modified_base (282)..(282): a, c, t, g, unknown or other
  modified_base (324)..(324): a, c, t, g, unknown or other
  modified_base (411)..(411): a, c, t, g, unknown or other
  modified_base (419)..(419): a, c, t, g, unknown or other
  modified_base (433)..(433): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggattcacgtttaccnctatagtatcaacgtgggtncgccaggccgntggacaacgacctgagtggagtgggatcgggacaaccctaancgtggtgtacacgtagtcgtccttacacccatcccgtacccgggacaacgtaccttaccatcgaccacgaactccctacaataaacncagcctanagtggattgaggancctagacagtctagaccgacgacgtccgtatagttactgtcgacgagcgtcccagcgtcccggttgaccggtccttaacggcgacgggtcccggttccttttcggaccgttcgggttccgggggcccgttaagggggtccccg

SEQ ID NO: 394558 - DNA, 591 bp, Homo sapiens
  misc_feature: GZ8MTXP01EZLM0.17.25.C03.1.454.CMB.2.raw
  modified_base (337)..(337): a, c, t, g, unknown or other
  modified_base (367)..(367): a, c, t, g, unknown or other
  modified_base (424)..(424): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctcctatagtatcaacgtgggtgcgccaggccgctggacaacgacctgagtggatgggatgggacgaaccctaacactggtgtcanagtcgtcttcacccatcccgtaccgggacngacttaccatcgaccacgactcctacaataaacacacgcctacatgggagttgaggngcctagaccatctagaccacgacgggcctcttattacgtgtcgagtacggacgtcccctaaaggcgttcccgggagaaccgttcccggaaaccgggcttaaccgggtcccgggttccctttgggtacccgtttcgggttaccggggggcccgttaagggggtccccg

SEQ ID NO: 394559 - DNA, 529 bp, Homo sapiens
  misc_feature: GZ8MTXP01BI76I.17.25.C03.1.454.CMB.2.raw
  modified_base (274)..(274): a, c, t, g, unknown or other
  modified_base (286)..(286): a, c, t, g, unknown or other
  modified_base (297)..(297): a, c, t, g, unknown or other
  modified_base (503)..(503): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaatggtatcagcagaaacctggaaanccccagacctcngatctctggtncatccactctgcgaagtgcgtcccatcgaggttccaggtgcagtggaatcgtgggacagatttcaatctacaccatcaccactctgcaaccgtgtaggattgtgactaatcctactactgtacaaactagtacgttacacgttacccctcgtacctacgtttcggccgaacggggaacaaaggttcgagtactacgaaacgttacngtgggctgcaccttatccgttgttcc

SEQ ID NO: 394560 - DNA, 534 bp, Homo sapiens
  misc_feature: GZ8MTXP01D48YT.17.25.C03.1.454.CMB.2.raw
  modified_base (209)..(209): a, c, t, g, unknown or other
  modified_base (315)..(315): a, c, t, g, unknown or other
  modified_base (358)..(358): a, c, t, g, unknown or other
  modified_base (446)..(446): a, c, t, g, unknown or other
  modified_base (453)..(453): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggcctnagtgagtctctgcagctctggattcacgtttactctatagtatcaacgtgggtgcgccaggccgctggacaacgacctgagtggatgggatgggacgaaccctaanacgtggtgtcacagtcgtccttcacccatcccgtaccgggacngtaccttaccatcgacccacgaactcctacaataaacacagcctaacagtggagttgaggacgcctagacatctgacgacacggcctntattacngtgacgagcgtcccagacgtccgggttgacgccgttacggcacggccgtctttgcgttcggcggggtccgaaggggtcccg

SEQ ID NO: 394561 - DNA, 537 bp, Homo sapiens
  misc_feature: GZ8MTXP01A8NW7.17.25.C03.1.454.CMB.2.raw
  modified_base (364)..(364): a, c, t, g, unknown or other
  modified_base (449)..(449): a, c, t, g, unknown or other
  modified_base (522)..(522): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtcgtcttcacccatccctaccgggacngacttaccatcgaccacgactcctacaataacacagcctacatgagtcgaggagcctagacatcgtgaccgacgacggtcccgtntattacctgtcgcgacgcgtccccaacgttagtcccggttgacgccttacgggcacggtcgtcttgacttcgnggggccaaggggccg

SEQ ID NO: 394562 - DNA, 636 bp, Homo sapiens
  misc_feature: GZ8MTXP01DYAU3.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggagtgggatggggacgaaacccctaacacgtggtcgtcacagtcgtccttacacccctatcccgtaccgggacaacgaccttaccatcgacccacgaactccctaccaataaaccacacgacctacagtggagttgaggacgcctagaccagtcgtaggaaccgacgaccggtccgttcttacgtttaaccgtggttcggacgtaacggaccggttaaccccgaacggttacgtcccgggttaggaaccggtcccgttaaccgggcttaccgggtcccgggttacccgttttcggaccgtttcgggttcgggggtaacccgaagggggtccccgg

SEQ ID NO: 394563 - DNA, 553 bp, Homo sapiens
  misc_feature: GZ8MTXP01B6UW2.17.25.C03.1.454.CMB.2.raw
  modified_base (223)..(223): a, c, t, g, unknown or other
  modified_base (297)..(297): a, c, t, g, unknown or other
  modified_base (302)..(302): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganaagtcacgtacgttaaaactatttaaatggtatcagcaagaaacctaggaaaacgccccaagacctctgatctntggtncatccactctgcgaagtggctcccatcgaggttccaggtggctagtggaatcgtgggactagtatttacaattcctacacccatccacctactctagcaacgtgagtattgagactaatctactactagtacaacgagtacgttactaccgtttcccctgtccttaacgtttcgggacccgtaaagggggtaacccttaaaggttcgaagaactacgaaacgttcttggtgctcgcacattccgttgttcc

SEQ ID NO: 394564 - DNA, 591 bp, Homo sapiens
  misc_feature: GZ8MTXP01A5Z42.17.25.C03.1.454.CMB.2.raw
  modified_base (221)..(221): a, c, t, g, unknown or other
  modified_base (278)..(278): a, c, t, g, unknown or other
  modified_base (300)..(300): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccgganaagtcacggtacgttaaaacctatttaaattggtatcagcaagaaacctggaaaacncccagacctctgatctctggtncatccactctgcgaagtcggctccatcgagttccagtggcagtgaatcgtgggacagtatttcaatctacaccatcaccactctgactaaacctggaggtattgtgactaattacttactactgtacaaactagtacgttacacggtttcccctctacctacgtttcgggaccgtaagggggtaaacccttaaaggtttcgaaacggtaaacttaacccgaaaacggttaaaccgtttcgggaacgggtaccttaacgggacctaacccgttagttccttcggtttaaccc

SEQ ID NO: 394565 - DNA, 448 bp, Homo sapiens
  misc_feature: GZ8MTXP01C1GI2.17.25.C03.1.454.CMB.2.raw
  modified_base (432)..(432): a, c, t, g, unknown or other
  modified_base (439)..(442): a, c, t, g, unknown or other
  modified_base (444)..(448): a, c, t, g, unknown or other
tcagcgtagactagcacgaccggtgctcgatttagtagtgtagatttgggtttgggagggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatcgtgggacagatttcaatctcaccatcaccactctgcaacctgaggtattgtgcaatctactactgtacaacagtacgttacacgttcccctcgctacgttttcggaccgagggggacctaaagttgagactacaaacgaactgtaggctcgcccaccatctgtcttacatccttcccgcctatctgactagtctacgctgacgcgggctggacaaggcnctagagnnnngnnnnn

SEQ ID NO: 394566 - DNA, 551 bp, Homo sapiens
  misc_feature: GZ8MTXP01AUCQ6.17.25.C03.1.454.CMB.2.raw
  modified_base (307)..(307): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcaacggtacgttaaaacctatttaaatggtatcagacaagaaacctaggaaaacgccccaagacctcctgatctctggtncatccactctggacgaagtcggccgtcccagtcggaggttccaggtggcagtggaatcgtgggacagtattcaatctacaccatcaccactctgacaacgtgagtatgcgataactctaactactgtacaaactagtacgttacacgttcccctcgtctacgtttcggacgtaacggggtaacttaaaggttgaagtataacgaaacgttacgttggtggctcgaccacttactcgttcgttcc

SEQ ID NO: 394567 - DNA, 575 bp, Homo sapiens
  misc_feature: GZ8MTXP01ACBL9.17.25.C03.1.454.CMB.2.raw
  modified_base (213)..(213): a, c, t, g, unknown or other
  modified_base (280)..(280): a, c, t, g, unknown or other
  modified_base (292)..(292): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacatgtgcccactcccaggtgcagctggtgcagtctggggctgaggtgaagaagccgtggggcctnagtgaaggtctcctgcaaggtcttcgtggtattcacgtttacattcctatagtatcaacgtgggtcncgccgaggccgntggaacacgacctgagtggagtgggatcgggaccaacctacacgtggtgtcaccgagtgtcctcacccatcccgtcggacacgtacttacatcgacacgactctacataaacacagacctactagtggtaggtgaacggacgcccgagggtacacgtcgtacgacgacgaccggtccgtacctgttactggcgcgaagccgttacccgacgacgtccggtaggacgttccgttacggccgaggtccggtccgtttcgttaccgttcggttcggggaacccggg

SEQ ID NO: 394568 - DNA, 580 bp, Homo sapiens
  misc_feature: GZ8MTXP01D2I1C.17.25.C03.1.454.CMB.2.raw
  modified_base (208)..(208): a, c, t, g, unknown or other
  modified_base (264)..(264): a, c, t, g, unknown or other
  modified_base (315)..(315): a, c, t, g, unknown or other
  modified_base (360)..(360): a, c, t, g, unknown or other
  modified_base (407)..(407): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggctnagtgagtctctgcagcttctggattcacgtttacctctatagtatcaacgtgggtncgccaggccgctcggacaacgactgagtggatgggatgggacaaccctaancgtggtctcactagtcgtccttacgaccctatcccgtacgggacncgtacttaccatcgaaccacgaactcctacaataaacacagacctanagttggattgagacgctagactagtctgaaccgacgaccggtccgtcttagttactggtcgacgacgtcgtcccaggacgtcccggggttagaccggcccgttacgggcgaacggtcccgggttacctttggtacccgttcgggttccgggggaaccgttaacgggggtcccg

SEQ ID NO: 394569 - DNA, 572 bp, Homo sapiens
  misc_feature: GZ8MTXP01DGVES.17.25.C03.1.454.CMB.2.raw
  modified_base (328)..(328): a, c, t, g, unknown or other
  modified_base (369)..(369): a, c, t, g, unknown or other
  modified_base (412)..(412): a, c, t, g, unknown or other
  modified_base (428)..(428): a, c, t, g, unknown or other
  modified_base (454)..(454): a, c, t, g, unknown or other
  modified_base (465)..(465): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatgggaccgaaaccctaanactggtgtcacagtcgtcttcacccatcccgtaccgggacngacttacatcgaccaacgactcctacaataaacacagacctanagtggagtgagagccngacatcgtgaacacgaccggtccctntatttaaccgngtacgacgtacgaccgtcccgaacgttcgtccggagaccggtccgttacggcgttacggtccggttacgtttcgaccggttcgggacggggtccgaacggggtcccg

SEQ ID NO: 394570 - DNA, 640 bp, Homo sapiens
  misc_feature: GZ8MTXP01BCEHZ.17.25.C03.1.454.CMB.2.raw
  modified_base (222)..(222): a, c, t, g, unknown or other
  modified_base (276)..(276): a, c, t, g, unknown or other
  modified_base (299)..(299): a, c, t, g, unknown or other
  modified_base (392)..(392): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcacatcacttgccgganaagtcacgtacgttaaaactatttaaatggtatcagcaagaaacctggaaaacncccaagacctctgatctctggtncatccatctgcgaagtcggctccatcgagtccagtgcagtgattgggcagtattcaatctacacatcaccatctgacaacgtgagtattggtnactaaatcttaacctacgttacgtaacctaaacgtacggtaaacgtttaaccctaaccggttttcccccctaacgtaccgtttaacccggtttttccggggacccgggtaaacggggggtaaaccccttaaaaaggtttcgggaaaacttaaacgttaacccgaaaaacggttaaaccgttgggttacggggaacccttaggaacccctaaacccgttacgtttaccgttaacgtttaaccttaaccg

SEQ ID NO: 394571 - DNA, 592 bp, Homo sapiens
  misc_feature: GZ8MTXP01DN6IO.17.25.C03.1.454.CMB.2.raw
  modified_base (221)..(221): a, c, t, g, unknown or other
  modified_base (296)..(296): a, c, t, g, unknown or other
  modified_base (360)..(360): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccgganaagtcacggcttaaaacctatttaaatggtatcagcagaaacctggaaaacgcccaagacctctgatctctggtncatccatctgcgaagtggctccatcgagttccagtggcagtgaatctgggacagattcaatctnacatcacactctgacaacctgaggattgtcgacaatctaacgttacttgtacaaacaggtacttaaccacggtttaccccctcggtcctaccgtttttcgggacccgtaaacggggggtaacccttaaaaggtttacgaaaggtaaacttaccgaaaaaaccgggttaaaccttgggttaacggggcccttaacggtacccaaccccttaagttccgtttcgttttaacccc

SEQ ID NO: 394572 - DNA, 523 bp, Homo sapiens
  misc_feature: GZ8MTXP01EKYEV.17.25.C03.1.454.CMB.2.raw
  modified_base (306)..(306): a, c, t, g, unknown or other
  modified_base (347)..(347): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacttaaaacctatttaaattggtatcagacaagaaacctggaaaacgcccccaagaccctcctgatctctggtncatccactctgcgaagtggctcccatcgagttccagtggcngtggaatctgggacagtatttcaatctcaccatcaccactctgcaactgagatgtgctaatctactactgtacaaacagtagttactacgttcccctcgtcctacgttttcggccgaaggggtaaccaaaggttgaagtactaacaaacgacttgtggctcgcaccatcttgttcc

SEQ ID NO: 394573 - DNA, 554 bp, Homo sapiens
  misc_feature: GZ8MTXP01ETRTO.17.25.C03.1.454.CMB.2.raw
  modified_base (223)..(223): a, c, t, g, unknown or other
  modified_base (304)..(304): a, c, t, g, unknown or other
  modified_base (376)..(376): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctggtgggggtcagagtcaccatcacttgaccgganaagtcacggtacttaaaactatttaaatggtatcagcaagaaacctggaaaacgccccaagaccctcctgactctctggtncatccactctgacgaagtcggctcccatcgaggttccaggtgcagtggaatcgtgggacagtatttcaatcncacatacaccactctgacaactgaggtattgtgactaaatcttaactactgtaacaacgtagtacgttactacgtttcccctcgtaccttacgtttcggaccgaacggggtaaccttaaaggttgaagtaacgtaacaaaacggacttgggtaagcctgccacttatccttgttaacc

SEQ ID NO: 394574 - DNA, 595 bp, Homo sapiens
  misc_feature: GZ8MTXP01A52II.17.25.C03.1.454.CMB.2.raw
  modified_base (222)..(222): a, c, t, g, unknown or other
  modified_base (277)..(277): a, c, t, g, unknown or other
  modified_base (395)..(395): a, c, t, g, unknown or other
  modified_base (493)..(493): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcacatcacttgccganagtcacggtacttaaaactatttaaatggtatcagacaagaaacctaggaaaacnccccaagacctcctagactctgtggtcactactcccattctggacgaaggtcggccgttacccagtccggaggttccaggtgacagtgaatcgtgggactagtatttacatctacacngtacaccacgtcacgactaaccgtgaacggtatttcggactactaacttaccgttactactacgttaacaaacgtaggtacttaccaccgtttccccncgtacttacgtttcggcccgaagggaccttaaaggtgaaagtaactaacgaaaccgttgttcggttcggctaaggaccctaacgttacttccgttgtttccc

SEQ ID NO: 394575 - DNA, 580 bp, Homo sapiens
  misc_feature: GZ8MTXP01BFTQJ.17.25.C03.1.454.CMB.2.raw
  modified_base (279)..(279): a, c, t, g, unknown or other
  modified_base (432)..(432): a, c, t, g, unknown or other
  modified_base (444)..(444): a, c, t, g, unknown or other
  modified_base (492)..(492): a, c, t, g, unknown or other
  modified_base (555)..(555): a, c, t, g, unknown or other
  modified_base (557)..(557): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatcctccctgtctgcctctggtgggggtcagagtcaccatcacttgccggacaagtcacggtacttaaaacctatttaaatggtatcagcaagaaacctggaaaacnccccaagaccctccagtactctcgtggtcactactcctactcgtcgacgtaacggtcgtaccgtacagtacggtagttccgaggtgacgtaggtaggactcggaagggactagttacttacatcacacactacacctacgtctacaactacgngtagtattcganactaactacttatagtactaaacaacgtgtaacctcgtacctcccgtntacgttacgtcggaacggtaacgtaacttagtacgaacgtaactaacgaacgttgcggtaacncnctactacttcttccgttcgttcc

SEQ ID NO: 394576 - DNA, 560 bp, Homo sapiens
  misc_feature: GZ8MTXP01C61R3.17.25.C03.1.454.CMB.2.raw
  modified_base (276)..(276): a, c, t, g, unknown or other
  modified_base (327)..(327): a, c, t, g, unknown or other
  modified_base (334)..(334): a, c, t, g, unknown or other
  modified_base (367)..(367): a, c, t, g, unknown or other
  modified_base (428)..(428): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaaggcttctggattcacgttttacctcctatagtatcaactgggtncgcaggccgctggacaacgcctgagtggatgggatcgggacaaaccctaancgtggtncacagtcgtcttcacccatcccgtaccgggacngacttaccatacgaccacgaacctccctacaataaacacacgcctacatggagttgaggancctagacatcgtagaccgacgacgccgtctattactgtgcgagctcccaagcgtcccggttgacgtccgaacggttcgacggtcccggtacctttcggaccgtttcggcgggggccttaagggggtaacccg

SEQ ID NO: 394577 - DNA, 542 bp, Homo sapiens
  misc_feature: GZ8MTXP01CA0SX.17.25.C03.1.454.CMB.2.raw
  modified_base (211)..(211): a, c, t, g, unknown or other
  modified_base (363)..(363): a, c, t, g, unknown or other
  modified_base (525)..(525): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctnagtgaaggtctcctgcaaggcttctggattcacgtttacctcctatagtatcaactgggtgcgccaggccgctggacaacgcctgagtggatgggatgggacaaccctacacgtggtgtcacgagtcgtcttcacccatccctaccgggacngaccttaccatcgaccacgaactcctaccataaaccacacgacctacagtggtagtgaggacgcctagacatctgacgacacggcgtctattactgtgtcgagtcgtcccagatccggttgacgtccgttacgggcagggtccggtcctttggaccttcggnggggtccaaggggtccg

SEQ ID NO: 394578 - DNA, 565 bp, Homo sapiens
  misc_feature: GZ8MTXP01BA4X6.17.25.C03.1.454.CMB.2.raw
  modified_base (253)..(253): a, c, t, g, unknown or other
  modified_base (273)..(273): a, c, t, g, unknown or other
  modified_base (326)..(326): a, c, t, g, unknown or other
  modified_base (368)..(368): a, c, t, g, unknown or other
  modified_base (437)..(437): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtncgccaggccgctggacaacgacctgagtggatgggatcgggacgaaccctaanacgtggtgtcacagtcgtcttcacccatcccgtaccgggacngaccttaccgatcgacccacgaactccctaccaataaaccacacgacctaacataggagttggaaggancctagacctagtctagaccgacgacggccgtcttattacgtgtcgacgacgcgtcccagactcccgggttgacgcccgttacggcacggccggtctttgacctttcggcggggtcccaaggggtcccg

SEQ ID NO: 394579 - DNA, 548 bp, Homo sapiens
  misc_feature: GZ8MTXP01E4QKM.17.25.C03.1.454.CMB.2.raw
  modified_base (418)..(418): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggatggggatggggaccaaaccctaacacgtggtgtcacagtcgtccttcacccatcccgtaccgggacaagaccttacatcgaccacgaactccctaccaataaaccacagacctanatggagttgaggacgcctgacagtcagaccgacacggccgtctattactgtgacgagcgtcccacgatcccggttgacgccttacggcagccggcctttggaccttcggttcggggcccgaaggggcccg

SEQ ID NO: 394580 - DNA, 552 bp, Homo sapiens
  misc_feature: GZ8MTXP01BOFKJ.17.25.C03.1.454.CMB.2.raw
  modified_base (272)..(272): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacgttaaaacctatttaaatggtatcagcagaaacctggaaancccagacctctgatctctggtgcatccactctgcgaagtcggctccatcgaggttccaggtgcagtggaatctggggactagatttcaatctacaccatcaccactctgacaacctgaggtattgagactaaatccttaacgtactgtaccaaactagtaacgttacctacgtttcccctcgtaccgtaccttttcggccgtaacgggggtaaccaaaggtttcgaaggaacttacaaacgttacttacggtaaggcctgaccctacactccttcgttcc

SEQ ID NO: 394581 - DNA, 561 bp, Homo sapiens
  misc_feature: GZ8MTXP01DD73Z.17.25.C03.1.454.CMB.2.raw
  modified_base (280)..(280): a, c, t, g, unknown or other
  modified_base (413)..(413): a, c, t, g, unknown or other
  modified_base (418)..(418): a, c, t, g, unknown or other
  modified_base (425)..(425): a, c, t, g, unknown or other
  modified_base (436)..(436): a, c, t, g, unknown or other
  modified_base (465)..(465): a, c, t, g, unknown or other
  modified_base (474)..(474): a, c, t, g, unknown or other
  modified_base (506)..(506): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtgaagagccgtgggcctgagtgaaggtctcctgcaaggtcttcgtggtattctacgtttacctctatagtatcaacgtgggtncgccaggccgctggacaacgctgagtggagtgggatcggggaccaaaccctaacacgtggtgtacacgtagtcgtccttacaccctatcccgtaacgggacaagaccttaacatacgaccacgactccacaanaaacncagccanatggagtgagngcctagacagtcagacgacgacggtcctntattacggngtcgacgacgccgtaacccgagttcgtccggngaccgtccgacggcgacggtccgtcgttcgtcgtcgggacgggtccgcgggtccg

SEQ ID NO: 394582 - DNA, 557 bp, Homo sapiens
  misc_feature: GZ8MTXP01E1T7C.17.25.C03.1.454.CMB.2.raw
  modified_base (221)..(221): a, c, t, g, unknown or other
  modified_base (247)..(247): a, c, t, g, unknown or other
  modified_base (265)..(265): a, c, t, g, unknown or other
  modified_base (290)..(290): a, c, t, g, unknown or other
  modified_base (462)..(462): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcacatcactgccganagtcacgtactaaactattaatgatnagcaagaactaggaaacncccaagacctctgactctcgtggtncactccgactcgtggacgaaggtcggacctacccagtcggtagttccgaggtgctaggtgaatcgtgggacagtattacaatctacacactaccacacgtctcgactaaccgtaggagtattggacactaacttactaacgtactgtaccaacgagtatacctacgttcccngtcctacgtttcggaccggaacgggaacttaaaggttgaagtaactaacaaaacgacgttcgtcgggacttcgacctaccattccgttgtttccc

SEQ ID NO: 394583 - DNA, 579 bp, Homo sapiens
  misc_feature: GZ8MTXP01BO5AA.17.25.C03.1.454.CMB.2.raw
  modified_base (251)..(251): a, c, t, g, unknown or other
  modified_base (271)..(271): a, c, t, g, unknown or other
  modified_base (323)..(323): a, c, t, g, unknown or other
  modified_base (410)..(410): a, c, t, g, unknown or other
  modified_base (469)..(469): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcacgtttaccncctatagtatcaactgggtncgccaggccgctggacaacgacctgagtggatgggatgggacgaaccctaanacgtggtgtcacgagtcgtccttcacccatcccgtaccgggacaacggaccttaccgatcgacccacgaacctccctaccataaacncacgacctacatggattgaggagcctagacagtctagacgacgaccggcctctattacngtcgcgagcgtcccgaagttcgtccggttgaaccgtccgttaacgggccgacggtccgggtcccctttggacccgttcgggttacgggggccgttaacgggggtaacccg

SEQ ID NO: 394584 - DNA, 563 bp, Homo sapiens
  misc_feature: GZ8MTXP01BEVBM.17.25.C03.1.454.CMB.2.raw
  modified_base (223)..(223): a, c, t, g, unknown or other
  modified_base (276)..(276): a, c, t, g, unknown or other
  modified_base (300)..(300): a, c, t, g, unknown or other
  modified_base (415)..(415): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganagtcacggacttaaaacctatttaaatggtatcagcaagaaacctggaaaacnccccagacctcctgatctctggtncactccactctgacgaagtcggcctcccatcgagttccagtgcagtgaatcgtgggacagtatttcaattctacaccataccacctactctagaccaaaccgtgaggtattggtnactaatcctaacgtacttgtaccaatagtaacgttactacgtttcccctgtccttacgtttcggacccgtaagggggtaacccaaaggtttcgaagtactaacgaaaccgttcttaggtcggctcgccaccttatccttgtttaaccc

SEQ ID NO: 394585 - DNA, 602 bp, Homo sapiens
  misc_feature: GZ8MTXP01EKQFC.17.25.C03.1.454.CMB.2.raw
  modified_base (213)..(213): a, c, t, g, unknown or other
  modified_base (406)..(406): a, c, t, g, unknown or other
  modified_base (434)..(434): a, c, t, g, unknown or other
  modified_base (437)..(437): a, c, t, g, unknown or other
  modified_base (442)..(442): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctnagtgaggtctcctgcaggtcttcgtgattctacgtttacctctatagtatcaacgtgggtcgcgccgaggccgcgtcggacaacgaccgtgagtggagtgggagtcgggaccgtaaaccctaagcgttggtctcaacgtagttccgtccttacaaccccgtatccccgtaaccgggaacaagtaccttaaccntacgaacctacgactccctacaataacncancctanatggactgagcgctagacagtctcggaacgacgacggtcctacttattaccgtgtgcgtacgcgtaacccacgttacgtccggttagaccgtccgttaacggcacgggtccgtccgtttaacggaccgttcgggcggggtaacccgaagggggtaacccg

SEQ ID NO: 394586 - DNA, 541 bp, Homo sapiens
  misc_feature: GZ8MTXP01BO3XX.17.25.C03.1.454.CMB.2.raw
  modified_base (275)..(275): a, c, t, g, unknown or other
  modified_base (298)..(298): a, c, t, g, unknown or other
  modified_base (411)..(411): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacgttaaaacctatttaaatggtatcagcagaaacctggaaaacnccccagacctctgatctctggtncatccactctgcgaagtcggcgtcccatcgagttccagtggcagtgaatcgtgggacagtactttcaacttctacacctactccaccactctgacctaaccgtgaggtattgngctaatctaactactgtacaactagtacgttacctacgttcccctcgtcctacgtttcggccgtaagggtaaccttaaagttcgagaactacgaaacgttacttggtcgctcgcacttactcgttgttcc

SEQ ID NO: 394587 - DNA, 546 bp, Homo sapiens
  misc_feature: GZ8MTXP01AQLVT.17.25.C03.1.454.CMB.2.raw
  modified_base (369)..(369): a, c, t, g, unknown or other
  modified_base (432)..(432): a, c, t, g, unknown or other
  modified_base (463)..(463): a, c, t, g, unknown or other
  modified_base (529)..(529): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatggggatcggggcgaaccctaacacgtggtgtcacagtcgtcttcaccctatcccgtccggggacncgaccttacccatcgaccacgaaactccctaccaataaacacagcctacatggagttgaggancctgacatctgacacgacggcctctattacngtgacgacgcgtcccagacgtccggttgacgtcccttacggcacggcgggtccctttgacttcggnggggcccaaggggcccg

SEQ ID NO: 394588 - DNA, 561 bp, Homo sapiens
  misc_feature: GZ8MTXP01BHJK2.17.25.C03.1.454.CMB.2.raw
  modified_base (253)..(253): a, c, t, g, unknown or other
  modified_base (273)..(273): a, c, t, g, unknown or other
  modified_base (364)..(364): a, c, t, g, unknown or other
  modified_base (399)..(399): a, c, t, g, unknown or other
  modified_base (408)..(408): a, c, t, g, unknown or other
  modified_base (422)..(422): a, c, t, g, unknown or other
  modified_base (443)..(443): a, c, t, g, unknown or other
  modified_base (458)..(458): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtncgccaggccgctggacaacgacctgagtggatgggatgggacaaccctaacactggtgtcacagtcgtcttcacccatccctaccgggacncgacttaccatcgaccacgaactcctacataaacncagccctanactggatggaggancctagacagtctagaccgacncggtcctctattacngtgcgagcgtccccagttacgtcccggttgacgtcccgttacgggccttagggcccggttcctttggaccgttcggttacgggggcccgttaagggggtcccg

SEQ ID NO: 394589 - DNA, 555 bp, Homo sapiens
  misc_feature: GZ8MTXP01BLV1N.17.25.C03.1.454.CMB.2.raw
  modified_base (273)..(273): a, c, t, g, unknown or other
  modified_base (370)..(370): a, c, t, g, unknown or other
  modified_base (415)..(415): a, c, t, g, unknown or other
  modified_base (431)..(431): a, c, t, g, unknown or other
  modified_base (459)..(459): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcttatagtatcaactgggtncgccaggccgctggacaacgacctgagtggatgggatagggacgaaccctaagacgtggtgtcactagtcgtcttcaccctatcccgtaccgggacncgacttaccatcgacctacgaactccacaataaacacagacctanagtggaattgaggacncgtagacagtcgagaccgacgccgtctntagtcgtgtcgacgacgccgtaaccacgcgtcggacgacgtccgttacggcgcgggtccgtcgttcggcgttcgggcggggccgttaacgggtccg

SEQ ID NO: 394590 - DNA, 615 bp, Homo sapiens
  misc_feature: GZ8MTXP01CRH7J.17.25.C03.1.454.CMB.2.raw
  modified_base (222)..(222): a, c, t, g, unknown or other
  modified_base (278)..(278): a, c, t, g, unknown or other
  modified_base (298)..(298): a, c, t, g, unknown or other
  modified_base (303)..(303): a, c, t, g, unknown or other
tcagcgtagactagcacgaccggtgctcgatttagtagtgtagatttggggtttggggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcacatcactgccganaagtcacggtacttaaacctatttaaattggtatcagcaagaaacctaggaaaacnccccaagacctcctgatctntggtncatccactctgacgaaggtcggcctaccctagtcggtaggttcccagggtggcgtaggtggaattcgtggggactaagttactttaccaattcctaccaacctactaccaacctacctctacgacctaaaccgtggaaggtattgacgtactaacttactacgttactacgtaaccaaacgtagtaacgttaccgtacgttcccctacgtccttacgtttacgggaccgtaaggggtaaccttaaaggttgaacgtaactaacgaaaacgttacttaggtcggctcgacccacttacttcgttcgtttaacc

SEQ ID NO: 394591 - DNA, 519 bp, Homo sapiens
  misc_feature: GZ8MTXP01ERTNR.17.25.C03.1.454.CMB.2.raw
  modified_base (268)..(268): a, c, t, g, unknown or other
  modified_base (273)..(273): a, c, t, g, unknown or other
  modified_base (346)..(346): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacngggtncgaccaggccgctcggacaacgacctgagtggagtgggagtggggcccgaacccgtaacacgtggtgtacacngtgtcttcacccactcctccgggacagactaccatcgaccacgaactacctaccaactaaacacacgacctaacagtggagttagaggacgcgtgacatctgacgacacggccgtcttattacttgtgcgagcgttcccgaacgacgtccggtcgacgaccgtaacggcgaag

SEQ ID NO: 394592 - DNA, 549 bp, Homo sapiens
  misc_feature: GZ8MTXP01AW2NC.17.25.C03.1.454.CMB.2.raw
  modified_base (220)..(220): a, c, t, g, unknown or other
  modified_base (297)..(297): a, c, t, g, unknown or other
  modified_base (398)..(398): a, c, t, g, unknown or other
  modified_base (417)..(417): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcactgccganagtcacggtacttaaactatttaaatgtatcagcaagaaacctaggaaaacgcccagaccctcctgatctctggtcncactccactctggacgtaaggtcggccgtcccagtcggtaggttccaggtgcaggtgaactcgtgggactagtactttacaatctacacatcaccacttcngactaaccgtgagtattgnactaatctactactgtacaacgatacgttactaccgttccctcgtaccttacgtttcggccgtaaggggaaccttaaaggttgaatacgtaacgaaacgttacttggtggctcgacaccttatcgttgttcc

SEQ ID NO: 394593 - DNA, 544 bp, Homo sapiens
  misc_feature: GZ8MTXP01AYHH9.17.25.C03.1.454.CMB.2.raw
  modified_base (212)..(212): a, c, t, g, unknown or other
  modified_base (274)..(274): a, c, t, g, unknown or other
  modified_base (285)..(285): a, c, t, g, unknown or other
  modified_base (324)..(324): a, c, t, g, unknown or other
  modified_base (332)..(332): a, c, t, g, unknown or other
  modified_base (356)..(356): a, c, t, g, unknown or other
  modified_base (363)..(363): a, c, t, g, unknown or other
  modified_base (420)..(420): a, c, t, g, unknown or other
  modified_base (427)..(427): a, c, t, g, unknown or other
  modified_base (526)..(526): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttctggattctacgtttacctcctatagtatcaactgggtncgccaggccgntggacaacgacctgagtggatgggatgggcgaaccctanacgtggtntcacagtcgtcttcacccatcccnccgggangtactaccatcgaccacgactccaccataaacacacgcctacatggagttgaggacncctgacngtcgtgaaccgacgacggccgtactagttactgtgcgacgcgtccccagttacgtccggttgacgcccgttacggcgaggtccgtctttcgacgttcgnggggtccaaggggtcccg

SEQ ID NO: 394594 - DNA, 797 bp, Homo sapiens
  misc_feature: GZ8MTXP01DY7YU.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctcagtgaaggtctcctgcaaggtcttcgtggtattctacgttttacctcctatagtatcaacgtgggtgcgccgaggcccgcgtggaacaaccgaccgtggagtggagtggggaagtcggggaccgaaacccctaagacgtgggtcgtacacgtagttccgttcctttaccaaccccgtacgttccccgtaacccggggaactaacggtaaccctttaacccgagttaccgaacccctaaccgtaaacccttcccctaaccctaaattaaaacccacgaacgtaccccttaaacgtaagttaggggtaagtttacgggaacgggtaacgtccccgttaagggaaacccctaaggtttacccgtaacggggaaaccccgaaaccggtaccccggggttaccccgttacctttaaagtttaacccggtggttacggaccgggtaacgtaacccggttaaccccgaacggttaaccggttcccggggttagtaacccgggcccgttaaccggggcttaccggggtccccggttaccgttttcggaacccgtttcggggacgggggtaaccccgaagggggttccccgg

SEQ ID NO: 394595 - DNA, 537 bp, Homo sapiens
  misc_feature: GZ8MTXP01EQTA2.17.25.C03.1.454.CMB.2.raw
  modified_base (272)..(272): a, c, t, g, unknown or other
  modified_base (320)..(320): a, c, t, g, unknown or other
  modified_base (397)..(397): a, c, t, g, unknown or other
  modified_base (404)..(404): a, c, t, g, unknown or other
  modified_base (406)..(406): a, c, t, g, unknown or other
  modified_base (418)..(418): a, c, t, g, unknown or other
  modified_base (422)..(422): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatgtatcaactgggtncgcaggccgctggacacgacctgagtggatgggatgggcgaaccctanacgtggtgtcacagtcgtcttcgacccatcccgtaccgggacaagacttaccatcgaccacgactcctcaataaacncagccananggagtgaggacnctanacagtcgagacgacgaccgtcctattatcgtgtgacgacgcgtccagcgtccggagaccgtccgttacggcacggtccggttccttggccgttcgggcggggtccgaaggggccg

SEQ ID NO: 394596 - DNA, 573 bp, Homo sapiens
  misc_feature: GZ8MTXP01DM0MM.17.25.C03.1.454.CMB.2.raw
  modified_base (225)..(225): a, c, t, g, unknown or other
  modified_base (305)..(305): a, c, t, g, unknown or other
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccgganaagtcacggtacttaaaactatttaaattggtatcagcaagaaacctaggaaaacgccccagacctcctgatctctggtncatccactctgcgaagtcggctcccatcgaggttccaggtgcagtggaatcgtgggactagtactttcaatctacaccatcaccactctgacaacgtgacggtattgtcgactaattctaacgtactacgtacaaacagtacgttactacgttcccctcgtctacgtttcgggccgtaacgggaaccgttaaaggttgaagtaacgtaacgaaaacgttacgttaggtaacgcgttaacggacctaccttacttccttaacgtttccc

SEQ ID NO: 394597 - DNA, 600 bp, Homo sapiens
  misc_feature: GZ8MTXP01COJOA.17.25.C03.1.454.CMB.2.raw
  modified_base (224)..(224): a, c, t, g, unknown or other
  modified_base (303)..(303): a, c, t, g, unknown or other
tcagcgtagactagcacgaccggtgctcgatttagtagtgtagatttgggtttgggggaggtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganaagtcacggacttaaaacctatttaaatggtatcagacaagaaacctggaaaacgccccagacctcctgatctctggtncactccactctgcgaagtcggctcccatcgaggttccaggtggcagtggaatcgtgggacagtatttcaatctacacatcaccactctagactaaaccgttggaaggtactttgagactaaattcctaacttacgtagtacaaacgtagtaacgttacctacggtttacccctgtaccttacggttttacggcccgaaacgggggtaacccttaaagggtttcgaaacggtaactaaccgttaaaacggacgttcggtaacgggtactcggtaccacttacgttcttcggttaaccc

SEQ ID NO: 394598 - DNA, 606 bp, Homo sapiens
  misc_feature: GZ8MTXP01C63RG.17.25.C03.1.454.CMB.2.raw
  modified_base (253)..(253): a, c, t, g, unknown or other
  modified_base (274)..(274): a, c, t, g, unknown or other
  modified_base (378)..(378): a, c, t, g, unknown or other
  modified_base (444)..(444): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgttttaccncctatagtatcaacgtgggtncgccaggccgctggacaacgacctggagtggatggggatcgggacgaaccctaagacgtggtgtcacgagttcgtccttaccaccctatcccgtacccgggacncgaccttaccatcgacccacgaactccctaccaataaacacacgacctacagtggagttgaggacncctagacctagtctgaccgacgacggtcctctacttacgtgtcgacgacgtaccgtcccgacggacgtcccgggttgaccggtacccgttacgggcgttacgggtcccgggttaccttttcggacccgtttcgggacgggggtcccgaacgggggtccccgg

SEQ ID NO: 394599 - DNA, 592 bp, Homo sapiens
  misc_feature: GZ8MTXP01BRGFC.17.25.C03.1.454.CMB.2.raw
  modified_base (333)..(333): a, c, t, g, unknown or other
  modified_base (378)..(378): a, c, t, g, unknown or other
  modified_base (471)..(471): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctcgaggtgaagaagccgtggggcctcgagtgaaggtctcctgcaaggcttctggattctacgtttacctcctatagtatcaacgtgggtgcgccaggcccgctggacaacgacctgagtggagtgggatggggaccaaccctaanacgtggtgtcacgtagtcgtcttccacccatcccgtaccgggacngtactaccatcgaccacgactcctacataaacacacgcctacagtggagttgagacgctagactagtcgtacgaccgacgaccggtcccgttnttacttacgtggtgcgagtcgtccccgaacgcgtcccgggttgaccggtcccgttaacgggccacgggtccggtccctttggtaccgttccgggttcgggggcccgttaaggggtccccgg

SEQ ID NO: 394600 - DNA, 536 bp, Homo sapiens
  misc_feature: GZ8MTXP01AC2NL.17.25.C03.1.454.CMB.2.raw
  modified_base (288)..(288): a, c, t, g, unknown or other
  modified_base (299)..(299): a, c, t, g, unknown or other
  modified_base (465)..(465): a, c, t, g, unknown or other
  modified_base (495)..(495): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaggcttctggattcacgttacctcctatagtatcaactgggtncgccaggccgntggacacgacctgagtggatgggatgggcaacctacactggtgtcacagtgtcttcacccatccctcgggacagaccttacatcgaccacgactcctacataaacgacacgcctaacagtggaggttgaggacgccctgacagtcgtacgacgacgacggcccgtntaacttacgttgtcggcgagcgttccccgngacgtcccgggtgaacgccgtacgggcaacggcggttcccg

SEQ ID NO: 394601 - DNA, 604 bp, Homo sapiens
  misc_feature: GZ8MTXP01DFAUD.17.25.C03.1.454.CMB.2.raw
  modified_base (301)..(301): a, c, t, g, unknown or other
  modified_base (304)..(304): a, c, t, g, unknown or other
  modified_base (366)..(366): a, c, t, g, unknown or other
  modified_base (468)..(468): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcaacggtacgttaaaacctatttaaatggtatcagcaagaaacctaggaaaacgccccagacctcctgatctcngtncatccactctgacgaaggtcggccgtacccagtcggaggtttccaggtggcagtggaatcgngggacagtattcaatctcaccatcaccactctgacaactgaggtattgtagacaatctactactagtaacaaacgtagtaacgttacctacgtttacccccncggtaccttaccgttttcgggaccggtaaacgggggtaaacccttaaaaggtttgaaacggtaaacttaccgaaaaacggttacttacgggttaacggcttaacggaccctaacccgttattccggttcgtttccc

SEQ ID NO: 394602 - DNA, 531 bp, Homo sapiens
  misc_feature: GZ8MTXP01AU8IV.17.25.C03.1.454.CMB.2.raw
  modified_base (276)..(276): a, c, t, g, unknown or other
  modified_base (299)..(299): a, c, t, g, unknown or other
  modified_base (399)..(399): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaatggtatcagcagaaacctggaaaacnccccagacctctgatctctggtncatccactctgcgaagtcggctccatcgagttccagtgcagtgaatcgtgggacagtattcaatctacaccatcaccactctgacaacctgagtattganactaatcctaactactgtacaacagtacgttacacgttcccctgtcctacgtttcggaccgtaaggggtaaccttaaaggttgagtaactaacgaaacgttacttggtggactgccaccttatccttgttcc

SEQ ID NO: 394603 - DNA, 589 bp, Homo sapiens
  misc_feature: GZ8MTXP01C47MD.17.25.C03.1.454.CMB.2.raw
  modified_base (278)..(278): a, c, t, g, unknown or other
  modified_base (289)..(289): a, c, t, g, unknown or other
  modified_base (295)..(295): a, c, t, g, unknown or other
  modified_base (300)..(300): a, c, t, g, unknown or other
  modified_base (428)..(428): a, c, t, g, unknown or other
tcagcgtagactagcacgaccggtgctcgatttagtagtgtagatttggggtttggggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcactgccggacaagtcacggacgttaaaactatttaaatggtatcagcaagaaacctggaaaacncccagacctcngatctntggtncactccactcgtgacgtaaggtcggcctacccagtcggtacggttccaggtggcaggtggaatcgtgggactagtactttacaatcctacaccataccacctactctagaccaacgtgagtattgganactaatacttacgtactagtacaacgtaagtacgttacctccgttcccctcgtaccgtacgtttcgggaaccggtaacggggaaaccttaaaggttaggaacgtaactaacgttaaacgttacttgggtaacgctaacgacctacttattcgttcgtttcc

SEQ ID NO: 394604 - DNA, 523 bp, Homo sapiens
  misc_feature: GZ8MTXP01D6G4X.17.25.C03.1.454.CMB.2.raw
  modified_base (250)..(250): a, c, t, g, unknown or other
  modified_base (270)..(270): a, c, t, g, unknown or other
  modified_base (320)..(320): a, c, t, g, unknown or other
  modified_base (364)..(364): a, c, t, g, unknown or other
  modified_base (400)..(400): a, c, t, g, unknown or other
  modified_base (453)..(453): a, c, t, g, unknown or other
  modified_base (460)..(460): a, c, t, g, unknown or other
  modified_base (476)..(476): a, c, t, g, unknown or other
  modified_base (482)..(482): a, c, t, g, unknown or other
  modified_base (516)..(516): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaggcttctggattcacgtttaccncctatagtatcaactgggtncgccaggccgctggacaacgacctgagtggatgggatgggcaaccctaanacgtggtgtcacagtcgtccttcacccatcccgtacccgggacngaccttaccatcgaccacgaactcctacaataaacncacgcctacatgggattgaggagcctagacatctggaccgtacgaccggcctntattacngtgcgagcgtcccagntccggngacgcttacgggcaggcggtcttgcttgcgggcngggtccg

SEQ ID NO: 394605 - DNA, 635 bp, Homo sapiens
  misc_feature: GZ8MTXP01CBQ4C.17.25.C03.1.454.CMB.2.raw
  modified_base (210)..(210): a, c, t, g, unknown or other
  modified_base (332)..(332): a, c, t, g, unknown or other
  modified_base (371)..(371): a, c, t, g, unknown or other
  modified_base (421)..(421): a, c, t, g, unknown or other
  modified_base (486)..(486): a, c, t, g, unknown or other
  modified_base (498)..(498): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaggtctcctgcaaggcttctggtattcacgtttacctctatagtatcaactgggtgcgccaggccgctggacacgacctggagtggatgggatcggggacaacccgtaacacgtggtntcacgagtcgtcgttcaccctatcccgtaccggggaacnggtacctttaacccattcgacccaacgtaacctccctaccaagtaaaccncaacgcctacagtggagttgaggacgcctagactacgtctacggacgaccgacgggtccccgttntaagtttaccgngttgaccggagtaccggtcccctaaggttcgttccggggttacgaacggtcccgttaacgggcgttacgggtcccggttcccttttaacgggacccgtttccgggttacggggggaaccccttaaggggggtccccg

SEQ ID NO: 394606 - DNA, 661 bp, Homo sapiens
  misc_feature: GZ8MTXP01DMOC2.17.25.C03.1.454.CMB.2.raw
  modified_base (211)..(211): a, c, t, g, unknown or other
  modified_base (274)..(274): a, c, t, g, unknown or other
  modified_base (329)..(329): a, c, t, g, unknown or other
  modified_base (441)..(441): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctnagtgaaggtctcctgcaaggcttctggattctacgtttacctcctatagtatcaacgtgggtncgccaggccgctggacaacgacctgagtggatgggatcggggactaaaccctaanacgttggtgtcacgagttcgtccttcaaccccattcccgtaacccgggaactaacgtacctttaacccatcgaacccaacgaaactccctacaataaacacacgaccctaanacgtaggagttagaaggacgaccgtgaaccagttcgtacgaaccgaccgaccgggtcccttacgtacttttaaccgtggttacggacggaacgtaaccggttccccgaaacggttcgttccgggttacggaaaccgtccggttaaccggggcttaacggccgggtttcccgttttcggtacccggtttcgggttacgggggcccggaagggggtccccgg

SEQ ID NO: 394607 - DNA, 690 bp, Homo sapiens
  misc_feature: GZ8MTXP01ET4IM.17.25.C03.1.454.CMB.2.raw
  modified_base (225)..(225): a, c, t, g, unknown or other
  modified_base (281)..(281): a, c, t, g, unknown or other
  modified_base (307)..(307): a, c, t, g, unknown or other
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcaccatcacttgccganaagtcacgtacgttaaaactatttaaagtgtatcagacaagaaacctaggaaaacnccccaagacctcctgatctcgtggtncatccatctggacgaagtcggcctccagtcggagttccaggtgcagtggaactcgtggggactaagtactttacaaattcctacaacctactaccaaccctacttcctagaacccgtaaaccgtggtaaagggttactttaggacgtaactaaacttaccctttaaacgttaaccgtttaacggtaaccaaaacgttaaacgtaacggttttaaccctaacccggtttcccccttacgtacccgtttaccgttttaccggggaacccggtaaacgggggtaaacccgttaaaagggtttaggaacggtaaacttaaccgaaaaacggttacgttacggggttcgactccgggttaaccacccgttatccgtttaacgtttccc

SEQ ID NO: 394608 - DNA, 573 bp, Homo sapiens
  misc_feature: GZ8MTXP01BAFN4.17.25.C03.1.454.CMB.2.raw
  modified_base (278)..(278): a, c, t, g, unknown or other
  modified_base (301)..(301): a, c, t, g, unknown or other
  modified_base (395)..(395): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacttaaaacctatttaaatggtatcagcaagaaacctggaaaacnccccagacctctgatctctggtncatccatctgacgaagtcggcgtcccagtcgaggttccaggtggcaggtggaatcgtgggactagtatttcaatctacaccactcacactctanacaaccgtgacgtattgtacgactaattcctacgtactagtaccaacgtagtacgttaccgaccgttcccctcgtaccttacgtttcggaccggtaagggggtaaaccttaaaggttagacgtaactacgaaaacgttcgttaggtcggactcgacacccttattccgttcgttaacc

SEQ ID NO: 394609 - DNA, 536 bp, Homo sapiens
  misc_feature: GZ8MTXP01D8TJ4.17.25.C03.1.454.CMB.2.raw
  modified_base (210)..(210): a, c, t, g, unknown or other
  modified_base (250)..(250): a, c, t, g, unknown or other
  modified_base (322)..(322): a, c, t, g, unknown or other
  modified_base (365)..(365): a, c, t, g, unknown or other
  modified_base (427)..(427): a, c, t, g, unknown or other
  modified_base (454)..(454): a, c, t, g, unknown or other
  modified_base (500)..(500): a, c, t, g, unknown or other
  modified_base (519)..(519): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaggtctcctgcaaggcttctggattcacgtttaccnctatagtatcaactgggtgcgccaggccgctggacaacgacctgagtggagtgggatgggacgaaccctaanacgtggtgtcacagtcgtccttcacccatcccgtaccgggacngaccttaccatcgaaccacgaactcctaccaataaacacagacctacagtggagttgaggancctagacagtctagacacacgtccgtntattactgtgcgagcgtcccaagacgtcggttgacgccttacgggnacggcgtccttgcttcggnggggcccgaagggcccg

SEQ ID NO: 394610 - DNA, 626 bp, Homo sapiens
  misc_feature: GZ8MTXP01CZMU0.17.25.C03.1.454.CMB.2.raw
  modified_base (222)..(222): a, c, t, g, unknown or other
  modified_base (271)..(271): a, c, t, g, unknown or other
  modified_base (295)..(295): a, c, t, g, unknown or other
  modified_base (403)..(403): a, c, t, g, unknown or other
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcacatcactgccganagtcacggtacttaaactattaaatggtatcagcagaaactaggaaacnccccagacctctgatctctggtcncactccactctgacgtaagtcgggcctacccagtcggaggttccaggtggctaggtggaattcgtggggactaggttactttacgaatcctacaccctatccaacccnctctacgaccaaaccgtggaaggtattcgtagactaagttcctacttacgtgtaaccaaacgtacgttaaccgttacccgtaccgtttaccccctcgtaccgtttacggtttacgggacccgggtaaagggggtaaacccttaaagggtttcgaaacggtaaactacgaaaaaccgttcgttcggtaacggacttcggaccctacgttacttcttaacgttcc

SEQ ID NO: 394611 - DNA, 551 bp, Homo sapiens
  misc_feature: GZ8MTXP01CWWDJ.17.25.C03.1.454.CMB.2.raw
  modified_base (221)..(221): a, c, t, g, unknown or other
  modified_base (275)..(275): a, c, t, g, unknown or other
  modified_base (300)..(300): a, c, t, g, unknown or other
  modified_base (358)..(358): a, c, t, g, unknown or other
  modified_base (383)..(383): a, c, t, g, unknown or other
  modified_base (387)..(387): a, c, t, g, unknown or other
  modified_base (402)..(402): a, c, t, g, unknown or other
  modified_base (424)..(424): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctggtgggggtcagagtcaccatcacttgccganaagtcacggacttaaaactatttaaatggtatcagcaagaaacctaggaaaacnccccaagacctcctgatctctggtncactccactctgacgaagtcggcctcccagtcgtagttccaggtggcaggtgaatcgnggacagtattcaatctcacatcacnctcngacactgagtattgnactaatctactactgtacaaanagtaacgttactacgttcccctgtaccttacgtttcgggaccgtaaggggaaaccttaaaggttcgaagtaactaacgaaaacgttacgttggtaaggtctaacgcctacttacttcgttcgtttcc

SEQ ID NO: 394612 - DNA, 629 bp, Homo sapiens
  misc_feature: GZ8MTXP01EWAXH.17.25.C03.1.454.CMB.2.raw
  modified_base (222)..(222): a, c, t, g, unknown or other
  modified_base (300)..(300): a, c, t, g, unknown or other
  modified_base (339)..(339): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcacatcacttgccgganaagtcacggtacttaaaactatttaaatggtatcagcaagaaacctaggaaaacgccccagacctctgatctctggtncatccactctgcgaagtgcgtccatcgagttccagtgcngtgaatcgtgggacagtatttcaatctacaccatcaccactctacgactaaaccgtgtaaggtattaggactaactaaacttaccttaacggttaacgttacgttaaccaaactaacggttaacgtttaacctaaccggtttccccctacgtaccttaaccggttttcggaaccgggtaaacgggggtaaacccttaaagggtttacgaaaggtaacttaaaccgaaaacggttaaccgttgggtaacgggtccttaaggacccaccgttaacgttcccttgtttaaccc

SEQ ID NO: 394613 - DNA, 572 bp, Homo sapiens
  misc_feature: GZ8MTXP01A6ECI.17.25.C03.1.454.CMB.2.raw
  modified_base (224)..(224): a, c, t, g, unknown or other
  modified_base (279)..(279): a, c, t, g, unknown or other
  modified_base (308)..(308): a, c, t, g, unknown or other
  modified_base (403)..(403): a, c, t, g, unknown or other
  modified_base (407)..(407): a, c, t, g, unknown or other
  modified_base (421)..(421): a, c, t, g, unknown or other
  modified_base (448)..(448): a, c, t, g, unknown or other
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatcgacccagtctccatcctccctgtctgcctctggtgggggtcagagtcaccatcacttgccganagtcacggtacttaaaacctatttaaatggtatcagcaagaaacctaggaaaacnccccaagaccctctgacttctcgtggtcncatccatctggacgtaaggtcggcctcccagtcggtaggttccaggtggcaggtggaactcgtgggactagtatttcaatctacactactcaccnctcnactaacctggagtntgtcactaactctactactgtaccaanagtacgttacctacgttcccctcgtcctacgtttcggccgtaacggggtaaacttaaaggttacgaagtaacgtaacgaaaccgttagttcggtcggctcgaccaccgttattccttcgttccc

SEQ ID NO: 394614 - DNA, 582 bp, Homo sapiens
  misc_feature: GZ8MTXP01BJ3PO.17.25.C03.1.454.CMB.2.raw
  modified_base (210)..(210): a, c, t, g, unknown or other
  modified_base (251)..(251): a, c, t, g, unknown or other
  modified_base (330)..(330): a, c, t, g, unknown or other
  modified_base (338)..(338): a, c, t, g, unknown or other
  modified_base (373)..(373): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaaggtctctgcaaggcttctggattctacgtttaccnctatagtatcaacgtgggtgccgccgagggccgctgggaccaacgacctgagtggagtgggatcggggacaacccctanacgtggtntcactgtcgtccttcacccatcccgtaccgggacncgacttaccatcgaccacgaactcccacactaaaccacagacctacacgtaggtaggttacggaggacgtccgtagaacgctacgtaggaccgacgtacggccgtacttattaccgtgtcgcgagtccgtaaccacggactccgggttgacgccgttacggcgagcccggttacttcgaccgttcgttacgggggccgcggggtaaccg

SEQ ID NO: 394615 - DNA, 542 bp, Homo sapiens
  misc_feature: GZ8MTXP01AUJCI.17.25.C03.1.454.CMB.2.raw
  modified_base (333)..(333): a, c, t, g, unknown or other
  modified_base (407)..(407): a, c, t, g, unknown or other
  modified_base (419)..(419): a, c, t, g, unknown or other
  modified_base (425)..(425): a, c, t, g, unknown or other
  modified_base (449)..(449): a, c, t, g, unknown or other
  modified_base (475)..(475): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatgtatcaactgggtgcgccaggccgctggacaacgacctgagtggatgggatgggacaaccctacactggtgtcanagtcgtcttcacccatcccgtaccgggacaacgacttaccatcgaccacgaactccacataaacacagccctanatgagtgagacnctgacngtctagacgacacggctctatacngtgcgagcgtcccacgacgtccgggngacgtcccgttagggcttacgggccggtcctttcggacctttcggcggggtcccgaaggggtcccgg

SEQ ID NO: 394616 - DNA, 694 bp, Homo sapiens
  misc_feature: GZ8MTXP01C2QU8.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacatgtcgcccactcccaggtgcagctggtgcagtcgtggggctggaggtagaagaacgccgtggggcctcgagtgaacggtcctccgtgacgtaaggtcttcgtggtacttctaacgtttacacttacctaatagtatacgtaacgtgggtacgccgccgacggcccgagtacggaaaccaacgtaccgtaggagtagggaagtaggggagttacggggaacccgaaaccctaagacgttggtacgtaccgaaccgtaggttcgttccctacccacccgtaacgtccccgtaaccgggaactaacgtaacccttaacacgtacgaaccaccgtaacctacctaccaaactaaacacacgaccttacgagtagggtagtagacggtacgaccgttggactaacgtacgtacggaaccgaccgtacccggtcgttacctagttaacgtgacgtacggaacgtacgcccgtaaacgccgttcggtacgaaccgccgttacggaaccggtgtcccggttacgtcgttaccgtcgggttaacgggaaccgg

SEQ ID NO: 394617 - DNA, 910 bp, Homo sapiens
  misc_feature: GZ8MTXP01C1L34.17.25.C03.1.454.CMB.2.raw
  modified_base (212)..(212): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggctnagtgaaggtctcctgcaaggcttctggattcaccgtttacctcctatagtatcaactgggtgcgacaggccgctggacaacgacctggagtggagtggggatcgggggaccgtaaacccctaacgacgttggtacgttaccacgtacggttcggttccctttaccaacccccgtacgttacccccgtaacccgggggtaacctaacggttaaaccctttaaaccccgaaacgtttaccggaaaccccctaaacccgggtaaacccttccccctaaacctaaaacttaaaaaacccggacccaaacggtaccccttaaacgtaaggttacgggggtaaacgtttgggaacggggttaaacccgtacccgttaacgaaacccgttaacggttaccccggtaaccggggaaaaccccggtaaccccgggtaaccccgggggttaaccccgttttaaccgtttaaacggttttacccggttacggggttaaccggggaaacccggtaaacccggggtaaaccccgggttaacccccggtaaacgggttacccgggtttacccggggacggttaaccccgggtaaccccggttaaccggggcccggttaacccggggttccccgggtttacccgttttaacgggtaccccggggtttccgggggttacccggggggtaacccgggttaacgggggtaaccccg

SEQ ID NO: 394618 - DNA, 596 bp, Homo sapiens
  misc_feature: GZ8MTXP01A949S.17.25.C03.1.454.CMB.2.raw
  modified_base (223)..(223): a, c, t, g, unknown or other
  modified_base (281)..(281): a, c, t, g, unknown or other
  modified_base (305)..(305): a, c, t, g, unknown or other
  modified_base (414)..(414): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganaagtcacggtacgttaaaacctatttaaattggtatcagcaagaaacctaggaaaacnccccagaccctctgatctctggtncactccactctgcgaagtcggcctccagtcgaggttccaggtgcagtgaatcgtgggacagtattacaatctacaccactcacctactctgaccaacctgagtatggtnacaattctactactagtacaacgtagtaacgttacctaccgtttaccccgtcgtaccttacgttttaccgggaccggtaacgggggtaacccttaaaggtttacgaacgtaactaaccgaaaacggttacgttacgggtcggtcgtaacggtacctaaccttacttccgttcggtttaaccc

SEQ ID NO: 394619 - DNA, 546 bp, Homo sapiens
  misc_feature: GZ8MTXP01DMJ0K.17.25.C03.1.454.CMB.2.raw
  modified_base (208)..(208): a, c, t, g, unknown or other
  modified_base (349)..(349): a, c, t, g, unknown or other
  modified_base (364)..(364): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggctnagtgaggtctctgcaggctctggattcacgtttacctctatagtatcaacgtgggtgcgccaggccgctggacaacgacctggagtggatgggatcgggacgaaccctaagacgtggtctcacgtagtcgtccttcacccnctcccgtccgggacngtactacatcgaccacgactcctcaataacacacgacctacgatcggtagttgagacgcctagactatcgtacggaaccgacgacggtccctattacgttactggtcgacgagcgtcccagttcgacgttcggtgcgaccgttcgcgcggcggtcctttgccgttcggtcgggcccgaaggg

SEQ ID NO: 394620 - DNA, 585 bp, Homo sapiens
  misc_feature: GZ8MTXP01DMEYC.17.25.C03.1.454.CMB.2.raw
  modified_base (269)..(269): a, c, t, g, unknown or other
  modified_base (370)..(370): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggctcagtgaggtctcctgcaggcttctggattcacgtttacctctatagtatcaacgtgggtnccgccaggccgcgtggacaacgacctggagtggagtgggatcgggacaaccctaacacgtggtgtcactagtcgtccttacacccatcccgtaccgggacngaccttaccatcgacccacgaacctccctacaataaacacagcctacagtggagttggaggtacgcctagactagtcgtaggaaccgacgaccggtccgtcttacttacgtgtcgtacgacgtcgtaacccacgacgtcccgggttcgacgtccgttaccggcgacggtccggtccgtttcggtacgtcgggttacggggccgaacggggtcccg

SEQ ID NO: 394621 - DNA, 548 bp, Homo sapiens
  misc_feature: GZ8MTXP01ASAJA.17.25.C03.1.454.CMB.2.raw
  modified_base (224)..(224): a, c, t, g, unknown or other
  modified_base (385)..(385): a, c, t, g, unknown or other
  modified_base (402)..(402): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccgganaagtcacggtacgttaaaactatttaaatggtatcagcaagaaacctggaaaacgccccagacctctgatctctggtgcatccatctgcgaagtggctccatcgaggttcagtgcagtggaatcgtgggacagtatttacaatctacacatcaccactctnacaactgaggtattggnactaaatctaacgtactagtacaaacagtacttactacgttcccctgtctacgtttcggaccgtaaggggaaccaaaggttgaagtaaacttaacgaaaacgaaccgttggtaacgggctcgcctacccttaatcttcgtttaacc

SEQ ID NO: 394622 - DNA, 546 bp, Homo sapiens
  misc_feature: GZ8MTXP01CJO7B.17.25.C03.1.454.CMB.2.raw
  modified_base (304)..(304): a, c, t, g, unknown or other
  modified_base (410)..(410): a, c, t, g, unknown or other
  modified_base (532)..(532): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcaacggtacttaaaacctatttaaatggtatcagcaagaaacctggaaaacgccccaagaccctctgatctctggtncatcccatctgacgaagtcggctccatcgagttccaggtgcagtgaatcgtgggacagtatttcatctacacatcacctactctgactaacgtggaggtattggtnacaattctactactgtacaacgagtactacgtcttaccctcgtccttacgttcggccgtaaacggggtaaccaaaggtttcgaagtaactacgaaaacgttacttcggtgtctcgcaccttnttcgttcgttaacc

SEQ ID NO: 394623 - DNA, 650 bp, Homo sapiens
  misc_feature: GZ8MTXP01CVUBI.17.25.C03.1.454.CMB.2.raw
  modified_base (333)..(333): a, c, t, g, unknown or other
  modified_base (428)..(428): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctctatagtatcaacgtgggtgcgccaggccgctacggacaacgcctgagtggacgtgggatcggggaccaaaccctaacncgtggtcgtacatagtcgtccttacaccctatcccgtaccgggacaacgtaccttaccagtcgaacccacgtaacctcccacctaaataaaaccncaacgaccttaagacgtgggtacgttaggacgtacgcctagacacgtcgtaggaaccgacgtaccggtccttacttaacgttacgtggtcgacggtaacgccggtaacccgtaacggttacggtcccgggttagaacccggtccgttaaccgggccgacgggtcccggttaccgtttcggtaccgttcggggttccggggaaccggttaacggggtccccgg

SEQ ID NO: 394624 - DNA, 586 bp, Homo sapiens
  misc_feature: GZ8MTXP01DWIWG.17.25.C03.1.454.CMB.2.raw
  modified_base (213)..(213): a, c, t, g, unknown or other
  modified_base (254)..(254): a, c, t, g, unknown or other
  modified_base (455)..(455): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttctggattcacgtttaccnctatagtatcaactgggtgcgccaggccgctggaccaacgacctgagtggatggggatggggaccaaaccctaacgacgttggtcgtacacagttcgtccttcacccctatccccgtaccgggaacaagtaccttaaccatcgaacccacgaactccctaccaaataaaccacacgcctaacagtcggtagttggaggacnccgtagaccaagtcgtagaaccgacgaccggtcctatacgttactgtcgacgagaccgtcccacgttagtcccggttgacgtcccgttacgcagtccggtactttggccttggcggggccgaaggggtccg

SEQ ID NO: 394625 - DNA, 621 bp, Homo sapiens
  misc_feature: GZ8MTXP01EHQQY.17.25.C03.1.454.CMB.2.raw
  modified_base (231)..(231): a, c, t, g, unknown or other
  modified_base (291)..(291): a, c, t, g, unknown or other
  modified_base (447)..(447): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagcgtgggcctnagtgaggtctcctgcagcttctggtattctacgttacctcctatagtatcaacgtgggtnccgccgaggcccgcgtggaaccaacgcctggaggttggagtgggatcgggaccgaacctaacacgttggtcgtaccacgtagtcgtcctaccaccctacgtcccgtacgggacacgtaccttacatacgaccacgtaacctcctaacaactaaacnctacgacctaacagtggtagggttacgagggactcgtagactacgtcgtacgaccgtaccgaccgtccgtcttaattaccgttgtacggacgtaacggtacccgttaccgacggttaccgtaaccgggtcgaaccggtacccggtaccggcgtaaccggttcccggtttaaccg

SEQ ID NO: 394626 - DNA, 725 bp, Homo sapiens
  misc_feature: GZ8MTXP01DMCSS.17.25.C03.1.454.CMB.2.raw
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgttttacctctatagtatcaacgtgggtgcgccaggccgctaggacaacgacctgagtggagtgggagtcgggaccgaaacccgtaacacgttggtcgtacacgtacgtccgttccttaccgaacccctacttccccgtaaccccgggggaactaacggtaaaccctttaaccccgaagttaccggaaaccccaaccggtaaaccttcccctacctaaacttaaaaccaccaacgtacccttaacaagttaggggtaagttaggaagggacgtaccgtagaacctacggttcgtacggaaaccgaacccgaccggggtcccttacgttaagtttaccgtggtcggacgtaggaccggttaaccccaacgggttacgttccggggttcgaacggtcccgttacgggccgttaacggggtcccggttcccgtttttcgggaccgtttccgggttacgggggcccggaacgggggtccccg

SEQ ID NO: 394627 - DNA, 620 bp, Homo sapiens
  misc_feature: GZ8MTXP01AUXCE.17.25.C03.1.454.CMB.2.raw
  modified_base (275)..(275): a, c, t, g, unknown or other
  modified_base (472)..(472): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaacgtgggtncgccaggccgctggacaacgacctgagtggatgggatcggggacaaccctaacacgtggtcgtcacgagtcgtccttcacccatcccgtaccgggactcgactaccatcgaccacgacctcctacaataaaccacacgaccctagacgttggacgttggaaggtacgcctagacccagtccgtacgaaccggaaccnccggggtcccttacttacgtttaaccgtggttcggacgtacgtaaccggtccccaacgggttacgtccccgggttagacgtcccgttacgggcacgggcccgttcgtttcgacgttccgggttcggggcccgttaagggggtaacccg

SEQ ID NO: 394628 - DNA, 555 bp, Homo sapiens
  misc_feature: GZ8MTXP01BNT4P.17.25.C03.1.454.CMB.2.raw
  modified_base (219)..(219): a, c, t, g, unknown or other
  modified_base (279)..(279): a, c, t, g, unknown or other
  modified_base (290)..(290): a, c, t, g, unknown or other
  modified_base (329)..(329): a, c, t, g, unknown or other
  modified_base (439)..(439): a, c, t, g, unknown or other
  modified_base (475)..(475): a, c, t, g, unknown or other
  modified_base (500)..(500): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcccccagcagctacaagtgcccactcccaggtgcagctggtgcagtcgtggggctggaggtgaagaagccgtggggcctnagtgaaggtctcctgcaggcttctggtattctacgtttacctctatagtatcaatgggtncgccaggccgntggacaacgcctgagtggatgggatgggcaaaccctaancgtggtctcatagtcgtcttcacccatcccgtacccgggacaagacttaccatcgaccacgaacctccctacaactaaacacacgccctaacgagtggagttggaggtancctagaccagtctgaccacgacggccgtctattacngtgacgagacgtcccagcgtccggngacgcgttacggcacggcggtcctttgacgtcggttcggggccgttaaggggccg

SEQ ID NO: 394629 - DNA, 557 bp, Homo sapiens
  misc_feature: GZ8MTXP01BSBGL.17.25.C03.1.454.CMB.2.raw
  modified_base (308)..(308): a, c, t, g, unknown or other
  modified_base (366)..(366): a, c, t, g, unknown or other
  modified_base (415)..(415): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcaccatcacttgccggacaagtcacggtacttaaaactatttaaatggtatcagcaagaaacctaggaaaacgccccaagaccctcctgacttctctggtncactccactctgaccgaagtcggcctcccagtcgagttccaggtggcagtggaatcgngggacagtattcaattctacaccatcaaccactctgactaacgtgagtnttgcactaatcctacgtactgtacaacagtacgttacacgttcccctgtccttacgtttcgggaccgtaaggggtaaccttaaaggttagagtaactaacgaaacgttcttggtcgctcgacctacttacttcgttcgttcc

SEQ ID NO: 394630 - DNA, 714 bp, Homo sapiens
  misc_feature: GZ8MTXP01ET62P.17.25.C03.1.454.CMB.2.raw
  modified_base (527)..(527): a, c, t, g, unknown or other
  modified_base (590)..(590): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtgggcctcagtgaaggtctcctgcgaaggtcttcgtggtattcctacgttttacctcctaatagtatacaacgtgggtcgccgccgaacggcccggtcgtcggaaccaaccggacctggaaggtgggagttagggggaacttcgggggaccgtaaaacccctaaacgtacgttgggtacgttacaaacgacggttaccgttccttaccaaccccgtaacgttccccggtaacccgggaactaacggtaaccctttaacccgaagttaccggaaccctaaacccgaaaccttaccctaccaaaactaaaaccacacgaccctanaacgtggtagtgaagcgcctagacctagtctacgacgaccgaccggtccttactaatttacgngtacggacgaacgtaccggtccccaacggacgttccggttcgaaaccggcccgttaacgggcttacggtcccgggttccttttcggaaccgtttcgggacggggtaacccgaagggggtccccg

SEQ ID NO: 394631 - DNA, 570 bp, Homo sapiens
  misc_feature: GZ8MTXP01ARP7N.17.25.C03.1.454.CMB.2.raw
  modified_base (341)..(341): a, c, t, g, unknown or other
  modified_base (373)..(373): a, c, t, g, unknown or other
  modified_base (420)..(420): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaggcttctggattcacgtttacctctatagtatcaacgtgggtgcgccgaggccgctggacaacgcctggagtggatgggagtcgggaccgaaccctaacacgtggtgtcanagttcgtcttcaccctatcccgtaccgggacncgacttaccatcaccacgtaactccctacataaaccgcacgacctanacgtaggagttgaggactctagacagtcgtcgaccgacgacgtccgtactattacgtgtgcgagccgtcccgacgttacgtccgttaggcgtccgttacggcgacggtccgtaccgttgtaccgtcgggttcgggccgttaacgggcccg

SEQ ID NO: 394632 - DNA, 559 bp, Homo sapiens
  misc_feature: GZ8MTXP01AB4Y5.17.25.C03.1.454.CMB.2.raw
  modified_base (417)..(417): a, c, t, g, unknown or other
  modified_base (430)..(430): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaaggcttctggattcacgtttacctcctatagtatcaactgggtgcgccaggccgctggacaacgacctgagtggatgggatgggacaaccctaacacgtggtgtcacaggttcgtccttcaccctatcccgtaaccgggacaagactaccatcgaccacgaactccacaataaacacagcctanatggagttgagancctagactatcgtgaccgacgaccggccgttctaagttacctggtcgcgaacgcgtcccagacgtccggttagacgccgttacggcacggtccggtccttggaccttcggaggggcccgaagggtcccg

SEQ ID NO: 394633 - DNA, 584 bp, Homo sapiens
  misc_feature: GZ8MTXP01DB4EQ.17.25.C03.1.454.CMB.2.raw
  modified_base (357)..(357): a, c, t, g, unknown or other
  modified_base (459)..(459): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctgagtgaaggtctcctgcaaggcttcgtggtacttctaccgtttacctcctatagtatcgaacgtgggtcgcgaccagggcccgcgtaggaaccaacggtacctggacgtggagtgggatggggaccaaacccgtaagacgtggtntcacgtagtcgtccttcaccctactcccgaacgggacaacgtacttaaccatcgaaccacgaacctccctacaataaacacacgctacagtgataggagacnctagacagtcgtagacacgaccggctctattacgtgtgacgacgctcccagccgtcggttagaccgccgttacgcgttacggtcgtccgttcggtaccgttcggcggggtccgaagggggtcccg

SEQ ID NO: 394634 - DNA, 630 bp, Homo sapiens
  misc_feature: GZ8MTXP01D4LT2.17.25.C03.1.454.CMB.2.raw
  modified_base (276)..(276): a, c, t, g, unknown or other
  modified_base (419)..(419): a, c, t, g, unknown or other
  modified_base (447)..(447): a, c, t, g, unknown or other
tcagcgtagactagcacgaccggtgctcgatttagtagtgtagatttgggtttggtgaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtctcctgcaaggcttctggattctacgtttacctcctatagtatcaacgtgggtncgccgaggcccgcgtcggaacaaccgactggagtgggagtgggatcggggaccaaaccctacacgtggtcgtcacgtagtcgtctcaccctatcccgtccgggaacagtacttaccatcgaccacgacctcccacaataaacncacgccttaagagtggagtcggaagtcnccgtagactacgttcgacggaccgaacgccggtccgttattaaacgttcgtcggtacggaccgacggtaacccgtaccccgacgggtacgttcccgggtaggacccgttcccggttaacggccgtaacggtccgggttccgttttcgacccggtttcgggtccggggggaaccgaaccggggg

SEQ ID NO: 394635 - DNA, 581 bp, Homo sapiens
  misc_feature: GZ8MTXP01CJPHN.17.25.C03.1.454.CMB.2.raw
  modified_base (225)..(225): a, c, t, g, unknown or other
  modified_base (308)..(308): a, c, t, g, unknown or other
  modified_base (487)..(487): a, c, t, g, unknown or other
  modified_base (570)..(570): a, c, t, g, unknown or other
tcagcgtagactagcacgaccggtgctcgatttagtagtgtagatttggggtttggggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcacatcacttgccgganaagtcaacggtacttaaaactatttaaatggtatcagacaacgaaacccggaaacgccccaagacctctgactctcgtggtcncaactccctactcgtgacgtaagtcggccgtcccagtcggtaggttcaggtggctaggtggactcgtagggaacagtattcaatctacacactacacctactctacgaccaacgttggacggttattggacactaattctaactacgtagtacaactaggtacttaccaccgtttcccncgtacttacgtttcggaccgtaaggggtaacctaaaggttgaaacgactaaacgaacttacgttgttacgctacgctaccgtnttctcgttctc

SEQ ID NO: 394636 - DNA, 533 bp, Homo sapiens
  misc_feature: GZ8MTXP01BVFB6.17.25.C03.1.454.CMB.2.raw
  modified_base (219)..(219): a, c, t, g, unknown or other
  modified_base (294)..(294): a, c, t, g, unknown or other
  modified_base (364)..(364): a, c, t, g, unknown or other
  modified_base (373)..(373): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcacatcacttgccganagtcacggacttaaacctatttaaatggtatcagcagaaacctggaaaacgccccagacctcctgatctctggtncatccatctgcgaagtcggctcccatcgagttcagtgcagtggaatcgtggacagtatttcaatctcacntcaccatcngacaactgagtatgtgctaatctactactgtaccaactagtacgttacacgtttcccctgtcctacgttttcgggcgaagggggtaaccttaaaggttcgaagtacttaaccgaaaacggttacttggtggacttcggctacccttattccttggttccc

SEQ ID NO: 394637 - DNA, 600 bp, Homo sapiens
  misc_feature: GZ8MTXP01CWYZ8.17.25.C03.1.454.CMB.2.raw
  modified_base (225)..(225): a, c, t, g, unknown or other
  modified_base (426)..(426): a, c, t, g, unknown or other
  modified_base (433)..(433): a, c, t, g, unknown or other
  modified_base (475)..(475): a, c, t, g, unknown or other
  modified_base (504)..(504): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagacgtcacatcacgtcgaccganaagtcgacggtaacttaaaacttatttaaagttggtatacagacaaacgaaacgtaggaaaacctcccaacgtaccctctagtattcctcgtggtcacactcctacgtcgtggacgagtcggcctacctagtcggtacggttccgaggtcgcgtaggtaggtaacttacgtgggaactagttacttacaatcctacaactntaccacncgtcacacaacgtgagtacttgatacctaattcctatacgtnaaccaagtgtaacctacgtccttacccgntaccgttacgtacggacgaacggtaacttaagtgaaacgtaacgtacgttaaacgttgttcgggaactactaacgactacttcgttcgttcgttcc

SEQ ID NO: 394638 - DNA, 717 bp, Homo sapiens
  misc_feature: GZ8MTXP01BNT7S.17.25.C03.1.454.CMB.2.raw
  modified_base (210)..(210): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaaggtctcctgcaggcttctggtattcacgtttacctcctatagtatcaacgtgggtgcgccaggccgctggacaacgacctggagtggagtggggatcggggaccgaaaccctaacacgtggtcgtcacgaggttcgttccttacaacccctagttccccgtacccggggaactaacggtaaacctttacccgattacggaacccctaaccgtaaacccttccctaacccaaacttaaaaccaaccacgtaccctaaacgaacgttagggtaaggtttacgggaagggacgtacccgttaggaacctacgggttaccgttagggaacccgtaaccggaccgggtaccccgttactttaacgtttaaccggtggttcggaccggtaacggtaccgggttaaccccgaacggttacgttcccgggttagaccggtccgttacgggccacgggtccggtcctttcggaccgtttcggggacgggggtccgaacggggtaacccgg

SEQ ID NO: 394639 - DNA, 616 bp, Homo sapiens
  misc_feature: GZ8MTXP01ED9A8.17.25.C03.1.454.CMB.2.raw
  modified_base (211)..(211): a, c, t, g, unknown or other
  modified_base (267)..(267): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctnagtgagtctctgcagcttctggattcacgtttacctctatagtatcaacgtgggtncgccaggccgctaggacaacgacctggagtggagtgggatcggggaccgtaaaccctaacgacgttggtcgtcacgtagtccgttccttaccaccctatccccgtaaccgggacaacgtaccttaccatcgacccacgacctccaccaactaaacacacgacctaacagtaggtagttaggaggacgcctagaacacgtcgtaggaaccgaccgacgtccgttacttagttactgtcgacgtacgacgtcccgacgttcgtccgggttagaccgtcccgttacggccgacgggtcccggttaccgtttcggtaccgttcggttacgggggtcccggaacggggtcccgg

SEQ ID NO: 394640 - DNA, 526 bp, Homo sapiens
  misc_feature: GZ8MTXP01ELX6P.17.25.C03.1.454.CMB.2.raw
  modified_base (498)..(501): a, c, t, g, unknown or other
  modified_base (503)..(526): a, c, t, g, unknown or other
tcagcgtagactagcacgaccggtgctcgatttagtagtgtagatttgggtttgggagggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaactgaggattgtgcatctacactgtcaaacagagttacacgttacccctcgctacgtttttcggccggagggaaccctaaagttagagtactaacgaaaactaacgttaggtgacgtcgaccccacctaattcgttcttcccttaactaactttcccgttcccgacctacttctacgtaaccgttacgtacccgtaacgtccgttggaacgggcgggtcgttagggaaccgaagggccggaaacagagnnnngnnnnnnnnnnnnnnnnnnnnnnnn

SEQ ID NO: 394641 - DNA, 576 bp, Homo sapiens
  misc_feature: GZ8MTXP01AUPEM.17.25.C03.1.454.CMB.2.raw
  modified_base (223)..(223): a, c, t, g, unknown or other
  modified_base (276)..(276): a, c, t, g, unknown or other
  modified_base (303)..(303): a, c, t, g, unknown or other
  modified_base (344)..(344): a, c, t, g, unknown or other
  modified_base (413)..(413): a, c, t, g, unknown or other
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctcctgtctgcctcgtggtgggggtcagagtcaccatcacttgccganagtcacggtacttaaactatttaaatggtatcagacaagaaacctaggaaacnccccaagaccctctgactctcgtggtncactccactctgacgagtggcctccatcgagttcaggtgcngtgaatcgtgggactagtattacaatcctacaacctatccacctactcgtcgactaacgtgagtatgtnactatctacgtatcgtaccaagtacgtaacgttcctacccgttcccctgtaccttacgtttacgggaccgtaaacggggtaaccttaaagggttcgaaacgtactaaacgaaaccggttcgttaggtccggtactccgacctaccgttacttccgttcgttcc

SEQ ID NO: 394642 - DNA, 568 bp, Homo sapiens
  misc_feature: GZ8MTXP01BIDWC.17.25.C03.1.454.CMB.2.raw
  modified_base (253)..(253): a, c, t, g, unknown or other
  modified_base (272)..(272): a, c, t, g, unknown or other
  modified_base (325)..(325): a, c, t, g, unknown or other
  modified_base (372)..(372): a, c, t, g, unknown or other
  modified_base (405)..(405): a, c, t, g, unknown or other
  modified_base (429)..(429): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccnctatagtatcaactgggtncgccaggccgctggaacacgacctgagtggatgggatcggggacaaccctaanacgtggtcgtcacgagtcgtccttcaccctatcccgtaccgggaacngacttaccgatcgaccacgactccacataaacncacgcctacatggagttgagtacncctgaacagtcgtagaccgacgaccggcctcgtacgttactgtcgacgagccgtcccgagacgttccggttgaccgtccgttacggcgacggcccggtcctttcgtacgttcgggttcggggccgttaacggggtcccg

SEQ ID NO: 394643 - DNA, 591 bp, Homo sapiens
  misc_feature: GZ8MTXP01BIJ41.17.25.C03.1.454.CMB.2.raw
  modified_base (390)..(390): a, c, t, g, unknown or other
  modified_base (423)..(423): a, c, t, g, unknown or other
  modified_base (431)..(431): a, c, t, g, unknown or other
  modified_base (445)..(445): a, c, t, g, unknown or other
  modified_base (454)..(454): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcaaggtcttcgtggtattctaccgttttacctccttaatagtatcaacgtgggtgcgccgaggccgctggacaacgacctggagtggagtgggatcggggaccaaaccctagacgtggtctcacgagttccgtcctcacccactccctaaccgggacncgacttaccatcgacacgactccacaataaacncagcctanagtggactgacggncctagaccngtcgtagaccgacgccgtcgtcttagttacgtgtacgcgacgtccgtcccgacgttacgttcccgggagaccgccgttacgggcacgggtccgtcccgtttaagccgttggccgggggaacccgttggggtaacccg

SEQ ID NO: 394644 - DNA, 590 bp, Homo sapiens
  misc_feature: GZ8MTXP01A2GH4.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacagtcacggtacttaaaacctatttaaatggtatcagcaagaaacctaggaaaacgccccagacctcctgactctgtggtgcatcccactcgtgccgaaggtcggccgtacccagtcggaggttcccaggtggcaggtggaatcgtgggactagtatttcaatctacaccatcaccactctcgacaacctggaggtattgtagactaacttccttaacgtactagtaacaaactagtacgttactaccgttcccctcgtccttacgttttacgggaccgtaaacggggtaacccttaaagggttagaaacgtactaaccgaaaacgttacgttggtaaggctaacgccaaccttatccgttcgttccc

SEQ ID NO: 394645 - DNA, 653 bp, Homo sapiens
  misc_feature: GZ8MTXP01EZZZT.17.25.C03.1.454.CMB.2.raw
  modified_base (232)..(232): a, c, t, g, unknown or other
  modified_base (287)..(287): a, c, t, g, unknown or other
  modified_base (309)..(309): a, c, t, g, unknown or other
  modified_base (315)..(315): a, c, t, g, unknown or other
  modified_base (380)..(380): a, c, t, g, unknown or other
  modified_base (404)..(404): a, c, t, g, unknown or other
tcagcgtagactagcacgaccggtgctcgatttagtagtgtagatttggggtttggggggagtcagtctcagtcaggacacagcatggacatgagggtccccgctcagctcctggggctcctgctactctggctccgagctgccagatgtgacatccagatcgacccagtcctccactccctccctgtctcgcctcgtggtgggggtcagagtcaccatcacttgaccgganagtcacggtacttaaaactatttaaatggtatcagacaagaaacctaggaaaacnccccaagaccctctgtactctntggtcncatccactcgtaggacgtaggtcggctcccagtcggtagttccaggtggctaggtggaacttcgngggaactagtactttacaattccncaacctatacccacctactcgtacgacctaacgtgggtacggtatttggactaactaacttaccttaacgttacgtactaacctaaacgtacggtaacctttacccgtaccgtttccccgtcgttaccttacggtttccgggaaccggtaaacgggggaaccttaaaggttagacgtaaacgtaaaccgaaacggttacgttgggtccggtcttaaccggacctacccttagttcctttcggttaaccc

SEQ ID NO: 394646 - DNA, 600 bp, Homo sapiens
  misc_feature: GZ8MTXP01DAHIN.17.25.C03.1.454.CMB.2.raw
  modified_base (223)..(223): a, c, t, g, unknown or other
  modified_base (302)..(302): a, c, t, g, unknown or other
  modified_base (410)..(410): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatcctcctgtctgcctcgtggtgggggtcagagtcacatcacttgccgganaagtcacggtacttaaaactatttaaatggtatcagcaagaaacctggaaaacgccccaagacctcctgatctctggtncactccactctggacgtaaggtcggccgttcccagtcggaaggtttccaggtggctaaggtggaaatcgtggggaactagtaatttcaactctacaccataccaaccntcgtagacctaaacgtggaaggtattggacacaaatttcctaacttacgttgaaccaaacaggtaaacgtttaccaccggtttacccctgtaccttacgtttcggacccgtaagggggtaaaccttaaagggtttacgaagtaactacgaaaacgttgttggtgactgacaccttattccgttgttaacc

SEQ ID NO: 394647 - DNA, 554 bp, Homo sapiens
  misc_feature: GZ8MTXP01CAD01.17.25.C03.1.454.CMB.2.raw
  modified_base (271)..(271): a, c, t, g, unknown or other
  modified_base (326)..(326): a, c, t, g, unknown or other
  modified_base (367)..(367): a, c, t, g, unknown or other
  modified_base (400)..(400): a, c, t, g, unknown or other
  modified_base (402)..(402): a, c, t, g, unknown or other
  modified_base (407)..(407): a, c, t, g, unknown or other
  modified_base (455)..(455): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcacgtttacctcctatagtatcaactgggtncgccaggccgctggacaacgacctggagtggatgggatggggacgaaaccctaancgtggtgtcacagtcgtcttcacccatcccgtaccgggacngacttaccatcgaccacgaactccacataaacnancctanatggatgagacgcctagacagtctgaccgacgacggcgtctattacgngtcggacgacgacgtccccgaacgttagtcccgggttagacgccgttacgggcacggtccgggtccttggtcgttcgttgggggtcccaaggggtcccg

SEQ ID NO: 394648 - DNA, 661 bp, Homo sapiens
  misc_feature: GZ8MTXP01ERY4L.17.25.C03.1.454.CMB.2.raw
  modified_base (389)..(389): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctctatagtatcaacgtgggtgcgccaggccgcgtggacaacgacctgagtggagtgggatcggggaccgaaacccctaacgacgttggtgtacacgtagttcgtccttacacccctatccccgtacccggggaacncggtaacctttaccagttacgaacccaacgaacctccctaccaaataaaccacacgcctaagacgtggtagttgaggacgcctagacatcgtagaaccgacgaccggtcccgttacttagttaccgtggtacgaccggtaacgtaccgtccccaacggttacgttcccggggttgaccggtaccccgttacggggcccacgggtcccggggttacccttttcgggtaccgtttccggggacggggggtaaccccgttaaagggggtccccgg

SEQ ID NO: 394649 - DNA, 585 bp, Homo sapiens
  misc_feature: GZ8MTXP01C7KQ7.17.25.C03.1.454.CMB.2.raw
  modified_base (212)..(212): a, c, t, g, unknown or other
  modified_base (273)..(273): a, c, t, g, unknown or other
  modified_base (324)..(324): a, c, t, g, unknown or other
  modified_base (371)..(371): a, c, t, g, unknown or other
  modified_base (408)..(408): a, c, t, g, unknown or other
  modified_base (413)..(413): a, c, t, g, unknown or other
  modified_base (422)..(422): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggctnagtgaggtctcctgcaaggcttcgtggattctacgtttacctctatagtatcaagtgggtncgccaggccgctggacaacgactgagtggagtgggatgggacaaccctaanacgtggcgtcactagtccgtccttcacccgatcccgtaaccgggacncgaacttaccatcgaacccaacgaacctccctacaanaaacncacacctanatggatgagagcctagacagtctagacgaacgcgtccgtacttagttacgtgtcgacgacgtaccgtcccgaacgttacgttccgggagacgacccggttacggccgttacggccggttcctttcggaccgtttcgggacgggggtcccgaagggggtccccg

SEQ ID NO: 394650 - DNA, 614 bp, Homo sapiens
  misc_feature: GZ8MTXP01CO6W4.17.25.C03.1.454.CMB.2.raw
  modified_base (349)..(349): a, c, t, g, unknown or other
  modified_base (394)..(394): a, c, t, g, unknown or other
  modified_base (476)..(476): a, c, t, g, unknown or other
  modified_base (481)..(481): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggctcgagtgaggtctctgcaggcttctggattctacgtttacctctatagtatcaacgtgggtgccgccgaggccgctggaaccaacgacctggacgtgggagtgggatcgggggaccaaacccgtaacgacgttggtntccgacgtaggttccgtcttccaccctactcccgtaacgggaacncgtaccttaccgatcgaacccacgtaacctccctactaactaaaccacacgcctacagtcggagttagaggcgtctagaacncgtcncgtaccgacgccggtccgtactattaccgtgtcgacgagccgtccgacgacgtccggttcgacggtccgttacgggcttacggtcccggtccgtttcggtaccgttcggacggggtccgaacgggggtccccg

SEQ ID NO: 394651 - DNA, 693 bp, Homo sapiens
  misc_feature: GZ8MTXP01E28PJ.17.25.C03.1.454.CMB.2.raw
  modified_base (255)..(255): a, c, t, g, unknown or other
  modified_base (495)..(495): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggtattcacgttttaccnctatagtatcaacgtggtcgcgcaggccgctggacaacgctgagtggatgggatcgggaccgaaaccctaacacgtgggtctacacgagttcgtccttacaacccagtcccgtaccggggaactaacggtaacctttaaaccacgttacggaaacccctaacggtaaacctcccctaccaaaacttaaaaaccaccgaagaccccttaacgaagttagggaaggtttacggaaggggacnccttaggacctaattcgtagaaccgacgaaacccggtccggttaccttaattaccgtaggtcgacggaagaaccggttaaccccaacggttaacgttcccggggaggaaaccgttcccgttaacggggcaaccgggtccggggtacccttttggaaccgttttcggaccggggggtaaccccaagggggtaaccccgg

SEQ ID NO: 394652 - DNA, 581 bp, Homo sapiens
  misc_feature: GZ8MTXP01ACOYU.17.25.C03.1.454.CMB.2.raw
  modified_base (273)..(273): a, c, t, g, unknown or other
  modified_base (323)..(323): a, c, t, g, unknown or other
  modified_base (366)..(366): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctcctatagtatcaactgggtncgccaggccgctggacaacgcctgagtggatgggatgggacaaccctaanacgtggtgtcactagtcgtcttcacccatcccgtaccgggacngacttacccatcgaccacgaactcctaccaataaacacagcctacacgtggtagttcgaaggacgcccgtagacaacggttctaggaccgaccgaccgggtaccttctaattaccgtgtcgcgacggcgtccccagacgtccgggttacgacgtcccgttacgggcacgggtcccggtctttcggaccgtttcgcgggggcccaagggggtcccg

SEQ ID NO: 394653 - DNA, 576 bp, Homo sapiens
  misc_feature: GZ8MTXP01D7RZD.17.25.C03.1.454.CMB.2.raw
  modified_base (271)..(271): a, c, t, g, unknown or other
  modified_base (320)..(320): a, c, t, g, unknown or other
  modified_base (511)..(511): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcacgtttacctctatagtatcaactgggtncgccaggccgatggacaacgacctgagtgatggatgtgcgaaaccctanactggtgcactagtcgtcttacaccctatcccctccgggaactacgaccttaccatcgaaccacgaaacctcctacaactaaacacagacctaacatgggtagtgagacgccctagactactctacgaacgacgtaccggccgttacttactacgtgtcgccgagtaaccgtcccgaagtccgttaccggngtacggttcccgcggacgcggtccggttccgtttacgtcgttcgggtcgggaaccggtaacgggg

SEQ ID NO: 394654 - DNA, 567 bp, Homo sapiens
  misc_feature: GZ8MTXP01C7NYA.17.25.C03.1.454.CMB.2.raw
  modified_base (326)..(326): a, c, t, g, unknown or other
  modified_base (369)..(369): a, c, t, g, unknown or other
  modified_base (408)..(408): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatcggggacaaaccctaanacgtggtgtacacagtcgtcttcacccatcccgtaccgggacngactacatacgacccacgaactccctacaataaacacanacctaacagtggtagttgagtacgcctagactagtctacgacgacgacgccgtactattacgtgtgcgacgacgtcccgacgttacgtcccggttgacgtccgttacgggcacggtccggtaccttcgtacgttcggttcggggtccgaaggggtcccg

SEQ ID NO: 394655 - DNA, 656 bp, Homo sapiens
  misc_feature: GZ8MTXP01CGGBI.17.25.C03.1.454.CMB.2.raw
  modified_base (515)..(515): a, c, t, g, unknown or other
  modified_base (558)..(558): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggtcttcgtggattctaccgttttacctctatagtatcaagtgggtgccgccgacggccgcgtacggaacaacgacctggagtggagtgggagtcgggaccgtaaaccctaacgacgttggtcgtacgacgtaggttccgttccttacgaccccgtactaccccgttacccggggaactaacggtaaccctttaacccgagttaccggaacccctaaccgtaaaccctacccttaccaaactaaaccacacgtaccctaagacgtgggtagttggaacggacncctagacagtcgtaggaccgacgaccggtcctactattaccgngtacgacgtacgcgtaacccctaggacgtccgggagaccgcgttaacggcgacggtccgtcgttcgtaccggtcggacggggtccgaacggggtcccg

SEQ ID NO: 394656 - DNA, 653 bp, Homo sapiens
  misc_feature: GZ8MTXP01BWBH2.17.25.C03.1.454.CMB.2.raw
  modified_base (215)..(215): a, c, t, g, unknown or other
  modified_base (277)..(277): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctnagtgaaggtctcctgcgagcttcgtggattcacgtttacctcctatagtatcaacgtgggtnccggccgagggcccgcgtacggaaccaacgccgtaggaggtggagtggggaagtcgggaccaaacccgtaagacgtggtactcaacgtgtcgtccttacacccctagtcccgtaccgggacaagaccttaccatacgaccacgacctacctacaactaaaccacgacacctacagtggtagtagaggacgcctagacacgtctaggaaccgacgacggtcctactagttaaccgtgtcgacgacgaccgtaacccgaacgttacgtcccggttaggaacccggtcccgttaacgggccgaccgggtcccgggttcccgttttcggaacccggtttccgggttacggggggtaacccccgttaagggggtcccccgg

SEQ ID NO: 394657 - DNA, 633 bp, Homo sapiens
  misc_feature: GZ8MTXP01B14Q2.17.25.C03.1.454.CMB.2.raw
  modified_base (210)..(210): a, c, t, g, unknown or other
  modified_base (270)..(270): a, c, t, g, unknown or other
  modified_base (368)..(368): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaaggtctcctgcaggcttctggattcacgtttacctctatagtatcaacgtgggtncgccaggccgctaggacaacgacctgagtggatgggatcgggaccaaaccctaagcgtggtctacacagtcgtccttcacccatcccgtaccgggacngacttacatcgaaccacgaacctcctacaataaacacagaccctagagtggagttgaggtacgcctagactatcgtagacgacgacccggctacgtaattacgtgtcggacgaacggtcctaaccccgaacgttcgttaccccgggagaaaccgggtcccgttaaaccggggccgttaaccggggtccccgggttacccgttttaacggaacccgggttttccgggttaccggggggtaaccccggttaaacgggggtccccggg

SEQ ID NO: 394658 - DNA, 590 bp, Homo sapiens
  misc_feature: GZ8MTXP01B7C8S.17.25.C03.1.454.CMB.2.raw
  modified_base (210)..(210): a, c, t, g, unknown or other
  modified_base (250)..(250): a, c, t, g, unknown or other
  modified_base (270)..(270): a, c, t, g, unknown or other
  modified_base (322)..(322): a, c, t, g, unknown or other
  modified_base (369)..(369): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaggtctcctgcaggcttctggtattcacgtttaccnctatagtatcaacgtgggtncgccaggccgctggacacgacctgagtggatgggatggggaccaaccctaanacgtggtgtacagtagtcgtccttcaccctactcccgtaccgggacncgtaccttaccatcgaccacgactccctaccaataaaccacacgacctaacagtcggagttggaggtacgcctagacctgtcgtaggaccgacgaccgtcccgttaccttagttaccgtggtcgacgtacgccgtcccgagttacgtccggttaggaccgtccgttacggcttacggccggttcctttggtccgttcggcggggtcccgaacggggtcccg

SEQ ID NO: 394659 - DNA, 536 bp, Homo sapiens
  misc_feature: GZ8MTXP01ANFEP.17.25.C03.1.454.CMB.2.raw
  modified_base (251)..(251): a, c, t, g, unknown or other
  modified_base (272)..(272): a, c, t, g, unknown or other
  modified_base (328)..(328): a, c, t, g, unknown or other
  modified_base (360)..(360): a, c, t, g, unknown or other
  modified_base (394)..(394): a, c, t, g, unknown or other
  modified_base (527)..(527): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcacgtttaccncctatagtatcaacgtgggtnccgcaggccgctggacaacgctgagtggatgggatgggacaaccctaacaatggtntcacagtcgtccttcacccatcccaccgggancgacttaccatcgaccacgaactccacataaacncacgccacatggattgagtgccagtacagtctgaacgacgtaccggcgtctactacgtgtcgcggagcgtcccgagacgtcccgggttgaaccggcttacggcacggtcgtcccttgaccgttcgcggggccnggggtcccg

SEQ ID NO: 394660 - DNA, 664 bp, Homo sapiens
  misc_feature: GZ8MTXP01BVQND.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtgacagcagctacaagtgcccactcccaggtgcagctggtgcagtcgtggggctggaggtgaagaagccgtggggcctcgagtgaacggtctcctgcaaggtcttcgtggtatttctacgtttacctcctatagtatcaagtggtgccgcaggccgcgtggaccaacgacctggagtggagtgggagtcggggacctaaaccctaagccgttggtacgtacacgtagttccgttccttaccgacccctattccccggtaccgggaacaacgtacctttaacccgatccgaacccaaccgtaacctccctacccaaattaaaaccacgtacgtaccctaagtacgtagggtagtaggacgacgccctagactagtcgtaggaaccgacgaccggtccgtacttattaccgtgtcggacgacgtaccgtcccgaacgttcggtcccggttagaccggtaccgttacgggcgacggtccggttaccgttcggtacccgttcggggttacggggtcccgaagggggtccccg

SEQ ID NO: 394661 - DNA, 587 bp, Homo sapiens
  misc_feature: GZ8MTXP01CU5TO.17.25.C03.1.454.CMB.2.raw
  modified_base (488)..(488): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttcgtggattcacgtttacctctatagtatcaactgggtgcgccaggccgctggacaacgacctgagtggagtgggatggggaccaaccctaacacgtggtcgtccacagtccgtccttcacccagttccccgtaacccgggacaacgtacctttaacccagttacgacccacgtaaacctccctaccaaactaaaccactacgaccctaacagtcgggtagttcggaggagcctagaccagtctagacgacncggccgttctattacgtgtgacgagacgtcccaggactccgggttagacgccgttacggcacggtcgtcctttgcgttcggcggggtccgttggggccg

SEQ ID NO: 394662 - DNA, 619 bp, Homo sapiens
  misc_feature: GZ8MTXP01BO9G4.17.25.C03.1.454.CMB.2.raw
  modified_base (224)..(224): a, c, t, g, unknown or other
  modified_base (278)..(278): a, c, t, g, unknown or other
  modified_base (302)..(302): a, c, t, g, unknown or other
  modified_base (359)..(359): a, c, t, g, unknown or other
  modified_base (393)..(393): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgccgganagtcacggtacttaaaactatttaaatggtatcagcaagaaacctaggaaaacnccccaagacctctgatctctggtncactccactctgacgaagtcggccgtccatcgaggttccaggtggcaggtgaatcgngggacagtatttcaatctacacatacaccactcncgacaaccgtgaggtattgagactaataccttaacttactagtaaccaacgtaacgtacgttacctaccgtttcccctcgtccgttaaccgttttcgggacccggtaaacgggggtaaaccttaaaagggtttcgaaagtaaacgttaaccgttaaaaacggttaccttacgggtaacgggtaccttaacggaccctaaccgttactttcgttaaccgtttaaccc

SEQ ID NO: 394663 - DNA, 615 bp, Homo sapiens
  misc_feature: GZ8MTXP01BL3FN.17.25.C03.1.454.CMB.2.raw
  modified_base (253)..(253): a, c, t, g, unknown or other
  modified_base (379)..(379): a, c, t, g, unknown or other
  modified_base (429)..(429): a, c, t, g, unknown or other
  modified_base (443)..(443): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacncctatagtatcaactgggtgcgccaggccgctggaacaacgacctggagtggagtgggatcgggacaacccgtaacacgtggtcgtcacgtagtcgtccttccaccctactcccgtacccgggacncgtaccttaccatcgacccacgaactccctacaataaaccacacgcctanacgtgagtgagganccgtagactagtcgtacgaccgacgaccggtccgttactacgtttacctggttacgacgtacgtccgtaacccaacggcgtacccgggttgaccggtaccgttaccggcgttacggtccggttccgtttaacggtaccgttcgggttcgggggaaccgaagggggtccccgg

SEQ ID NO: 394664 - DNA, 830 bp, Homo sapiens
  misc_feature: GZ8MTXP01CK6G3.17.25.C03.1.454.CMB.2.raw
  modified_base (213)..(213): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctnagtgaaggtctcctgcaaggcttctggattcacgtttacctcctatagtatcaacgtgggtcgcgccgaggtcccgcgtacggaacaaccgtacctggaggtggagtggggagtcgggggacctaaaccccgtaacgacgttggtcgtaccacgtacggttccgttccttaccgaaccctacgtaccccggtaacccggggaaactaacggtaaccctttaaacccgaacgttacccggaaccccaaaccggtaaacccttccccctaaacccgtaaaacttaaaaacccaaccgtaacggtaccccttaaacgtaacggttaggggtaaccggtttaggaacgggaaccgtacccgttacggaacctaacggttccgttaacgggaacccgaaccggtacccgggtcccttacgtttaacgtttaacgttcggtacggtaccggtaacggtacccggtaacccccgtaacggttaaccggtttcccgggacggtaacccggtacccggttaaccggggcccggttaaaccgggttcccgggttacccgttttaacgggtaacccggtttccggggttaccggggggaaccccggttaacgggggttaacccccggg

SEQ ID NO: 394665 - DNA, 540 bp, Homo sapiens
  misc_feature: GZ8MTXP01CKZT1.17.25.C03.1.454.CMB.2.raw
  modified_base (148)..(148): a, c, t, g, unknown or other
  modified_base (289)..(289): a, c, t, g, unknown or other
  modified_base (298)..(298): a, c, t, g, unknown or other
  modified_base (336)..(336): a, c, t, g, unknown or other
  modified_base (342)..(342): a, c, t, g, unknown or other
  modified_base (368)..(368): a, c, t, g, unknown or other
  modified_base (414)..(414): a, c, t, g, unknown or other
  modified_base (426)..(426): a, c, t, g, unknown or other
  modified_base (446)..(446): a, c, t, g, unknown or other
  modified_base (451)..(451): a, c, t, g, unknown or other
  modified_base (455)..(455): a, c, t, g, unknown or other
  modified_base (476)..(476): a, c, t, g, unknown or other
  modified_base (486)..(486): a, c, t, g, unknown or other
  modified_base (505)..(505): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctnttcttggtggcagcagctacaagtgcccactcccaggtgcagctggtgcagtctggggctgaggtgaagaagcctggggcctgagtgaaggtctctgcaaggcttctggattcacgttacctctatagtatcaactgggtncgcaggccntggacaacgctgagtggagtggatgggacaacctaacnctggtntcacaagtgtccttcacccattcccncgggacacgacttaccatacgaccacgaactccctacaactaaacnccagaccctaanagtggagttagaagggaccncgtanactntcgacgacgacgccgtccgtntaacttacgngtacgcgagtcgttaccgngttacgtccggtagcgccgtaggctcggccgttcg

SEQ ID NO: 394666 - DNA, 561 bp, Homo sapiens
  misc_feature: GZ8MTXP01AS42V.17.25.C03.1.454.CMB.2.raw
  modified_base (301)..(301): a, c, t, g, unknown or other
  modified_base (393)..(393): a, c, t, g, unknown or other
  modified_base (436)..(436): a, c, t, g, unknown or other
  modified_base (538)..(538): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcacatcactgccgacagtcacggtacttaaaacctatttaaatggtatcagcaagaaacctaggaaaacgccccaagaccctctgatctctgggtcncactcccactcgtgaccgaagtcggcgtccagtcgtagtccaggtggcagtggaatcgtggcagtatttcaattcacaacatccacactcgnacaaccgtgaggtatgtagactaatctactactgtaccaaagngtaacgttacaccgtttcccctagtaccgtacgtttcgggaaccgtaacgggggtaaccttaaaggttcgaagtaacgtaacaaacgttacttggaacgtcncgacctacttacttcgttcgtcc

SEQ ID NO: 394667 - DNA, 707 bp, Homo sapiens
  misc_feature: GZ8MTXP01BO7K6.17.25.C03.1.454.CMB.2.raw
  modified_base (278)..(278): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctcgagtgaaggtctcctgacaggtcttctggattcgtacgtttacctctatagtatcaacgtgggtncgccgaggccgcgtggacaacgaccgtgagtggatggggatcggggacctaaaccctaagacgttggtgtacagacgtcgtccttacaccctacgtcccgtaccggggaactaacgtaccttaaccactaccgaaccctaacgtaaaccttcccctaccctaaactaaaaccaaccaacgtacctaacacgtaggtagttaggacggaacgccgtagacactacgtacgaaccgaccgaccggtcccgttacttaacgttacgttccccgttggtacggtaccggtaacggttaaccccgaacggttccggttaccgggttaccggaccggtacccggttaaccgggccgttaccgggtaacccgggttcccgttttaacggtacccggttccgggttaccgggggcccgggttaacggggtccccggg

SEQ ID NO: 394668 - DNA, 648 bp, Homo sapiens
  misc_feature: GZ8MTXP01CF9AV.17.25.C03.1.454.CMB.2.raw
  modified_base (577)..(577): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagagcgtgggctgagtgaggtctcgtgacaggtcttcgtggtattcgtacgtttacctctatagtatcaacgtgggtgccgccgacgggccgcgtacggaacaacggacctggaggtggacgtgggagtcgggaccgaaaccctaacgcgtggtcgtaccacgtgttcccgtccttacaccccgtacgtcccggtaaccgggaacaacgtaacccttaaccaagtacccgaacccaacgtaaacctccctaactaaactaaacactacgacctacgagtacggagttacgaggactacgagaccagtcgtacgaccgacgtaccggtccgtactacttacgtgtcgacgtacgaccgttcccgaaagttcgttacggnggaccgtccgttacgggcacgggtccggttccgtttggtaccgttcgggcggggccgaagggtaaccccgg

SEQ ID NO: 394669 - DNA, 578 bp, Homo sapiens
  misc_feature: GZ8MTXP01BRTUG.17.25.C03.1.454.CMB.2.raw
  modified_base (271)..(271): a, c, t, g, unknown or other
  modified_base (418)..(418): a, c, t, g, unknown or other
  modified_base (433)..(433): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgccaggccgctggacaacgacctgagtggatgggatggggacaaccctaacacgtggtgtcacagtcgtccttcaccctatccccgtaccgggacaagtaccttaccatcgaccacgaactccctaccaataaaccacagccctanagtggagttgaggcncctagacctagtcgtacggaccgacgaccgggtccctacttattaccgtgtcgcgtaggcgtccccaggactcccgggttgacgtccgttacgggcacgggtcccggtcctttggaccttgggttcggggccgttaagggcccgg

SEQ ID NO: 394670 - DNA, 650 bp, Homo sapiens
  misc_feature: GZ8MTXP01CS0WV.17.25.C03.1.454.CMB.2.raw
  modified_base (460)..(460): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattctacgtttacctctatagtatcaacgtgggtgcgccaggccgctggacaacgctgagtggagtgggatcggggacaaaccctaacacgtggtgtcacgagtcgtccttacacccactcccgtaccgggacaagtaccttaccacgtcgacccacgtaacctccctaccaaactaaacacacgacccttaagacgttgggtaagttggaaggggtaacnccttagaacctaggttccgtaggaacccgaaccggaccggtacccgttacgttaacgtttaccgtggttacgcggtaacgtaccgtaaccccgaaggttaccgtcccgggttggaaccgccggttacggcgttacggtccggtaccgtttcgtaccgtttcgggacggggtccgttaacgggggtccccg

SEQ ID NO: 394671 - DNA, 655 bp, Homo sapiens
  misc_feature: GZ8MTXP01BNQ7G.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaggcttctggattctacgttttacctcctatagtatcaacgtgggtgccgccgaggcccgcgtacggaacaacgaccgtggagtgggagtgggagtcggggaccgaaaccctaacgacgtggtgacacgagttcgtccttcaaccctactcccgtaacccgggacaacgtaccttaccatcgaacccacgaactaccctaccaaataaaccacacgacctagtagtacgggtaaggttcggaacgacgtccctaaggaccctattccgtaacggacccgaaccgtaacccggggtccgtactttacgttacgtggtcggacgtaacggacgtaaccccgacggttaccgttccgggagtccggacccttacgggcttacgggccttcgttcgaccgttcgggacggggccgttaaggggtcccg

SEQ ID NO: 394672 - DNA, 579 bp, Homo sapiens
  misc_feature: GZ8MTXP01A8VZG.17.25.C03.1.454.CMB.2.raw
  modified_base (307)..(307): a, c, t, g, unknown or other
  modified_base (368)..(368): a, c, t, g, unknown or other
  modified_base (419)..(419): a, c, t, g, unknown or other
  modified_base (451)..(451): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacaagtcacggtacttaaaacctatttaaatggtatcagcaagaaacctggaaaacgccccaagaccctcctgatctcgtggtcncactccactcgtgacgaaggtcggccgtcccagtcgagttccaggtggcaggtggaatcgngggacagtatttcaatctacaccatcacactctcgacaacctgagtattgnactaatctaactactgtacaacagtacttacncgttacccctgtaccttacgtttcggaccggtaaggggtaacccttaaagggttacgaagtaaacgtaaccttaaaacggacttacggtgggtcttaacggaccacccttagttccgttgtttaaccc

SEQ ID NO: 394673 - DNA, 692 bp, Homo sapiens
  misc_feature: GZ8MTXP01ATODP.17.25.C03.1.454.CMB.2.raw
  modified_base (279)..(279): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagacgccgtgggcctgagtgagtctctgcaggtcttcgtgtacttctacgtttacctactatagtactcgacgtgggtcnccgccgaggccgtcgtacggaaccaacgccgtggagtcgggagtggggacgtcgggacctaaaccctaacgtggttggtcgtacacgtacggttccttccttaccacccgtacgtcccgtaaaccgggactaacgtacctaaccacgtaccgaacctaccgtaacctaccctaacaaactaaaccacaccgtacctagtacggtaggtagtacggacgacgtacagtacacggtcgaacggaaccaccggtaaccgtccggttacttaacgttaccgtggtacggacggtaccggtacccgtccgaacgttcgggtcccggttacgaaccggttcccggacggcgttcccgggttccggtttcgttccgttaccgggttccgggttcggggaacccggttaacgggtccccgg

SEQ ID NO: 394674 - DNA, 563 bp, Homo sapiens
  misc_feature: GZ8MTXP01A7PYH.17.25.C03.1.454.CMB.2.raw
  modified_base (222)..(222): a, c, t, g, unknown or other
  modified_base (278)..(278): a, c, t, g, unknown or other
  modified_base (302)..(302): a, c, t, g, unknown or other
  modified_base (405)..(405): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctgactccgagctgccagatgtgacatccagatgacccagtctccatcctccctgtctgcctctggtggggtcagagtcaccatcacttgccgganaagtcacggtacgttaaaacctatttaaatggtatcagcaagaaacctggaaaacnccccagacctcctgatctctggtncatccactctgcgaagtggcctccatcgagttccaggtgcagtggaatcgtgggacagtatttcaatctacaccatcaccactctgacaacctgaggtattgngacaattctaactactgtacaacgtagtacgttacacgttcccctgtccttacgtttcggccgtaaggggaaccttaaaggttcgaacgtaacgtaacgaaaaccgttacgttcgggttggccttaacggacctaacccgttattccttaagtttccc

SEQ ID NO: 394675 - DNA, 605 bp, Homo sapiens
  misc_feature: GZ8MTXP01EA1YQ.17.25.C03.1.454.CMB.2.raw
  modified_base (254)..(254): a, c, t, g, unknown or other
  modified_base (409)..(409): a, c, t, g, unknown or other
  modified_base (420)..(420): a, c, t, g, unknown or other
  modified_base (449)..(449): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagcgtggtgcaggtcgtggggctggaggtgaagagccgtgggcctcgagtgaaggtctccgtgacaaggtcttcgtggtacttntaccgtttacctcctatagtatactaacgtggtgcgccgacggccgcgtacggaacaacgaccgtggagtggagtagggagtacgggaccgtaaaccctaactacgtcggttagacagtacgtcgttccttacaccctactcccgtaaccggacncgtactacgancgggaaaaccaccgaaccacctaaccacntaaacaccacgactacgagttaggggagtagacgagacctagacagtacgtacgaccggaccgtaccggtccgttaactagttacgtcgttacggacggtaccgacgttcccgttaccggtaagtccggtcgacggccgttaccggtccgcgtcgg

SEQ ID NO: 394676 - DNA, 597 bp, Homo sapiens
  misc_feature: GZ8MTXP01B0RFG.17.25.C03.1.454.CMB.2.raw
  modified_base (209)..(209): a, c, t, g, unknown or other
  modified_base (230)..(230): a, c, t, g, unknown or other
  modified_base (268)..(268): a, c, t, g, unknown or other
  modified_base (323)..(323): a, c, t, g, unknown or other
  modified_base (377)..(377): a, c, t, g, unknown or other
  modified_base (476)..(476): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggcctnagtgagtctctgcaaggcttntgtattcacgtttacctcctatagtatcaacgtgggtncgccaggccgctggaccaacgacctggacgtggatgggatcgggacaaaccctanactggtgtcacgagtcgtcctcaccctagtcccgtaccgggactcgacttaccntacgaccacgactacctacaataaacacacgacctacatggacgttggaaggtacgcgtagactagtacgtcgaccgacgaccgtccgtctagttccgngttcgacgtacgcgtaacccgacggacgtcccgggttgaccgtcgttaaccgggttccgaacgggtcggttcccgtttcggtaccgtttcggccgggggtaaccgaacgggggtaaccccg

SEQ ID NO: 394677 - DNA, 562 bp, Homo sapiens
  misc_feature: GZ8MTXP01AO2WQ.17.25.C03.1.454.CMB.2.raw
  modified_base (199)..(199): a, c, t, g, unknown or other
  modified_base (375)..(375): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccatcctccctgtctgcatctgtagganacagagttaccatcacgttggccgggcaagtcagggcattagaatgattagctgatacaaacaaaagtggagacgacccctaactcctgtatctatgctgcatctagtttgacagcgtcgggtccagtctaaggtcagcgcagtgatgcgactacagtacttcactctacacctanacacgacacgctacgactacgtacgtagtaacttacgttacaactttaacttacttactacgttaactaacgtaactacttaccgtaccgttacccggcggtaaccgtacggaaccggaaacgggacgtaagggtagaacgttacgttaacgaacgtcgtcgtcggacttacgtaaccgttaactcg

SEQ ID NO: 394678 - DNA, 658 bp, Homo sapiens
  misc_feature: GZ8MTXP01ET675.17.25.C03.1.454.CMB.2.raw
  modified_base (452)..(452): a, c, t, g, unknown or other
  modified_base (472)..(472): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctcgagtgaaggtctcctgacgaaggtcttcgtggtacttctacgttttacctctagtagtatacaacgtgggtcgccgccgaggcccgacgtcggaaccaaccggacctggaggtgggagttggggagtcgggggacctaaacccctaagacgttggtctacacgtagtccgtccttacaccctatccccgtaacgggacaacgtactaccatacgaccacgactccacaataacacacncctacagcggtagtagagcncctagcatctcgacgaccgacggtccgtctacgttacgtgtacggtacgacgtaccgtcccgaacgttacggtacccggttacgaccggtcccgttaaccgggccgttaccgggtcccggtccgtttttaaccggtaccggtttccggggttaccgggggaacccggttaacggggtaaccccggg

SEQ ID NO: 394679 - DNA, 550 bp, Homo sapiens
  misc_feature: GZ8MTXP01DAXU2.17.25.C03.1.454.CMB.2.raw
  modified_base (324)..(324): a, c, t, g, unknown or other
  modified_base (367)..(367): a, c, t, g, unknown or other
  modified_base (429)..(429): a, c, t, g, unknown or other
  modified_base (542)..(542): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgttttacctcctatagtatcaacgtgggtgcgccaggccgctggacaacgacctgagtggatgggatgggcaaccctanacgtggtgtcacagtcgtcttcaccctatcccgtaccgggacngacttaccatcgaccacgactccctaccaataaaccacacgcctacagtggagttgaggacncctagactagtctgaaccgacgaccggccgttactattacctgtcgcgagcgtcccagactccggttgacgtccttacggcacggtccgtcttgacgttcggttcggggccgnggggtccg

SEQ ID NO: 394680 - DNA, 553 bp, Homo sapiens
  misc_feature: GZ8MTXP01EXR53.17.25.C03.1.454.CMB.2.raw
  modified_base (173)..(173): a, c, t, g, unknown or other
  modified_base (363)..(363): a, c, t, g, unknown or other
  modified_base (422)..(422): a, c, t, g, unknown or other
  modified_base (503)..(503): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccancctccctgtctgcctctggaggggttcagagtcaccatcacttgccggacaagtcacggtacgttaaacctatttaaattggtatcagcaagaaacctaggaaaacgccccagacctcctgactctctggtgcactcactctagcgaagtcggcgtcccatcgaggttccagtggcagtgaatctggacngattcatctcacatcaccactcccgcaacctgagacttgtcgactaatctaacttacgngtaccaacagtaacgttaacacgtttcccctcgcctacgtttcgaccgtgggggaaccaaaggttcgaagttataaaccgnaaaaccgttaacgttacggtaacggcgtcgccaccttactcgttcgttcc

SEQ ID NO: 394681 - DNA, 637 bp, Homo sapiens
  misc_feature: GZ8MTXP01BVOF5.17.25.C03.1.454.CMB.2.raw
  modified_base (229)..(229): a, c, t, g, unknown or other
  modified_base (261)..(261): a, c, t, g, unknown or other
  modified_base (280)..(280): a, c, t, g, unknown or other
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatcgacccagtcctccatccctccctgtctgcctcgtggtgggggtcagagtcaccatcacttgaccgganaagtcacggtacttaaacctatttaaatgtancagcaagaaccaggaaacncccagacctctgatctcgtggcactactcccactctgacgaggtcgccgtaccagtcggtagttccgaggtggctaggtggaactcgtgggacagtctttacaatctacactactacacctacgtctcgacctaacgtgaaggtattggcactaacttcctaactacgtcgtaacaaacgtacggtaacctttaccgtacccgtttcccctacgtacccgttaacggttttccgggaacccgggtaaacgggggtaaacccttaaaagggggtcaaacgggttaaactaaccgttaaaaacggttcgttagggtaacggctaacggaccctaacgttactttccgttcgtttaaccc

SEQ ID NO: 394682 - DNA, 632 bp, Homo sapiens
  misc_feature: GZ8MTXP01CW6X0.17.25.C03.1.454.CMB.2.raw
  modified_base (510)..(510): a, c, t, g, unknown or other
  modified_base (558)..(558): a, c, t, g, unknown or other
  modified_base (582)..(582): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtagaagagccgtgggcctgagtgaaggtctcctgacaaggtcttcgtggtacttctacgttttacctcgtatagtactcaacggtgggtcgccgaccgagggcccgtacgtaggaaccaaaccgccctgggaggttagggaaggttgggggaagttccgggggaaccctaaaccccgtaaacgaccgttgggtacgtaccaacgtagttcccgttaccttaccgaacccctagtcccccggtaaccgggaacaacggtaaccttaaccataccgaaccaacgtaaacctccctaacaataaacacacgcctanagtggacgtggagcgtcagaccagtcagcgacgacgtctctattacgngtgcgacgcctccgcgcgtccggngacgcgttcggcgacgtccgtcgttcgcgtcggacgggtccgcgggtccg

SEQ ID NO: 394683 - DNA, 699 bp, Homo sapiens
  misc_feature: GZ8MTXP01AZB7Z.17.25.C03.1.454.CMB.2.raw
  modified_base (231)..(231): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagcgtgggcctnagtgaggtctctgcaggtcttcgtggtacttctacgttacctcctatagtatcaacgtggggtgcgccgagggcccgcgtaggaccaacgacctggagtggagtgggacgtcggggaccgaacccgtaacacggtggtacgtccacgtaagtcgtccttacccgaccctacgtcccgaccgggtacacgtaccttaccataccgaacccacgtaacctcccgtaacaactaaaccgaccacgtacctaacgagttacgggtaacggttaggaacggggtactacccgtaggtaacctagttaccgtacgggaaccgtaccggtaacccgggtccccttaattaaacgttccggttagggtaccggaccggtaaacggtaacccggttacccccgagggttaaccggtttcccggggtacgaaccgggccccgttaacggggccgttaacgggttcccgggtttcccgg

SEQ ID NO: 394684 - DNA, 565 bp, Homo sapiens
  misc_feature: GZ8MTXP01AC7N4.17.25.C03.1.454.CMB.2.raw
  modified_base (478)..(478): a, c, t, g, unknown or other
  modified_base (555)..(555): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttctggattcacgtttacctctatagtatcaacgtgggtgcgccaggccgctggacaacgacctgagtggatgggatgggaccaaaccctaagacgtggtgtcagtagtcgtcttcaccctatcccgtaccgggacaacgtaacttacccatacgaacccacgaacctcctaccaataaacacacgcctacagtcggagttgaggagcctagacatcgagaccgacacggccctatacgttacngtcgcgacgcgtcccaaggactcggagacgccgttcggcacggccgttcccgtttgaccgttcggttacggggccgnggggtaaccg

SEQ ID NO: 394685 - DNA, 603 bp, Homo sapiens
  misc_feature: GZ8MTXP01CCFZF.17.25.C03.1.454.CMB.2.raw
  modified_base (220)..(220): a, c, t, g, unknown or other
  modified_base (248)..(249): a, c, t, g, unknown or other
  modified_base (251)..(251): a, c, t, g, unknown or other
  modified_base (267)..(267): a, c, t, g, unknown or other
  modified_base (290)..(290): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccatccctcctgtctgcctcgtggtggggtcagatcacatcactgccganagtcacggtacttaaactattaatgtannancaagaacctagaaacncccagacctctgatctcgtggtncactccatcgtgacgaagtcggcctccagtcgaggttccaggtggcgaggtggaactcggtgggactagtactttacaacttcacaccactaccaccacctacccgacaaccgtgtaggtacttggtacactaacttctaaccttacgtacgtacaaacgtacgtaacgttaccctccgtttcccctacgtcctttaccggtttaccggacccggtaaacggggtaaaccctaaaggttacgaacggttaaactaaccgtaaacgttacgttggacggtctacgaacctactagttccttcgttccttaaccg

SEQ ID NO: 394686 - DNA, 620 bp, Homo sapiens
  misc_feature: GZ8MTXP01CZI2G.17.25.C03.1.454.CMB.2.raw
  modified_base (269)..(269): a, c, t, g, unknown or other
  modified_base (274)..(274): a, c, t, g, unknown or other
  modified_base (329)..(329): a, c, t, g, unknown or other
  modified_base (337)..(337): a, c, t, g, unknown or other
  modified_base (510)..(510): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtctcctgcaaggcttctggattcacgtttacctctatagtatcaacgngggtncgccaggccgctggacaacgcctgagtggagtgggatcggggaccaaaccctaanacgtggtntacacagtccgtccttacaccctatccccgtaacccgggacaacggtaaccttacccagtaccgaacccaaccgtaacctccctaccaataaaccacacgaccctacaagtggagttcggaaggacgccctagactagtcgtacggaaccacgtaccggcctactagttacgngtcgcgaacgcgtcccacggttagtcccggttagaaccggtccgttaacgggcacgggtcccggttcctttcggacgttccgggttcgggggaacccgcggggtaacccg

SEQ ID NO: 394687 - DNA, 717 bp, Homo sapiens
  misc_feature: GZ8MTXP01ET79R.17.25.C03.1.454.CMB.2.raw
  modified_base (260)..(260): a, c, t, g, unknown or other
  modified_base (266)..(266): a, c, t, g, unknown or other
  modified_base (279)..(279): a, c, t, g, unknown or other
  modified_base (323)..(323): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggcctcagtgaaggtctctgcagcttcgtggattcacgtttacctctatagtancaacgnggtgcgcaggccnctggaccacgacctggagtggagtgggatcgggacaaccctaancgtggtctacacgtagtccgtcttaccacccactccccggtaacccgggactaacgtaaccctttaaaccgacgttacggaaccccctaacggtaaaccctttaccccaaccctaaataaaacccacgaacgacccgttaaacgtaaggttggggtaacgttaggaacgggacgtccgtagaacctacggttacgtacggaaccccgtaacgacccgggttccgttactttacgttaacgtcggttacgacgggttaacgcccggtaaccccgtaaacggttcggtacccggggttcgtaacggccccgttaacggggcgttaccgggtcccgggtttccctttaagggtaccccggtttggggacccggggggtcccgaacggggggtccccg

SEQ ID NO: 394688 - DNA, 556 bp, Homo sapiens
  misc_feature: GZ8MTXP01ACBFJ.17.25.C03.1.454.CMB.2.raw
  modified_base (331)..(331): a, c, t, g, unknown or other
  modified_base (339)..(339): a, c, t, g, unknown or other
  modified_base (373)..(373): a, c, t, g, unknown or other
  modified_base (418)..(418): a, c, t, g, unknown or other
  modified_base (444)..(444): a, c, t, g, unknown or other
  modified_base (467)..(467): a, c, t, g, unknown or other
  modified_base (496)..(496): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctcctgcaaggcttcgtggtattcacgtttacctctatagtatcaacgtgggtgcgccgaggccgctggacaacgacctggagtggatgggatcgggacaaccctaanacgtggtntcacagtcgtctcaccctatcccgtaccgggacncgacttaccatcgaccacgactccctacaataaacacacgcctanagtggagttgacggcgctagacatcngacacgacgtccgtctattacgngtcgcgacgcgtcccacgttcgtcccggngtacgccgttacggcgacggtccggtctttcgacgttcggttcggggccgaacgggtccg

SEQ ID NO: 394689 - DNA, 577 bp, Homo sapiens
  misc_feature: GZ8MTXP01EGYGY.17.25.C03.1.454.CMB.2.raw
  modified_base (210)..(210): a, c, t, g, unknown or other
  modified_base (251)..(251): a, c, t, g, unknown or other
  modified_base (331)..(331): a, c, t, g, unknown or other
  modified_base (343)..(343): a, c, t, g, unknown or other
  modified_base (371)..(371): a, c, t, g, unknown or other
  modified_base (401)..(401): a, c, t, g, unknown or other
  modified_base (418)..(418): a, c, t, g, unknown or other
  modified_base (438)..(438): a, c, t, g, unknown or other
  modified_base (523)..(523): a, c, t, g, unknown or other
  modified_base (538)..(538): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaaggtctcctgcaaggcttctggattcacgtttaccnctatagtatcaacgtgggtgcgccgaggcccgcgtggaaccaacgacctggagtggagtgggatcggggacaaccctaancgtggtctcacngtcgtcttcacccatcccgtacgggacngacttacatcgaaccacgaactccactaanaaacacgacgccctaanagtaggagttcgaagggacncccgtagaccatccgtaggaaccgacgaccgggtccctattagttactcggtgaccgagtaccgtaaccccgagttacgttcggngaacgccgttacggnacggtccgtctttgccttggacgggccgttaagggcccg

SEQ ID NO: 394690 - DNA, 589 bp, Homo sapiens
  misc_feature: GZ8MTXP01BB13C.17.25.C03.1.454.CMB.2.raw
  modified_base (255)..(255): a, c, t, g, unknown or other
  modified_base (328)..(328): a, c, t, g, unknown or other
  modified_base (335)..(335): a, c, t, g, unknown or other
  modified_base (372)..(372): a, c, t, g, unknown or other
  modified_base (579)..(579): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctcagtgaaggtctcctgcaaggcttcgtggtattctacgtttaccnctatagtatcaacgtgggtgccgccaggcccgctggacacgacctgagtggagtgggatgggacaaccctaancgtggtntcatagtcgtcttacaccctatcccgtaaccgggacncgtaccttaccgatcgaacccacgaacctccctaccaataaaccacacgcctaacagtggtagttaggaggactcctagaccagtcgtacgaccgacgaccggtccgtcttagttaccgtgtacgccgaacgtccgtcccgaaacgttcgtccggttgaccgtccgttacggcacggtccggtccttgaccgttcggcggggtccgnggggtccccg

SEQ ID NO: 394691 - DNA, 568 bp, Homo sapiens
  misc_feature: GZ8MTXP01BQLDQ.17.25.C03.1.454.CMB.2.raw
  modified_base (325)..(325): a, c, t, g, unknown or other
  modified_base (369)..(369): a, c, t, g, unknown or other
  modified_base (468)..(468): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggagtgggatcgggacgaaccctanacgtggtgtcacagtcgtccttcacccactcccgtaccgggacncgacttaaccatcgaccacgaactccctaccaataaaccacagaccctacagtggtagttagaggacgcctagaccagtctaggaccacgacgcccgtntacttacgtgtgcgagcgtcccacgacgtccggttgacggtccgacggttcacgggtccgtccgtttgaccgtttcggccggggtccgaagggggtcccg

SEQ ID NO: 394692 - DNA, 647 bp, Homo sapiens
  misc_feature: GZ8MTXP01BHTS8.17.25.C03.1.454.CMB.2.raw
  modified_base (276)..(276): a, c, t, g, unknown or other
  modified_base (303)..(303): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccatccctccctgtctgcctcgtggtgggggtcagacgtcaccatcactgccgacagtcacggtacttaaactatttaatggatcagcaacgaaacctaggaaacnccccagacctctgacttctcgtggtcncactccactcgtgacgtaacgtcggcctcccagtcggtagttccgaggtgacgaggtggaacttcggtgggactagttactttacaatttccaccaacctactaccgaaccctacttcctacggacccaaacgttgaaggtattcggacaactaacttctaacttacgtacgtaaccgaaacgtaagttaccgtttaccaacccggtttcccctcgtaccgtttacggtttccgggaacccgggtaaacggggtaacccttaaagggttcaaacggttaaacgtaacccaaaaccggttgttacggtcggctaaccgactaccgttacttcgttaacgtttccc

SEQ ID NO: 394693 - DNA, 553 bp, Homo sapiens
  misc_feature: GZ8MTXP01DOJIE.17.25.C03.1.454.CMB.2.raw
  modified_base (210)..(210): a, c, t, g, unknown or other
  modified_base (324)..(324): a, c, t, g, unknown or other
  modified_base (353)..(353): a, c, t, g, unknown or other
  modified_base (368)..(368): a, c, t, g, unknown or other
  modified_base (405)..(405): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaggtctcctgcaaggcttctggattcacgttttacctcctatagtatcaacgtgggtgcgccaggccgctggacaacgacctggagtggatgggatgggacaaccctaanacgtggtcgtcacgagtcgtcttcacccntcccgtaccgggacngacttaccatacgaccacgactccacataaacacgancctacatggagttagagagcctagacatctagacgacgacgggccttactattacgtgtcgacgtagacgtaacccaaggttacgtcccgggttgaacgccgttacggcacggtcgtaccttgcgttcggttcgggccgaagggtccg

SEQ ID NO: 394694 - DNA, 598 bp, Homo sapiens
  misc_feature: GZ8MTXP01AIHE8.17.25.C03.1.454.CMB.2.raw
  modified_base (206)..(206): a, c, t, g, unknown or other
  modified_base (211)..(211): a, c, t, g, unknown or other
  modified_base (294)..(294): a, c, t, g, unknown or other
  modified_base (320)..(320): a, c, t, g, unknown or other
  modified_base (454)..(454): a, c, t, g, unknown or other
  modified_base (548)..(548): a, c, t, g, unknown or other
  modified_base (570)..(570): a, c, t, g, unknown or other
  modified_base (572)..(572): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatccctccctgtctcgcctcgtggtggggtcagntcacntctactcggaccgacagtacgaacggtaactttaaaacttaatttaagtggtactacgagacaaagaaaccgtaggaaaaccncccaagacctctgtactctcgtggcnctactcctactcgtacgacggtagtcggcctacctagtcggtagttccgagggtcgtagtaggtgtaactccgggtgggaactagttacttacactcactactctacacctactcgacgactacgtgtacggtntgtacacgtacttacgtactacgtactacaacgtagtactacgtacctccgtctcgtcgttacggcgtaacgggtacttaaggtagacgtaaanaaccgaaagttcttgggtaacncncggactacgttacttcttcgttaacc

SEQ ID NO: 394695 - DNA, 574 bp, Homo sapiens
  misc_feature: GZ8MTXP01DZPZU.17.25.C03.1.454.CMB.2.raw
  modified_base (310)..(310): a, c, t, g, unknown or other
  modified_base (517)..(517): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcagtgaaggtctcctgcaaggcttcgtggattcacgttacctcctatagtatcaacgtgggtagccgtccgaggcccgngtggaccaaacgccgtgacggttggagttggggatcggggaccgtaaacccctaacgaccgttggtacgtacacgtaagttcgtcttccacccatcccgtacgggacagtacttacatcgacacgactcacataacacagccagagtggtagttaggaggtacgaccgtgactactcgtacgaccgacgaccgtcgtctaattacgngtcgagacgcgttacccgagttacgtcggtgcgccgtacggacgtcggccggtttcg

SEQ ID NO: 394696 - DNA, 673 bp, Homo sapiens
  misc_feature: GZ8MTXP01A57FK.17.25.C03.1.454.CMB.2.raw
  modified_base (544)..(544): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtggggcctcgagtgaaggtctccgtgcgaaggtcttcgtggtacttctacgttttacctcgtatagtatactaacgtgggtcgcgccgacggtccgcgtacggaacaacggaccgtggacggtgggagtgggggaagtcggggaccgtaaaccctaacgacgttgggtgtacacgtagttccgttaccttccaacccgtacgtccccgtaacccggggaactaacggtaaccctttaacccgagttacccgaaccccgtaacgtaaacccttcccctaacctaaacgtaaacccacgaacgtaccctaagtaaggtacgggtaagttgggaacggtacnccggtatacacgtcgtacgacgacgtccggctctagttacgtgtcgacgacgccgccacgttcggtcgcgacgtccgacggcttacggtcggttcttcggacgttcgggcgggtccgaacgggtcccgg

SEQ ID NO: 394697 - DNA, 574 bp, Homo sapiens
  misc_feature: GZ8MTXP01DAO2I.17.25.C03.1.454.CMB.2.raw
  modified_base (221)..(221): a, c, t, g, unknown or other
  modified_base (305)..(305): a, c, t, g, unknown or other
  modified_base (421)..(421): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctcgtggtggggtcagagtcacatcacttgccgganaagtcacggtacttaaaacctatttaaatggtatcagacaagaaacctaggaaaacgccccaagaccctcctgatctcgtggtncactccactctgacgaaggtcggcctcccagtcggtaggttccaggtgctaggtggaatcgtgggactagtatttacaatctacaccataccacctactctacgacaacgtgagtnttgagtactaattcctaactactcgtaaccaacgtagtaacgttacaccgtttcccctgtcttacgtttcgggccgtaacggggaacttaaaggttgaacgtaacgtacgaaaacgttcgttgggtcgctcgcctacttattccgttgttccc

SEQ ID NO: 394698 - DNA, 694 bp, Homo sapiens
  misc_feature: GZ8MTXP01CQPTO.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtgaagagccgtgggctgagtgaaggtctccgtgacaaggtcttcgtggtactttcctaaccgttttacctctaatagtactcaacgtgggtcgccgccgacggccgcgtacggaacaacgacctgaggtgggatggggacgtcgggggacctaaacccgtaacgacgttgggtactaccgaactagttccgttccttaccgaacccctacgttaccccgtaacccgggaactaacggtaacctttaacccgaatacccggaaccaaccgtaacctaccctaccaaaactaaaccacacgtacccttaagaacgttagggtacgttaggaacggacgtcccgtagaacctaggtctacggaccgaccgtcggtccgttacttagttaccgtgtaccgacgtacgaccgtaacccgaacggttcgtccggttagaccgtccgttacgggcacggttccggtccgtttaagccgttacgggcggggccgaaggggtcccg

SEQ ID NO: 394699 - DNA, 612 bp, Homo sapiens
  misc_feature: GZ8MTXP01D4IS0.17.25.C03.1.454.CMB.2.raw
  modified_base (341)..(341): a, c, t, g, unknown or other
  modified_base (390)..(390): a, c, t, g, unknown or other
  modified_base (448)..(448): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcagtgaaggtctcctgcaaggtcttctggtattctaccgtttacctctatagtatcaacgtgggtcgccgccaggcccgcgtggaacaacgacctggagtggagtgggatcgggggaccaaacccttaanacgttggtcgtcacgtagtccgtccttcaccctatcccgtaccgggacngtaccttacatcgaccacgaactcctacaataaacacacgactacagtggagtgagcnctagacagtctagaccgacgtacggccgtactagttactggtagcgtacgaccggtccccaaggttacgtcccgggttagaccggtcccttacgggccttacggtccgggtaccccttttgggacccgtttcggggaccgggggccccgttaagggggtccccg

SEQ ID NO: 394700 - DNA, 579 bp, Homo sapiens
  misc_feature: GZ8MTXP01CNS2M.17.25.C03.1.454.CMB.2.raw
  modified_base (223)..(223): a, c, t, g, unknown or other
  modified_base (279)..(279): a, c, t, g, unknown or other
  modified_base (296)..(296): a, c, t, g, unknown or other
  modified_base (301)..(301): a, c, t, g, unknown or other
  modified_base (357)..(357): a, c, t, g, unknown or other
  modified_base (464)..(464): a, c, t, g, unknown or other
  modified_base (476)..(476): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgccttcgtggtgggggtcagagtcacatcacttgccganaagtcacggtacttaaaacctatttaaatgtatcagacaagaaacctaggaaaacncccaagacctctgatcntggtncactccatctgacgaagtcgcgtaccagtcgagttccaggtggctaggtgaatcgnggaactgtattacgaatcctacactataccacctactctagactaaccgtgaggtatttggactactaaattccttaacgtaacttgtaacaacgaatacgttaacnccgtttaccccngtaccttacgttcggaacggtaaggtaaacttaagtacgaagtaaactaacgaaacgttcgttacggtaacgactcgtaaccacgttacttccgttaacgtcg

SEQ ID NO: 394701 - DNA, 740 bp, Homo sapiens
  misc_feature: GZ8MTXP01E2SRW.17.25.C03.1.454.CMB.2.raw
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggggcctcgagtgaaggtctcctgcaggcttcgtggattctacgttacctcctatagtactacgtaacgtgggtcgccgccgacgggcccgcgtacggaaccgaaccgaccgtaggagggtggaggtaggggacgtacgggggaacccaaccctaaccgacggttggtacgtactacgtaacgttccgttcccttacccgaccctaccgttaccccggtaccggggaactaccggtaaccctttaccgaacgttaccccggaaccccgtaaaccgtaaccccttaccccgtaaacctaaaactaaacccgaccgtaacgtaccccgtaaaggtacgtagggttacggggtaacgggaacgtaccgtaccgtacgaacgtaccgtacggtaccgaaccgacccggtaccgttaccgttaactaacgtcgttcgacggacgaccgtacccgttaccgcgttccggtaacggacgtaacccgtccggacgttacgtccggttccgttttaaccggg

SEQ ID NO: 394702 - DNA, 526 bp, Homo sapiens
  misc_feature: GZ8MTXP01CR8GX.17.25.C03.1.454.CMB.2.raw
  modified_base (323)..(323): a, c, t, g, unknown or other
  modified_base (363)..(363): a, c, t, g, unknown or other
  modified_base (418)..(418): a, c, t, g, unknown or other
  modified_base (449)..(449): a, c, t, g, unknown or other
  modified_base (517)..(517): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaanactggtgtcacagtcgtcttcacccatccctaccgggacngacttaccatgaccacgaactcctaccaataaacacagcctacatggatgaggancctgacagtctgacacacggcctctattacngtgcgagcgtcccacgatccggttgacgccttacggcacggcggtcctttgactttcgcggggtccgngggtaaccg

SEQ ID NO: 394703 - DNA, 601 bp, Homo sapiens
  misc_feature: GZ8MTXP01DU7RF.17.25.C03.1.454.CMB.2.raw
  modified_base (211)..(211): a, c, t, g, unknown or other
  modified_base (327)..(327): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctnagtgaaggtctcctgcaaggcttctggattcacgtttacctcctatagtatcaactgggtgcgccaggccgctggacaacgacctgagtggatgggatggggacgaaacccctaanacgtggtgtcacagtcgtcttcacccatcccgtaccgggacaacgacttaaccatacgaccacgaactccctaccaataaacacagcctaacagtggagttgaggacgcctagacagtctaggaccgtacgaccggtcccgtcttaacttacgtgtggccgaagtccgtccccgaacggttacgtcccgggttcgaccggtccgttaaccgggcgttacggtcccgggtcctttcggaccgtttcggttcgggggtcccgaagggggtccccgg

SEQ ID NO: 394704 - DNA, 566 bp, Homo sapiens
  misc_feature: GZ8MTXP01AWRFZ.17.25.C03.1.454.CMB.2.raw
  modified_base (250)..(250): a, c, t, g, unknown or other
  modified_base (428)..(428): a, c, t, g, unknown or other
  modified_base (444)..(444): a, c, t, g, unknown or other
  modified_base (473)..(473): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagagcctgggctcagtgaaggtctcctgcaaggcttctggtattcacgtttaccnctatagtatcaacgtgggtgcgccaggccgctggacaacgacctgagtggatgggatcggggacaaccctaagcgtggtcgtcactagtcgtccttcacccatcccgtaccgggacaaggtaccttaacccatcgaacccaacgaaacctccctaccaactaaaccacagtccctaanagtgagttgaaggacnctagacctagtctagaccgacgcgccgtntattacgtgtgacgacgcgtccgacgacgtccggttagaccgtccgacggcacggtccggtctttgacgttcggcgggtcccgaagggtcccg

SEQ ID NO: 394705 - DNA, 781 bp, Homo sapiens
  misc_feature: GZ8MTXP01AS504.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctgagtgaacggtctccgtgacaggtcttcgtggtattctaccgtttacctcctatagtatctaacgtgggtcgccgtccgacggcccgcgtacggaaccaacgtaccgtggacggtggagtggggagtcggggaacccgtaaaccctaacgtcgttggttcgtactacgtagttccgttcccttaccaacccctacttccccgtaaacccgaacgtaacccgtaacggtaaaccccttaacccgacgttaaccccgggaaacccctaaacccggttaaaccccttacccccttaaacctaaaaccttaaaacccaacccgtaaccggtaccccttaaacgtaaggttacgggtaaaggttacggaacgggtacgtaccgttacggaaccttaagtacccggtaacgacccggtaaccgtacccggttccgttacgtttaacgtacgtcggtacgaccgacggtaacccgtacccgacggtaaccgttccggtacgaccggttcccgttcggcgtaaccgggtccgttaacccgtttcggaccgttcggtaaccggggcgtaaccgggg

SEQ ID NO: 394706 - DNA, 570 bp, Homo sapiens
  misc_feature: GZ8MTXP01AGD73.17.25.C03.1.454.CMB.2.raw
  modified_base (271)..(271): a, c, t, g, unknown or other
  modified_base (291)..(291): a, c, t, g, unknown or other
  modified_base (341)..(341): a, c, t, g, unknown or other
  modified_base (430)..(430): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaggcttctggattcacgttaccncctatagtatcaactgggtncgccaggccgcggacacgactgagtggatggggatgggacaaaccctaanaccgtggtgcacagtgtccttcacccactcccgtaccgggacacgtacctaccatgacccaacgtaacctcctaccaaataaaccacancctaacatagggagttggggaggacgcctacgacacgtcgagaccgacgaccggcgtactattaacgtgttacgcgaagtcgtcccgacgacgttcccgggtgaccgccgtacgggcttacgtccggttcctttaacggg

SEQ ID NO: 394707 - DNA, 665 bp, Homo sapiens
  misc_feature: GZ8MTXP01CT6LV.17.25.C03.1.454.CMB.2.raw
  modified_base (278)..(278): a, c, t, g, unknown or other
  modified_base (283)..(283): a, c, t, g, unknown or other
  modified_base (592)..(592): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttcgtggtattctaccgttttacctcctatagtatcaactgggtncgccnggccgctaggacaacgcctggagtggagtggggatcggggaccgaaaccccttaacacgttggtgtcactagttcgttccttaccgaccctacgtcccgtaacccgggactaacgtacctttaaaccagtacgaaccctaaccgaaacttccctaccctaaataaaaccacaacgccccttaagagttacgggtagttaggacgggactcccgtagaccgtagttacgtacggaaccgaacggtccggtcccgttacttagtttaccgtgtcggacgacgtaccggtaacccaaggttcggttcccggngtaccgcccgttacggccacgggtccggttcgtttcggtaccgttcgggacgggggtccgttaacgggtcccg

SEQ ID NO: 394708 - DNA, 707 bp, Homo sapiens
  misc_feature: GZ8MTXP01D230R.17.25.C03.1.454.CMB.2.raw
  modified_base (351)..(351): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgtccactcccaggtgcagcgtggtgcaggtcgtggggctggaggtgaagagccgtgggcctgagtgaaggtctcctgcgaaggtcttcgtggtattcgtacgttttacctctatagtatcaacgtgggtcgaccgccgacggcccgcgtacggaaccaacgactggaggtggagtgggagtcgggaccaaaccctaanacggttggtcgtacacgtacgttccgtaccttaccacccgtattccccggtaacccgggaacaacgttaaccttaaccgacgttaccgaaaccccgtaaccgtaaacccttaccctaacccaaactaaaaccgacaaccgtccctaaacgtagtagggtacgtaggacggtacgcctagaactacgttcgacgaaccgaaccgtaccgggtccttaacttaacgtttacgtcggttacgaacgtacggaccgtaacccgaacgttcggttccggagaccggtaccgttccgggcttacgggtccggtttaccgttaacggtccgttcgggccgggggtaaccgaacggggtccccg

SEQ ID NO: 394709 - DNA, 612 bp, Homo sapiens
  misc_feature: GZ8MTXP01DSBXD.17.25.C03.1.454.CMB.2.raw
  modified_base (236)..(236): a, c, t, g, unknown or other
  modified_base (504)..(504): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagagcctgggcctcagtgaagtctcctgcagcttctggnttcaccgtttacctcctatagtatacaacgtgggtcgcgccgaggccgcgtggacaacgacctggagtggagtggagtgggaccaaccctaagacgtggtcgtcacgagttcgtccttcaccctatcccgtaaccgggactaacggtaaccttaccagtacgaacccacgtaaaccttaccctaccaaactaaaccactacgacctaacagtggagttggacggacgccgtagaccgtagtccgtagaaccgaccgacggtcccgttntaacgttacgtcgtcggacgtcgtaccgtccacggctacggttcgacgtccgaacggcgacggtccgttcgttcgtaccgtcgggttacgggtccgaacggggtcccg

SEQ ID NO: 394710 - DNA, 658 bp, Homo sapiens
  misc_feature: GZ8MTXP01A139Y.17.25.C03.1.454.CMB.2.raw
  modified_base (211)..(211): a, c, t, g, unknown or other
  modified_base (223)..(223): a, c, t, g, unknown or other
  modified_base (275)..(275): a, c, t, g, unknown or other
  modified_base (301)..(301): a, c, t, g, unknown or other
  modified_base (362)..(362): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccatcctccctgtctgcctcgtggtggggtcagagtcaccntcacttgccganagtcacggtacttaaactatttaaatggtatcagcaagaaacctaggaaacnccccaagaccctctgatctcgtggtncactccactcgtgcgtaagtcggcctccagtcgaggttcagtgcagtgaatgtggatagtnttacatctacactatcgacctactcgtcgacctaaaccgtggaaagttcttacggactaactaaacttccttaaacgtttactacggtaaccctaaacgtacgttaacgtttaccctaacccggttttcccccctaggttcccgtttaaccgttttaccgggaacccgggttaaaacgggggtaaacccttaaaggggtttagaaacgggtaaactaacccggttaaaaacggttaccgttgggttaacgggaccttaaccggacctaacccggtttacttccgttccgtttaacc

SEQ ID NO: 394711 - DNA, 632 bp, Homo sapiens
  misc_feature: GZ8MTXP01B9QL1.17.25.C03.1.454.CMB.2.raw
  modified_base (271)..(271): a, c, t, g, unknown or other
  modified_base (324)..(324): a, c, t, g, unknown or other
  modified_base (332)..(332): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctctgcaggcttctggattcacgtttacctcctatagtatcaacgtgggtncgccaggccgctggacaacgcctgagtggatgggatcggggaccaaccctaanacgtggtntcacagtcgttccttcacccctatccccgtaccgggactcgaccttaccgatcgaacccacgaacctccctaccaataaaccacacgcctaacgagtggagttggaggtacgcctagaccagtcgagtaccgacgaccggcccgttctaacgtttacgtcggtgcggacgtaaccggtccccgaacggttacgtcccgggttagaccggtcccggttaaccgggccgttacgggtcccgggttccgttttaacgggtaccgtttccgggttcgggggtcccggaagggggttaaccccgg

SEQ ID NO: 394712 - DNA, 648 bp, Homo sapiens
  misc_feature: GZ8MTXP01BGWT0.17.25.C03.1.454.CMB.2.raw
  modified_base (231)..(231): a, c, t, g, unknown or other
  modified_base (249)..(249): a, c, t, g, unknown or other
  modified_base (332)..(332): a, c, t, g, unknown or other
  modified_base (340)..(340): a, c, t, g, unknown or other
  modified_base (374)..(374): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggctcagtgagtctctgcagcttntggtattcacgtttaccnctatagtatcaacgtgggtgcgccgacggccgcgtcggaacaacgaccgtggacgtggagtgggagtcgggaccaaccctaanacgtggtncacagtcgtctacaccctatcccgtaccgggacncgtactaccatcgaaccacgactccctacaactaaaccacacgacctacgagttgggacgttagacggtacgtctagactacgtacgtacgaccggaaccgaccggtccgttacttagttaccgtcggttacgggccgtacggtaccgtaacccgaacggttacggtcccgggttaggacccggtccggttacgggttccgacggggtcccgggttcgttccgggtaccgtttccgggttacgggggtaacccgttaacgggggtaaccccggg

SEQ ID NO: 394713 - DNA, 664 bp, Homo sapiens
  misc_feature: GZ8MTXP01AGMT8.17.25.C03.1.454.CMB.2.raw
  modified_base (305)..(305): a, c, t, g, unknown or other
tcagcgtagactagcacgaccggtgctcgatttagtagtgtagatttgggtttggggaaccatatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggctcagtgaaggtctcctgcaaggcttcgtggtacttcaccgtttacctcctatagtatcaacgtgggtgcgccaggccgctggacaacgacctgagnggatgggagtcgggaccaaccctaacgcgtggtcgtcacgagttcgtcttacacccacgtcccgtacccggggacaacggtacctttaaccagtacgaaccctacgaacctccctaccaaataaacccacgacgtacccctaaagtacgtagggtaagtttcgggaacgggacgtaccgtggtaacccagttccgtaacggacccggaaacccgtaaccggggtcccttaacgttactttaccggtggttccgacggtaacgtaccgtccccgacgacggttcccggagaacggccccgttaagggcttaccgggccgttctttaaggaccgttcggcggggccgaaggggtaacccgg

SEQ ID NO: 394714 - DNA, 574 bp, Homo sapiens
  misc_feature: GZ8MTXP01CY86M.17.25.C03.1.454.CMB.2.raw
  modified_base (445)..(445): a, c, t, g, unknown or other
  modified_base (453)..(453): a, c, t, g, unknown or other
  modified_base (509)..(509): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggctcagtgaaggtctcctgcaaggcttctggattcacgtttacctcctatagtatcaactgggtgcgccaggccgctggacaacgacctgagtggatgggatggggcgaaaccctaacgacgtggtctacatacggtcgtccttccgaccctactccccgtaaccggggaactgacccttaaccatacgacccaacgacctccctacaataaaccacagacctacagtggattggaagnccgtgacntctggacacgacggtcctctattactgtcgcgagtcgtaacccgaagcgtcccggngaccgtccgttaacggcgacggtccggtaccgtttcgacgttcggcgggggcccaaggggtcccg

SEQ ID NO: 394715 - DNA, 628 bp, Homo sapiens
  misc_feature: GZ8MTXP01BFDAW.17.25.C03.1.454.CMB.2.raw
  modified_base (250)..(250): a, c, t, g, unknown or other
  modified_base (270)..(270): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacncctatagtatcaactgggtncgccaggccgctggacaacgacctgagtggatgggatgggcaaccctacactggtgtcacagtcgtccttcacccatcccgtaccgggactgacttacccattcgaccacgaaacctcctaccaataaacacaacgtccctacagtggaagttcgagggacgcctagacctatcgtacggaacgaccgaaccggtcccgttacttaagtttaacccgttggtacgaccggaacggtaccggttccccaaacgggttacgtttaccccgggttgaacccgggcccgttaacgggccaacgggtcccgggtcctttttaacgggaccctttcggttagggggtccccaaggggggtcccg

SEQ ID NO: 394716 - DNA, 553 bp, Homo sapiens
  misc_feature: GZ8MTXP01E2F9Y.17.25.C03.1.454.CMB.2.raw
  modified_base (330)..(330): a, c, t, g, unknown or other
  modified_base (377)..(377): a, c, t, g, unknown or other
  modified_base (469)..(469): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgctggacaacgacctgagtggagtgggatcgggacgaaacccctaanaccgtggtcgtcacagtcgtccttcacccatcccgtacccggggacncgtaccttaccatcgacccacgaactccctaccaataaacgacagcctacatggagtgagacgcctagacagtctagaccgacacggccgtnttatacgtgtgcgagcgtcccaacgctccggttgacgtccacggcacggtcgtcctttggacttcgcggggccaaggggtcccg

SEQ ID NO: 394717 - DNA, 561 bp, Homo sapiens
  misc_feature: GZ8MTXP01BO92P.17.25.C03.1.454.CMB.2.raw
  modified_base (273)..(273): a, c, t, g, unknown or other
  modified_base (321)..(321): a, c, t, g, unknown or other
  modified_base (397)..(397): a, c, t, g, unknown or other
  modified_base (405)..(405): a, c, t, g, unknown or other
  modified_base (418)..(418): a, c, t, g, unknown or other
  modified_base (443)..(443): a, c, t, g, unknown or other
  modified_base (450)..(450): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgctggacaacgcctgagtggatgggatgggcaaccctaanactggtgtcacagtcgtcttcacccatcccgtccgggacaagacttaccatcgaccacgaactcctacaataaacncagcctanatggattgagacncctagacatctgacgacacggcctntattacngtgccgagcgtccccagttactcccgggttgaacgtcccgttaacggcaacgggcccggtcccgttttggacccgtttcggttcggggggtccccaaggggggtaaccccg

SEQ ID NO: 394718 - DNA, 562 bp, Homo sapiens
  misc_feature: GZ8MTXP01AHHTR.17.25.C03.1.454.CMB.2.raw
  modified_base (261)..(261): a, c, t, g, unknown or other
  modified_base (272)..(272): a, c, t, g, unknown or other
  modified_base (369)..(369): a, c, t, g, unknown or other
  modified_base (411)..(411): a, c, t, g, unknown or other
  modified_base (489)..(489): a, c, t, g, unknown or other
  modified_base (551)..(551): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctggggctcagtgaaggtctcctgcaaggcttctggattcacgtttacctcctatagtancaacgtgggtncgccaggccgctggaacacgcctgagtggatgggatgggcaaccctaacacgtggtctacactagtcgtccttacaccctatcccgtaccgggaacngacttaccatcgaccacgaactccacactaaacacagcctanacgtggacttgagacgcctagacagtctcggacgaccgtacggccgtattacttaccgtgtggactaggcgtaacccnggttaactccgggttgacgtccgttacggcacggccgtctttggcgtttcggcgggggtccnggggtaacccg

SEQ ID NO: 394719 - DNA, 725 bp, Homo sapiens
  misc_feature: GZ8MTXP01DKXKG.17.25.C03.1.454.CMB.2.raw
  modified_base (247)..(247): a, c, t, g, unknown or other
  modified_base (385)..(385): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctgggctcagtgaagtctctgcaagcttctggattcacgtttacncctatagtatcaacgtgggtgcgccgaggccgctcggacaacgacctggacgttggacgtggggatgggggacctaaaccctaacacgttgggtcgtacacgagttccgtcttaccaccctatccccgtaccgggacncggaccttaccgatcgacccacgaacctccctaccaataaaccacacgaccctaagagtacgggagttacggaaggaacgcccttagacctaacgttccgtacgggaacccgaaccgtaccggggtcccgttacgtaactttaaccggtggttaacggcccggggtaaaacgtcccgggttaacccccgaacgggttaaccggttccccgggggttagaaacccgggtaccccggttaaccgggggcccttaaacgggggtcccgggtttaacccgttttcggggtaaacccctttcgggggttaccggggggaaccccgttaaggggggtaacccccgg

SEQ ID NO: 394720 - DNA, 681 bp, Homo sapiens
  misc_feature: GZ8MTXP01AQTV7.17.25.C03.1.454.CMB.2.raw
  modified_base (213)..(213): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctnagtgaaggtctcctgcaaggcttctggtattcacgtttacctctatagtatcaacgtgggtcgccgccgagggcccgcgtacggaaccaaccgccgtggaggtgggagtgggggatcgggggacctaaaccccgtaacacgtggtcgtccaacgtcgttccgttaccttccgaaccctacgtccccgtaacccggggaacctaacggtaccctttaaacccagttaccggaaccctaaccgtaaaccctaccctacccaaactaaaccacgactacccgtaatacgtagggtaagttggaacggacgtcgtagaacctacgtcgtacggaaccgaacccggtaccggtcccgttacttacttaccgtggtcgtacgacgaccggtcccacggttacggtccggttgaccgccgttcggcgacggtcgtaccgttcgtaccgttcgggttacgggccgttaagggcccg

SEQ ID NO: 394721 - DNA, 687 bp, Homo sapiens
  misc_feature: GZ8MTXP01ELD02.17.25.C03.1.454.CMB.2.raw
  modified_base (211)..(211): a, c, t, g, unknown or other
  modified_base (251)..(251): a, c, t, g, unknown or other
  modified_base (378)..(378): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagagcctgggcctnagtgaagtctctgcaggcttctggtattcacgttttaccnccttaatagtatcaacgtgggtcgcgccgaggccgctaggaacaacggacctggagtggagtgggagtcgggacaaacccctagactggtctcatgtcgtccttcaccctatcccgtaaccgggacncgtacttaccatcgacccaagaacctcctacaataaaccacacgactaacgtaagttgggtaagttaggaacggacgtaccgttaaggaacccttaagttacgttacgggaaaccgtaccggtaaacccggggttcccgttacctttaagttaacccgtgtaccgggaacggtaacgtaacccggtaacccccgtaagggttaccgttacccggggagaccggtacccgttaacggggcccttaaggggtcccgttccgttttaacggaccgtttccgggcgggggtaacccgttaagggggtccccgg

SEQ ID NO: 394722 - DNA, 637 bp, Homo sapiens
  misc_feature: GZ8MTXP01AIW86.17.25.C03.1.454.CMB.2.raw
  modified_base (277)..(277): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaagtcttctggtattctacgtttacctcctatagtatcaacgtgggtncgccgaggccgctcggacaacgaccgtggagtggagtgggagtcggggacgaaaccctaacgacgtggtcgtacacgtagtcgtaccttccaccctactcccgtaccgggacaacgtacctaccatcgaccacgactcctaccaataaaccacgacgtacctagtacgtaggtagttacgaggacgtccgtagacctacgtacgtacgaccgaaccgtacccggtccgttacgttaacgtttactggttccgacggtaacgtaccggtaaccccacggttacgtccccggttgaccgcccgttacggccgacggtccggtcctttggtaccgttcggttcgggaaccgaacggggtcccg

SEQ ID NO: 394723 - DNA, 798 bp, Homo sapiens
  misc_feature: GZ8MTXP01DV211.17.25.C03.1.454.CMB.2.raw
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcaggtcgtggggctggaggtgaagagccgtgggcctgagtgaaggtctcctgacaggtcttcgtggtacttctaccgttttacctaccttatagtatacaacgtgggtcgcgccgagggcccgtcgtaggaaccgaacgtaccgtggaggtagggagtagggggagtcgggaccgtaaaccccgtaaacgtacgttagggtcgtacaacgtaggttccgtccttaccaaccccgtacgtaccccggtaacccgggaacctaacggtaaccctttaacccgaacgttacccgaaccccgtaaacccgtaaacccttcccctaaaccctaaactaaaacccacgaaccgtaccccttaaataacggttagggtaaggttacgggaacggaacgtacccgtaagtaaaccgtacgttccgttaacgggaaccgaaacccgtaccgggtcccttaacgttaaacgttttaccgtaggttaccggacggtaacggtacccggttaaccccgaacggttaccggtaccggggttagaacccggtcccgaacgggttccgacgggttcccggtttaccgtttcgggtacccggttcgggccgggggtccggaacggggttccccggg

SEQ ID NO: 394724 - DNA, 645 bp, Homo sapiens
  misc_feature: GZ8MTXP01DLGIL.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcgaaggcttcgtggattctaccgttttacctcctatagtatcgaacgtgggtgcgccgaggcccgctcggaacaacgacctggagtggagtgggagtcgggaccgaaaccctaacacgtggttcgtacacgtagttccgtccttccacccctactcccgtaccgggaactaacgtaccttaccatacgacccaacgtaacctccctaccaataaaccacacgaccctaagagtagggagttaggaggacgccctagacctagtccgtaggaaccgtaccgaccgggtcccttacgttagtttaccgtgtcgacggacgaccgtccccgaagttacgtcccgggttagaaccgtcccggttaacggcgacggtccggttacgttcggtaccgttcggttcgggggtccgaaggggtccccg

SEQ ID NO: 394725 - DNA, 638 bp, Homo sapiens
  misc_feature: GZ8MTXP01CR02Z.17.25.C03.1.454.CMB.2.raw
  modified_base (294)..(294): a, c, t, g, unknown or other
  modified_base (306)..(306): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctgagtgaacggtctctgcaaggtcttcgtggacttctacgttacctctatagtatcaagtggtncgcgacggccgntacgacaacgctggagtggagtgggagtcgggactaaacctaacgacgtggtgtacacgtaagttcgtccttacaaccctagtcccgtacgggaactacgtaccttaacagtaccgaaccacgaacctccctaacaaactaaaccacacgaccctaagagtacgggtaggttacggaacggtaccaccgtacgtaactacgttcgaacggaccgacgtaccgccgttattaactacgttggtacgcggtaaacgtaccgttacccgttacggttaccgttccggtaacgcccgtacccggtacggaccgtaacggttcccgggttttaaccg

SEQ ID NO: 394726 - DNA, 544 bp, Homo sapiens
  misc_feature: GZ8MTXP01AODK5.17.25.C03.1.454.CMB.2.raw
  modified_base (208)..(208): a, c, t, g, unknown or other
  modified_base (226)..(226): a, c, t, g, unknown or other
  modified_base (239)..(239): a, c, t, g, unknown or other
  modified_base (258)..(258): a, c, t, g, unknown or other
  modified_base (267)..(267): a, c, t, g, unknown or other
  modified_base (301)..(301): a, c, t, g, unknown or other
  modified_base (308)..(308): a, c, t, g, unknown or other
  modified_base (398)..(398): a, c, t, g, unknown or other
  modified_base (412)..(412): a, c, t, g, unknown or other
  modified_base (452)..(452): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggctnagtgagtctctgcagctngattcacgtttcnctatagtatcaacgtgggncgcaggccntggacacgctgagtgatggatgggacaaccctanacgtggntcactagtcgtctcaccctatcccgtacgggacaacgtacttacccagtcgaaccacgtaaccttccaccgaataaacgactagacctanagtggagtgaggancctgacatcgacgacgacgaccggtcctctaatttccggngtacgacgacgaccgtaaccgaggttacgtccggagccgtacgttacggcgacggtcgttcgttcggtcgtcgggacgggtcgaacgggtcg

SEQ ID NO: 394727 - DNA, 570 bp, Homo sapiens
  misc_feature: GZ8MTXP01B5CSD.17.25.C03.1.454.CMB.2.raw
  modified_base (369)..(369): a, c, t, g, unknown or other
  modified_base (379)..(379): a, c, t, g, unknown or other
  modified_base (405)..(405): a, c, t, g, unknown or other
  modified_base (558)..(558): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaacgtgggtgcgccaggccgctggacaacgacctgagtggatgggatgggacgaaccctaacacgtggtgtcacagtcgtcttcacccatcccgtacccgggacngacttaaacntacgaccacgactcccacaataaacncacgcctaacagtggtagttagaggagcctagacatctagaccgacgaccggcctacgtattacgtgtcgcgagcgtcccaacgcgtcccggttgaccggccgttaacgggccacggtccggtccgtttcgaccgtttcggttcgggggccgnggggtaacccgg

SEQ ID NO: 394728 - DNA, 556 bp, Homo sapiens
  misc_feature: GZ8MTXP01AIYSF.17.25.C03.1.454.CMB.2.raw
  modified_base (281)..(281): a, c, t, g, unknown or other
  modified_base (294)..(294): a, c, t, g, unknown or other
  modified_base (307)..(307): a, c, t, g, unknown or other
  modified_base (317)..(317): a, c, t, g, unknown or other
  modified_base (347)..(347): a, c, t, g, unknown or other
  modified_base (356)..(356): a, c, t, g, unknown or other
  modified_base (413)..(413): a, c, t, g, unknown or other
  modified_base (458)..(458): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccatccctccctgtctgcctcgtggtgggggtcagagtcaccatcacttgccggacaagtcaacggtacttaaaactatttaaatggtatcagcaagaaacctaggaaacnccccagacctccngtatctctggtcncatccactcngcgaagtcggcctccatcgagttcagtgcngtgaatcgnggacagtatttacaatctacactactcaaccactctcgactaaccgtgagtattcgngactatctaactactgtacaacgtagtacgttacaccgtttcccncgtctaccgtttcggacgtaacggggaacttaaaggttcgaacgtaactacgaaacggttacttggtaacgctcgccacttacttcgttaacgtttcc

SEQ ID NO: 394729 - DNA, 654 bp, Homo sapiens
  misc_feature: GZ8MTXP01DSLOZ.17.25.C03.1.454.CMB.2.raw
  modified_base (214)..(214): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctnagtgaaggtctcctgcaaggtcttctggattctaccgtttacctcctatagtatacaacgtgggtcgcgccgaggcccgcgtcggaacaacggacctggagtggagtgggagtcgggaccgaaaccctaagacgttggtcgtacacgtagttcgtccttaccacccgtactccccgtaacccggggaactaacggtaacctttaaccgacttaccggaaccccaacgtaaacctccctaaccaaactaaaaccacaacgacctaacgagtaggtagttaggacggacgcctagacctagttcgtacggaaccgaccgaccggtcccgttacgttaacttacgtgtcgacgacggtccgtcccgagttcgtccggttagacgtccgttaacggcacggtccgtccgtttgtaccgttcgggttacgggccgaagggtcccg

SEQ ID NO: 394730 - DNA, 578 bp, Homo sapiens
  misc_feature: GZ8MTXP01EZOLT.17.25.C03.1.454.CMB.2.raw
  modified_base (387)..(387): a, c, t, g, unknown or other
  modified_base (436)..(436): a, c, t, g, unknown or other
  modified_base (454)..(454): a, c, t, g, unknown or other
  modified_base (487)..(487): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctgagtgaggtctctgacaggtcttgtgtattctaccgtttacctcctaatagtatacaacgtgggtagacgccgacggccgcgtaggaaccaacgactgagtggatgggatgggaccgaaaccctagacgtggtctcactagttcgtccttaccaccctactcccgtaaccgggacncgtacctacatcgaccacgaactccacaataaacgcacgaccagtaagngtagtcgagcgctagacncgtcgagaccgacgcggtccctattacttacgnggtcgacgacggctaaccccgagttacggtccggttgaccgccgttacggccaggtccgtctttcgcgttcggacgggcgttaagggcccg

SEQ ID NO: 394731 - DNA, 671 bp, Homo sapiens
  misc_feature: GZ8MTXP01EH6MI.17.25.C03.1.454.CMB.2.raw
  modified_base (315)..(315): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccactccctccctgtctcgcctcgtggtgggggtcagagtcaccatcacttgaccggacaagtcacggtaacttaaaacttatttaaatggtatcagacaagaaacctaggaaaacgccccaagaccctcctgatctcgtggtncctactcccactcgtaggacgtaaggtcggacctacccaagtcggtaggtttcccagggttggactaggtcggaatcgtgggactaagttcttacaactcctacaacctactaccacctactctacgacctaacgtggtaggtattggactacttaacttccttaacgttaacttacggaaacctaaacggtaacgttaccgttacccttaaccgtttcccctacgttacccgtttacggttaccgggaacccgggtaaaggggtaaaccttaaaggtacgttaaacgtaaacgttaacgaaaaccggttgttacggtcgtcgtaactacctaccttacttcgttccgtttaaccc

SEQ ID NO: 394732 - DNA, 639 bp, Homo sapiens
  misc_feature: GZ8MTXP01B4SYD.17.25.C03.1.454.CMB.2.raw
  modified_base (229)..(229): a, c, t, g, unknown or other
  modified_base (279)..(279): a, c, t, g, unknown or other
  modified_base (521)..(521): a, c, t, g, unknown or other
tcagcgtagactagcacgaccggtgctcgatttagtagtgtagatttggggtttggggggagtcagtctcagtcaggacacagcatggacatgagggtccccgctcagctcctggggctcctgctactctggctccgagctgccagatgtgacatccagatcgacccagtcctcctactccctccctgtctcgcctcgtggtggggtcagagtcacatcactgaccganagtcacgtacttaaactattaatgtatcagacaagaaacctaggaaaacnccccaagaccctctagactcgtcgtggtcactactaccctactcgtaggaccgtaaggtcggccgttcccagtcggtagttaccaggtggctaggtggaattcgtgggactaggtactttacactctccacctactccaacctactctaccgaactaaccgttaggaggtagttcgactactaactacctacttaacgtagttaaccaaacgtacgtaacgttacccgtaccgtttaccccncgttaccgttaccgtttccgggaacccgggtaaacggggaaacttaaacggtagaaacgtacgttaacgaaacgttacgttggtaacgcgttcgaccacttacttccgttcttaaccc

SEQ ID NO: 394733 - DNA, 597 bp, Homo sapiens
  misc_feature: GZ8MTXP01ATMGV.17.25.C03.1.454.CMB.2.raw
  modified_base (230)..(230): a, c, t, g, unknown or other
  modified_base (250)..(250): a, c, t, g, unknown or other
  modified_base (349)..(349): a, c, t, g, unknown or other
  modified_base (365)..(365): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggagatcctcttcttggtggcagcagctacaagtcgcccactcccaggtgcagctggtgcagtcgtggggctggaggtgaagagcgtgggctnagtgaggtctctgcagcttntggtattctacgttacctctatagtatcaacgtggtgcgccaggccgctcggaacaacgctggacgtggagtgggagtggaccgtaacctacgcgtggntcacagtctctcaccnctccgcggacacgtactacatacgaccacgaacctcctaccaactaaacaccaacgacctaacgagtaggacggttagaggtactaccgtagactactacgttaccgaacgtaccgaccggtaccgtctttaacgttacgttgggtacgaccggtacgtaaccggttacccgttacgttaccggtccgggtacgcggtacccgtacggcgtaacggttccggtttaacccgg

SEQ ID NO: 394734 - DNA, 569 bp, Homo sapiens
  misc_feature: GZ8MTXP01A0GQQ.17.25.C03.1.454.CMB.2.raw
  modified_base (211)..(211): a, c, t, g, unknown or other
  modified_base (253)..(253): a, c, t, g, unknown or other
  modified_base (273)..(273): a, c, t, g, unknown or other
  modified_base (323)..(323): a, c, t, g, unknown or other
  modified_base (363)..(363): a, c, t, g, unknown or other
  modified_base (421)..(421): a, c, t, g, unknown or other
  modified_base (429)..(429): a, c, t, g, unknown or other
  modified_base (433)..(433): a, c, t, g, unknown or other
  modified_base (449)..(449): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttctggattcacgttttaccncctatagtatcaactgggtncgccaggccgctggacaacgacctgagtggatgggatgggcaaaccctanacgtggtgtcacagtcgtcttcacccatccctacgggacngacttaccatcgaccacgaactccctacaataaacacagcctacatggattgaggacncctagacngtcngaccgacacggccgtntattactgtcgacgagcgtccccgaagacttccgggagaccggcccgttacggggcttaacggggtcccggtccttttaacggaccgttcgggttcgggggccccaagggggtaaccccg

SEQ ID NO: 394735 - DNA, 787 bp, Homo sapiens
  misc_feature: GZ8MTXP01A7Q00.17.25.C03.1.454.CMB.2.raw
  modified_base (211)..(211): a, c, t, g, unknown or other
  modified_base (274)..(274): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctnagtgaaggtctcctgcaaggcttctggattctacgtttacctctatagtatcaacgtgggtanccgccacgggcccgcgtacggaaccaaccgaccgtggagtgggagtgggggaacgttcgggggacccgtaaaaccccttaacgacgttgggtacgtccgaaacctaggttcgttccctttaccgaaccccgtacttcccggttaacccggggaactaacggtaaccctttaacccgacttaccggaacccccaacgtaaacccttcccctaaaccaactaaaaaccacctaacgaccccttaacgtaaagtgggtaacggtttacggaacgggacgtaccgttagaacctacgtacgttaccggaaacgacccgtaacccgggtccgttacgttaactttaccgtaggtccggacgtaacgttacggaacccccgtaaggttaaccgttcccggggacgaacccgggtccccgttaaacgggccggaaccgggtccccggggttacccgttttaacgggaacccgttttccggggttaaccggggggtccccgaaaccggggggtttcccccg

SEQ ID NO: 394736 - DNA, 599 bp, Homo sapiens
  misc_feature: GZ8MTXP01D83ZA.17.25.C03.1.454.CMB.2.raw
  modified_base (256)..(256): a, c, t, g, unknown or other
  modified_base (277)..(277): a, c, t, g, unknown or other
  modified_base (326)..(326): a, c, t, g, unknown or other
  modified_base (374)..(374): a, c, t, g, unknown or other
  modified_base (437)..(437): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggtcttctggtattcaccgtttaccncctatagtatcaacgtgggtncgcaggccgctggacacgactgagtggatgggatgggacgaacccctanactggtcgtcacagttcgcctttacaccctatcccgtacccgggaacngtacttaccatcgaaccacgaactcctacaataaacacacgcctacagtggagttgagggacnctagactagtcgacgaccgacgaccggtcctattacgttacgtggtcgacgtacgaccgtaacccgacgttacggtccgggttagaccggtccgaccggttcgacgggtcccggttccgtttcggtccggttcgggacggggtaaccggttcgggtaacccg

SEQ ID NO: 394737 - DNA, 792 bp, Homo sapiens
  misc_feature: GZ8MTXP01B9SO9.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaggtctcctgcaaggtcttctggtattctaccgttttacctccttatagtatacaacgtgggtgccgccgaggccgcgtggaccaacgaccgtggagtggagtgggagtcggggaccgtaaacccctaacgacgttggtcgtaccacgtacggttccgttccttaccgaccctacgtcccggtaacccggggaaccaacggtaaccttaacccacttaccggaacccaaccgtaaccctaccctacccaaacgtaaaacccaccaacgtaccctaacgaagttcgggtaaggttcgggaacggtacgtcccgtagaacctacgttacgtacggacccggaacccgtacccgggtacccgtttacttaacgtttaccgtcggttacggaccggtaacggtaaccccggttaaccccgaaccggggttacgttaccccggggttacggaaacccgggttccccggttaaaccgggggcccgaaccggggtttccccgggttcccgttttttaacgggtaaccccgggttttcccgggggttaccggggggaaccccggttaaacggggggttccccccgg

SEQ ID NO: 394738 - DNA, 772 bp, Homo sapiens
  misc_feature: GZ8MTXP01D1XWT.17.25.C03.1.454.CMB.2.raw
  modified_base (210)..(210): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgagtctctgcagtcttctggattcacgtttactctatagtatcaactgggtgccgccaggccgctggacaacgacctgagtggagtgggatcgggacgaacccctaagacgtggtcgtccacgtacgttcgtcctttacaacccctagttccccgtaaccggggaactaacggtaaacctttaaaccgacgttaccgaaccccgaacgtaaacccttcccctaacccaaattaaaaccggacctaacgaccccgtttaaaacgtaagggttacgggtaacggttacgggacggtaccgtaccgttacgaacctacgggttaccgaccggaaacccggtaacccgtaccgggttaccccgtttacgtttaaacgtttaccggtcggtaacgggtacccggtaaccgtacccggttaaccccgtaacgggttaccggttcccggggttacgtaacccgggtaccccgggttaacgggccggttaccggggttcccggtttacccgttttcggtacccggtttccggggaccgggggtaacccggttaacgggggtaacccg

SEQ ID NO: 394739 - DNA, 552 bp, Homo sapiens
  misc_feature: GZ8MTXP01AUGQ2.17.25.C03.1.454.CMB.2.raw
  modified_base (276)..(276): a, c, t, g, unknown or other
  modified_base (301)..(301): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggcactaaaacctatttaaatggtatcagcaagaaacctggaaaacnccccagaccctcctgatctctggtncatccactctgcgaagtgctccatcgagttcagtgcagtggatcgtgggacagtatttcaatctcaccatccacactctgaccaaaccgtgaacggtattgtcgactaatctaactactgtacaaacagtacgttacacgttcccctgtcctacgtttcggaaccgtaagggggttaaccctaaaggttgaaacgtaacttaccaaaacgttaaccgtggtacggtcctaggcccacctaacttcgttccg

SEQ ID NO: 394740 - DNA, 621 bp, Homo sapiens
  misc_feature: GZ8MTXP01EZQVO.17.25.C03.1.454.CMB.2.raw
  modified_base (232)..(232): a, c, t, g, unknown or other
  modified_base (295)..(295): a, c, t, g, unknown or other
  modified_base (365)..(365): a, c, t, g, unknown or other
  modified_base (472)..(472): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactccccaggtgcagctggtgcagtctggggctgaggtgaagaagcctggggcctnagtgaaggtctcctgcaaggcttctggtattctacgttacctcctatagtatcaaactgggtncgccacggccgcgtcggacaacgacctggagtggagtgggatggggaccgaaaccctaacacgttgggtntccactaagttcgtcttccaccctatcccgtccgggacacgaccttaccatcgaaccacgaacctcctaccaataaaccacagcctaacgatgggagttggaaggcncgtgaaccagttcgacggaaccgaacgacccggtaccgtagttaacttaacgttggttcggaccgaacggtaccgttaccccgacgttaacgttcccgggtagaacccggtcccgtaacgggccgtaacgggttcccggtttaacccgg

SEQ ID NO: 394741 - DNA, 589 bp, Homo sapiens
  misc_feature: GZ8MTXP01EB240.17.25.C03.1.454.CMB.2.raw
  modified_base (220)..(220): a, c, t, g, unknown or other
  modified_base (297)..(297): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcacatcacttgccganagtcacggacttaaactatttaaatggtatcagacagaaacctggaaaacgccccagacctcctgatctctgggtcncactccactcgtgacgaagtcggccgtacccagtcggagttccaggtggcaggtggaatcgtgggactagtatttcaatctacacatcacctactctagactaaccgtgaggtattggtacactaacttccttaacgtacttacgtaaccaaacgtacgtacgttacctaccgtttacccctcgtaccttacgttttcggacccgtaacggggtaaccttaaaggttcgaagtaactaacgaaaacgttacgttggtcggactcgacctaccttacttccgttcgtttaacc

SEQ ID NO: 394742 - DNA, 625 bp, Homo sapiens
  misc_feature: GZ8MTXP01A8NK7.17.25.C03.1.454.CMB.2.raw
  modified_base (213)..(213): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctnagtgaaggtctcctgcaaggcttcgtggtattctacgtttacctctatagtatcaacgtgggtgcgccgaggccgcgtcggacaacgactggagtggacgtgggagtcgggaccaaccctaacgacgtggtcgtcacgtaggttccgtccttaccgaccctacgtccccgtaacccgggaacaacgtaccttaaccattacgaaccctacgaacctccctaccaaataaaccacacgaccctaagtacgtagggtagttgggaggaacgtcctagaacctaggttcgtacggaccgaccgtaccgggccttacttagttaccgtggtacgcgtaacgtccgtaacccgacgttacgtccggagacgccgttaggcacggtcgtcttgcgttcggcgggccgttaagggcccg

SEQ ID NO: 394743 - DNA, 556 bp, Homo sapiens
  misc_feature: GZ8MTXP01D2B42.17.25.C03.1.454.CMB.2.raw
  modified_base (434)..(434): a, c, t, g, unknown or other
  modified_base (452)..(452): a, c, t, g, unknown or other
  modified_base (471)..(471): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaaggtctcctgcaaggcttctggattcacgtttacctcctatagtatcaactgggtgcgccaggccgctggacaacgcctgagtggatgggatgggaccaaccctaacacgtggtcgtcacagtcgtccttcgacccatcccgtaccgggacaagaccttaccgatcgaccacgaacctccctaccaataaacacacgacctaacagtggattggagacnctagacatctgaccgacnccggcctactattactgtnacgagcgtccccagacgtccggttagacgccttagttcggacgaacggtccggtcctttaggccttcggtcgggccgtaacgggg

SEQ ID NO: 394744 - DNA, 786 bp, Homo sapiens
  misc_feature: GZ8MTXP01A1B8D.17.25.C03.1.454.CMB.2.raw
  modified_base (212)..(212): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtgggcctnagtgaaggtctcctgcaggcttcgtggattctacgtttacctcttatagtatcgaacgtgggtgccgaccgacgggccgctacggaaccaacgtaccgtggacgtgggagtaggggacgtcgggggacccgtaaaccccttaacgacggttggtcgtacaacgtacggttccgttaccttaccgaaccccgtacgttcccccggttaacccggggaactaacggtaaccctttaacccgagttacccgaaaccctaaccgtaaaccctttcccaaccctaaactaaaacccaccgaacgtaccctaaacgtaacgttgggtaacggttacgggaaggtaaccgtcccgttaaagaacccgttaggttacccgtaacggggtaaacccgacccggtaaacccggggttccccgttaactttaaacgtttacccggttggtaccggtaccggtaacggtacccggtaacccctaacgggttacggtccccgggttagaaccggtacccggttaacgggcaacgggtcccggttaccgtttcggaccgtttcgggcgggggtccgaagggggtcccg

SEQ ID NO: 394745 - DNA, 671 bp, Homo sapiens
  misc_feature: GZ8MTXP01CQ6I4.17.25.C03.1.454.CMB.2.raw
  modified_base (269)..(269): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctctatagtatcaacgnggtgccgcgaggccgctggacaacgacctgagtggagtgggatcgggacgaaaccctaacgacgtggtcgtacacagtccgtcttaccaccctatcccgtaacccgggacaacgaccttaaccactacgacccacgtacctaccctacaactaaaaccacacgtcctaacagtgggtagtaggaaggacgcccttagaacacgttacgtaggaaccgaaccgccggggtacccttcgttaactttaaccggttggtaccggcgtaacggtaaccgtaacccccgtaacggacggtttccccgggagaacccggtcccggttaaccgggcgttacgggtaacccgggtttcccgtttcggacccggtttccgggccgggggtaacccgaacgggggtcccggg

SEQ ID NO: 394746 - DNA, 722 bp, Homo sapiens
  misc_feature: GZ8MTXP01EE2JP.17.25.C03.1.454.CMB.2.raw
  modified_base (355)..(355): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtgggcctcgagtgaaggtctcctgcaaggcttcgtggattctaccgtttacctcctatagtatcaacgtgggtgccgccgacggcccgactcggaacaacggacctgaggtggagtgggagtcggggaccgaaacccctaaagccgtggtntaccgacaacggttcgttccttaccgacccctacgtccccgtaacccggggactaacggtaccttaacccagtaccgacccaacgtaacctacccctaccaaataaaccacaacgaccctaacgtaacgttagggtaaggttggaacgggacgtaccgtaggtaacctacggtaccgttacggaaccggaccgtaccgggtacccgttcgtttaacgttaccgttggttccggacgtacggtaccggtaacccgtaacggttacgttacccgggttagacgggtacccggttaccgggcgttacgggtcccgggttcccgtttaacggtccgttccggggcgggggtaacccgaagggggtccccgg

SEQ ID NO: 394747 - DNA, 562 bp, Homo sapiens
  misc_feature: GZ8MTXP01AD72K.17.25.C03.1.454.CMB.2.raw
  modified_base (290)..(290): a, c, t, g, unknown or other
  modified_base (302)..(302): a, c, t, g, unknown or other
  modified_base (355)..(355): a, c, t, g, unknown or other
  modified_base (386)..(386): a, c, t, g, unknown or other
  modified_base (548)..(548): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcaccatcacttgccggacaagtcacggtacttaaactattaaatggtatcagcaagaaacctaggaaacgccccagaccctcngatctctggtcncatccactcgtgacgagtcggcctccagtcgagttccagtgacagtgaatcgnggacagtattacaattcacaccatccgaccnctctcgacacgtagacgtattgcgactaattctactactagtacaaacgtagtacttacctaccgttcccctcgtaccgttacgtttcgggacccggtaaggggaaaccttaaaggttcgaagtactaacgaaacgttacttcggtaacgctcggacctacnttcttcgtttaacc

SEQ ID NO: 394748 - DNA, 665 bp, Homo sapiens
  misc_feature: GZ8MTXP01CLSUK.17.25.C03.1.454.CMB.2.raw
  modified_base (177)..(177): a, c, t, g, unknown or other
  modified_base (470)..(470): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtncagtctggggctgaggtgaagagccgtggggccctagtgagtacgtcctcgcgagacgttctgtattctaccgttaccttacctattagtatactacgtaggtgcgccgacggccgcgtgacgaaacgaccgtggagtgggagtggggacgtacgggaccggaaaccccgtaaacgtaacgtgggttgtactacgaacgttcggttaccccttcctaacccacgttcccgtacccggggaaacctaagtaaccgtaacctacacgtacccaaccgaacctaccctacccaaanaaaactacacgtcctaaccagtaggacggtttagagggacgaccccttggaactattacggtacgaaccggaacctcccgggctttccgtaattaccgtagtcggacgtaggacgttccccaaggagttcccggtagcgacctcgggttaccgcggttccgttcttgtcgtcgggcgggccgtaacggccgtccg

SEQ ID NO: 394749 - DNA, 589 bp, Homo sapiens
  misc_feature: GZ8MTXP01EYK7J.17.25.C03.1.454.CMB.2.raw
  modified_base (215)..(215): a, c, t, g, unknown or other
  modified_base (356)..(356): a, c, t, g, unknown or other
  modified_base (433)..(433): a, c, t, g, unknown or other
  modified_base (468)..(468): a, c, t, g, unknown or other
  modified_base (502)..(502): a, c, t, g, unknown or other
  modified_base (510)..(510): a, c, t, g, unknown or other
  modified_base (562)..(562): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagccgtgggcctnagtgaaggtctcctgacaaggtcttctggtattcgtacgttttacctctatagtatcaacgtgggtgccgccgaggccgctacggaccaacggtacctggaggtggagtgggagtcggggaccaaaccctaacacgtggtntacatagttcgtcctacacccatcccgtacgggaactcgaccttaccagtacgaccctaacgaacctccacctaaanaaacacagacctagtagtagggtatacggaggacncctagacctagtcgtacggaccacgcggtccttntattacgngtacgagacgactcccagttacgtccggagcgccttagggcacggcccggtnttcgcgttcggcgggtccgaagggccg

SEQ ID NO: 394750 - DNA, 609 bp, Homo sapiens
  misc_feature: GZ8MTXP01EDOR9.17.25.C03.1.454.CMB.2.raw
  modified_base (232)..(232): a, c, t, g, unknown or other
  modified_base (347)..(347): a, c, t, g, unknown or other
  modified_base (403)..(403): a, c, t, g, unknown or other
  modified_base (412)..(413): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcgtgggcctcagtgaagtctctgcaagtctntggtactttactacgttacctctatatatacgacgtggtcgcgccgacggccgcgtacgacgaacgacgtgaggtaggagtggagtacggaccgaaccgtacgtacgtgtcgtanactacgtcgttctaccaccctacgtaccgtaccggaacgtacgtaacctacctacnactacgacnncaaccgtaacctacctacctaacaaccacacgtactacgtagtaggtacgtacgacggtacgtacgtacgtacgtacgtaccgtacggtaaccgtaaccgttacggttaccgttacgttacgttacgttacggttacgttaccgtaaccggtaccgtaacccgtacggtacggttaccggtaacggaaccggtccg

SEQ ID NO: 394751 - DNA, 555 bp, Homo sapiens
  misc_feature: GZ8MTXP01D1G5B.17.25.C03.1.454.CMB.2.raw
  modified_base (209)..(209): a, c, t, g, unknown or other
  modified_base (244)..(244): a, c, t, g, unknown or other
  modified_base (314)..(314): a, c, t, g, unknown or other
  modified_base (437)..(437): a, c, t, g, unknown or other
  modified_base (537)..(537): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggcctnagtgagtctctgcagcttctgattcacgtttaccncctatagtatcaacgtgggtgcgccaggccgctggacacgacctgagtggatgggatgggcaacccctanactggtgtcactagtcgtccttcaccctatcccgtcccggggacaacgtaccttacccaatcgaaccacgaactccctaccaataaacacacgcctaacagtggagttgacggagcctagacncgtctgaccgacgacggtccgtacttattaccgtgtcgtcgagcgtaacccaggacgtccggttgacgtccgttacggcacggccgtcgtttgcgttcgnggggtcccgaagggtccg

SEQ ID NO: 394752 - DNA, 605 bp, Homo sapiens
  misc_feature: GZ8MTXP01DTT9J.17.25.C03.1.454.CMB.2.raw
  modified_base (229)..(229): a, c, t, g, unknown or other
  modified_base (478)..(478): a, c, t, g, unknown or other
tcagcgtagactagcacgaccggtgctcgatttagtagtgtagatttggggtttggggaaccacatctgtcctctagagaaaaaccctgtgagcacagctcctcaccatggactggacctggaggatcctcttcttggtggcagcagctacaagtgcccactcccaggtgcagctgggtgcagttcgtggggctggaggtgaagaagccgtgggcctcagtgaaggtcnctgcaggtcttgtggtattactaccgtttacctcctatagtatacaacgtgggtgccgccgacggccgcgtggacaacgaccgtgaggtggagtggggaacgtcgggacctaaaccccttaagcgttggtgtaccagtacgttccgtcctaccaccctacttccccgaacccgggacaacgtactaccagtaccgaaccaacgactaccctaccaactaaacacacgctagacgtggtagtgacggacnctagactgtacgtagacccgacgacggtccttgttacttacgtgtcggacgtacgcgtaacccacgacgtccggttgtacgcgttcgcgacggtcgtcgttgtcgtcggcggtccgaacgggtcccg

SEQ ID NO: 394753 - DNA, 672 bp, Homo sapiens
  misc_feature: GZ8MTXP01D53VP.17.25.C03.1.454.CMB.2.raw
  modified_base (212)..(212): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagcgtgggcctnagtgagtctctgcagtcttgtgattctacgtttcctctatagtatacacgtggtcgcgccgacggccgcgtggaacaacgaccgtggagtggagtgggagtcggggaccgaacccctaacgacgttggtacgtcaagtacgttccgtccttaccaaccctacgtcccgtaacccgggaactaacgtaacttaaaccgactacgaaccctaacgaaaccttccctaacccaaataaacccacgaccgtaccctaaataggtacgggtagttaggaacggtacgacttaaggacctaggttacccgaggaaccgtaccggacgggtcccttagttaacgttaacgtggtacgacggtaacgtccggtaaccctagggaccgttcccgggttaagaccgtcccggttacgggcacgggtccgttctttcggaccgtttcggacggggtaacgaacgggtcccg

SEQ ID NO: 394754 - DNA, 765 bp, Homo sapiens
  misc_feature: GZ8MTXP01BYANN.17.25.C03.1.454.CMB.2.raw
  modified_base (255)..(255): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctgagtgaagtctctgcaggtcttcgtggtattctacgtttaccnctatagtactcaacgtgggtgccgccgacggccgcgtacggaaccaaccgaccgtagaggtgggacgtagggggaagtcgggggacccaaaccccgttaaacgaccgttagggtcgtaccgaacgtacgtttcggttaccctttaccgaaccccgtacctccccggtaacccggggaactaacggtaaaccctttaacccgaacgttacccgaaacccctaaccgggtaaacccttaccccctaaccctaaactaaaaccgaaccgtaccggtacccttaaacgtaacgttagggtaacggtttacgggaaggaccgtaccgtagaaccgtacgtaccgtaggaaccgtaccgaccggtccgtacttagttaccgtggtcggtaccgacggtaccgtaacccgtaacggacgttccgggagacccgtcccggttcgggaccgttaccgggtcccggtttcccggttcgtacccggttcgggttacggggtcccggttcggggtaaccccg

SEQ ID NO: 394755 - DNA, 709 bp, Homo sapiens
  misc_feature: GZ8MTXP01BLLFJ.17.25.C03.1.454.CMB.2.raw
  modified_base (211)..(211): a, c, t, g, unknown or other
  modified_base (251)..(251): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctgggcctnagtgaaggtctcctgcagtcttctggattcacgtttaccnctatagtatcaacgtgggtcgcgccgaggccgctggacacgactgagtggagtgggatgggacgaaaccctagacgtggtcgtcacgtggtaccgtccttccacccgtacttccccgtaacccggggaactaacggaaccctttacccgaagttacccggaaccccaaccggtaaacccttcccctaaccctaaactaaaaccgaaccacggtacccttaacgaagttcggggtaaagttcgggaaagggtacgaccgttaggaacctaacggtcgttaacggaacccgaaccggacccggtcccgttacgttaactttacgtcggtacgtaccgacggaccgtaaccccgaacgttaccgttccggggacgtaaaccggtcccgacgggcccgttacgggtcccggttctttcgggaccgttttccgggcgggggtaacccgaacggggttccccgg

SEQ ID NO: 394756 - DNA, 739 bp, Homo sapiens
  misc_feature: GZ8MTXP01AGP4E.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagtagctacaagtgcccactcccaggtgcagctggtgcagtcgtggggctggaggtgaagagccgtgggcctcagtgaggtctccgtgcgaaggtcttcgtggtacttcgtaccgtttacctctatagtactacgaacgtgggcgcgaccgacggccgacgtacggaacaaccgaccgttggacggtggacggtgggagtcgggaacctaaacccgtagacgttggtacgtacacgtaggttcgtccccttacccgacctacgtccccggtaccggaaactacgtaacccttaaccgactaccgaaccctaaccgtaacctccctaaccaactaaacacaacgtacctactaggtacggagttggacggtacgtacctagacctacgtacggtacggaacgtacccgaccggttccgttactacgtttacgtacggtcgaccggtaacgtacccgtacccggtaacgtaaccggttcccggggtacggaccggtacccgtaccggggttacgttacccggggttcccgtttaaccggtttaccggtccggttttcgggggaccgggggttaccgtaaccgggggttcggtttccccggg

SEQ ID NO: 394757 - DNA, 624 bp, Homo sapiens
  misc_feature: GZ8MTXP01BHZBT.17.25.C03.1.454.CMB.2.raw
  modified_base (215)..(215): a, c, t, g, unknown or other
  modified_base (541)..(541): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgccccactcccaggtgcagctggtgcagtcgtggggctggaggtgaagagccgtgggcctnagtgagtctctgcagcttcgtggtattctaccgtttactctatagtatcaacgtgggtgccgtccgaggccgctcggaaccaacgacctggacggtggagtgggggagtacgggggacctaaaccccgtaaactacgtggtacgtccgacgtacgttcgttccttaccaccctacgtcccgtaacccgggacaacgtaccttaccactcgaaccacgtaacctccctaccaaataaaccacacgacctacagttacggagttaggacggacgccgtagacgtacgtcgtagaaccgacgtaccgtccgtactagttaccgtgtcgngacgccgtccgaacggttcgtccggttacgcgtaccgcggcgcgtccggtcgttcgtcgtcggttcgggaacgcgggtaaccg

SEQ ID NO: 394758 - DNA, 731 bp, Homo sapiens
  misc_feature: GZ8MTXP01EY9EY.17.25.C03.1.454.CMB.2.raw
  modified_base (234)..(234): a, c, t, g, unknown or other
  modified_base (291)..(291): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctnagtgaaggtctcctgcaggctctgattcacgttcctctatagtatcaacgtgggtcncgcgaggccgctggacaacgcgtggacgtggagtgggatcggggacctaaacccgtaaccgacggttggtcgtaccacggtaaacggttcgtcctttacccgaacccgtacgttccccgttacccgggggaacacggttaaaccctttaccaacgttaccgaacccgtaacgtaaacccttccctaacctaaactaaaaccgaccaaaccggtccctaaacgtaacgttacggggtaagggtttacgggaacggggtacgtacccgtacggtacctaacgtttaccgtacgggaacccggaccgtaacccggggtccgttaaccttaagtttaacccgttggttacggaccgtaacggtaacccgttacccgacggttaaccggttccgggacggtaaccgtacccggtacggaccggtcggttaaccccgggtttccgg

SEQ ID NO: 394759 - DNA, 696 bp, Homo sapiens
  misc_feature: GZ8MTXP01ALCUQ.17.25.C03.1.454.CMB.2.raw
  modified_base (225)..(225): a, c, t, g, unknown or other
  modified_base (275)..(275): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctgagtgagtctcngacagtcttgtgtacttctacgtttacctctatagtatcaacgtgggtcncgccgacgggcccgtcgtacggaaccaacggaccgtggaggtgggagtggggagtcggggaccgaaacccttaacgacgtggtacgtcacgtagtcctccgttaccaccccgtacgtcccgtaaccgggaactaacggtaccttacccgactaccgaacctaccgaaccttacccaccaaactaaaccacgtacgacctaacgacgtagggaagttaggacggtacgtcccgtagtaactacggtaccgtacggaaaccggtacccgtaacccgggttcccttacgtttaacgtttacgtcggtccggacgtaacggccgtaaccccgagttacggtccggttacggccgtaccgttcggacgttccggtccggttccgttcggtccgttacgggttcggggaaccgttggggtaaccccg

SEQ ID NO: 394760 - DNA, 808 bp, Homo sapiens
  misc_feature: GZ8MTXP01EJSJ9.17.25.C03.1.454.CMB.2.raw
  modified_base (211)..(211): a, c, t, g, unknown or other
  modified_base (283)..(283): a, c, t, g, unknown or other
  modified_base (337)..(337): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtgggcctnagtgagtctctgcagtcttcgtggtattctaccgtttacctctatagtatcaacgtgggtgcgccaggccgntcggacaacgccgtggagtggagtgggagtcgggaccaaccctaagacgtggtntcacgtcgtcgtcctacaccctactcccggtaacccgggactaacgtaccttaaccacgtaccgtaaacccgaacgtaacccttaccctaacccaaacttaaaaccaccgaacgtacccttaacgtaagttacggggtacggttacgggaacgggtaccgtaccgttaacgtaacccgtacggtttacccggttaacgggaaccccggaacccggtaacccggggttccccgtttaaaccctttaacgttttaacccggtggggtaaccgggtaccgggtaaaaccggtccccgggttaaacccccgtaacgggttacccggtttccccgggggttaacggacccggggttaccccggttaacccgggggcggttaaccccgggggtttcccggtttaacccggttttcggttaacccggggtttccgggggccggggggtaaccccggttaaacggggggtccccccggg

SEQ ID NO: 394761 - DNA, 717 bp, Homo sapiens
  misc_feature: GZ8MTXP01EX0UH.17.25.C03.1.454.CMB.2.raw
  modified_base (214)..(214): a, c, t, g, unknown or other
  modified_base (259)..(259): a, c, t, g, unknown or other
  modified_base (278)..(278): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctnagtgaaggtctcctgcaaggtcttcgtggtattctacgtttaccnctatagtatcacgtgggtncgccgaggccgcgtaggaccaacgaccgtggagtggagtgggagtcggggaccaaacccctaagacgttggtctacacgtagtccgtccttaccacccgtactccccgtaacccgggaactaacggtaacccttaccaacgtccggtaaaccccaacgtaaaccctacccttaccaaataaacccacgacgtaccctaagaaggttagggtagttacggaagtacgcccgttagaaccctaggttcgtaacggaaccgtaccggtaccgggtacccttacttaacgtttaaccggcggtacgacgtaacggtacccgtaaccgtaacggttccggtccggacgtacccgggtaacccgttcgggcggttaccgggttcccgggttacgtttcgggtaccgggttccgggggacgggggtaaccggttaacgggtcccgg

SEQ ID NO: 394762 - DNA, 583 bp, Homo sapiens
  misc_feature: GZ8MTXP01DWGA0.17.25.C03.1.454.CMB.2.raw
  modified_base (226)..(226): a, c, t, g, unknown or other
  modified_base (281)..(281): a, c, t, g, unknown or other
  modified_base (304)..(304): a, c, t, g, unknown or other
  modified_base (415)..(415): a, c, t, g, unknown or other
tcagcgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtcctccatccctccctgtctgcctcgtggtgggggtcagagtcaccatcacttgccganagtcacggtacttaaaactatttaaatggtatcagacaagaaacctaggaaaacncccagacctctgatctgtggtcncactccactcgtgacgaagtcggcctccagtcgaggttcaggtggctaggtggaatcgtgggactagtacttacatctacacactaccaccactccacaacgtgagtatgnacaatctactacgtacgtacaacagtacttacctaccgttcccctacgtccttacggtttacggaccggtaacggggtaaacctaaaggttagaacgttaacgtaaacgtaaacgttaacgttggttacgtctacgcctacctacttacgttaacgttaactttaacc

SEQ ID NO: 394763 - DNA, 824 bp, Homo sapiens
  misc_feature: GZ8MTXP01ADP9V.17.25.C03.1.454.CMB.2.raw
  modified_base (256)..(256): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattctacgtttaccnctatagtatcaacgtgggtcgcgcgaggccgctggaaccaacgaccgtggaggtggacgtgggggagttcgggggaccgaaacccgtaacgtacgtggtcgttacacgtaggtccgttccgttaccaaccctacgtccccggttaaacccggggaactaacggtaacctttaccgaacgttaccgaaacccgtaaccggtaaaccttcccctaaaccctaaacgttaaaacccaaccgaccgtaacccttaaacgtaacggttacgggaaggtttacggaacgggttacgtaaccccttaaggaaccgtacgtttaccggtaaccgggtaaacccggaccggtaaccccggggtacctttaaccgttaaacggtttaaccgttgggtaacccggtacgggtaaccgtaacccggggttccccgaaacggttaaccgggtttcccgggttaaggaacccgggtccccgttaaaccgggggcccggttaaccggttccccgggggtttcttttaacccggggtaccgtttaccggggttccgggggaacccgttaaggggggttcccccg

SEQ ID NO: 394764 - DNA, 609 bp, Homo sapiens
  misc_feature: GZ8MTXP01A4UYY.17.25.C03.1.454.CMB.2.raw
  modified_base (258)..(258): a, c, t, g, unknown or other
  modified_base (277)..(277): a, c, t, g, unknown or other
  modified_base (334)..(334): a, c, t, g, unknown or other
  modified_base (425)..(425): a, c, t, g, unknown or other
  modified_base (450)..(450): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcgagtgaaggtctcctgcaaggtcttctggtattctacgtttaccncctatagtatcaagtggtncgccaggccgctggacaacgcctgagtggatgggatgggacaaccgtacacgtggtntcacgagttccgtcctacaccctgtcccgtaacgggacaagtacccttaaccatacgaccacgaacctcctacaataaacacagaccctanagtggtagtgaggcgcctagaactntctacggaccgacgaccggtcctactaagttcgtggtcgacgagtacccgccccgtaacggacggtcccgggttagaccggtccgttacgggcgacgggttccccggttctttaacggccggtttcgggaccgggggaacccgttaacgggggtccccg

SEQ ID NO: 394765 - DNA, 588 bp, Homo sapiens
  misc_feature: GZ8MTXP01A8CFO.17.25.C03.1.454.CMB.2.raw
  modified_base (274)..(274): a, c, t, g, unknown or other
  modified_base (446)..(446): a, c, t, g, unknown or other
  modified_base (539)..(539): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctacctgcaaggcttcgtggattcacgtttacctctatagtatcaacgtgggtnacgccaggccgcgtcggaacaacgacctggacgtggagtgggatcggggaccaaaccctacgacgtggtctacactagttccgtccttacaccctactcccgtaaccgggacaacgtaccttaccatacgaacccacgaacctccctacaaacgtaaaccacgactaccaanaagtgggtagttgaagggactccagaccaggtctagacctacgaccggtccctattaactaccgtgtcgacgagaccgtcccagttcgtccgngaccgccacgcacgggtcgtcttgaccgttcggcgggccgaagggcccg

SEQ ID NO: 394766 - DNA, 777 bp, Homo sapiens
  misc_feature: GZ8MTXP01B088H.17.25.C03.1.454.CMB.2.raw
  modified_base (225)..(225): a, c, t, g, unknown or other
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatgacccagtcctccatccctccctgtctgcctcgtggtgggggtcaggagtcacatcactgccganaagtcgacggtaacttaaacctatttaaatggtatcagacaagaaacctaggaaacgccccaagacctctagtacttctcgtgtcgactacctacctactcgtcggaacgtacgggtccggtacccttaccgagtacgggttacgtacggtacgggtcggtacgtagggtaggtaacgtacgggtaaggaacgttaacgtttacttacctaaacttccaaccctaaaccctacctaacccaacccggttacctccgtaaccgtaacccgttaaaccggggttaggtaaacgggtttctcgggtaacctaaacgtttaccttaaccttaaccggttaacgtaaccggttaaaccaaacggttaacggtttaacctttaacccggttcccccgtttaccccgtacggttaacccgtttttaccggggttaacccgggaaccgggggtaaaccgggttaaaaccgttaagggttaccgaacgttaaactaaaccgggttaaaccttgggttacgggtctaacgttccggacctacttacttcgtttccgttaacc

SEQ ID NO: 394767 - DNA, 640 bp, Homo sapiens
  misc_feature: GZ8MTXP01B1XHE.17.25.C03.1.454.CMB.2.raw
  modified_base (334)..(334): a, c, t, g, unknown or other
  modified_base (379)..(379): a, c, t, g, unknown or other
  modified_base (468)..(468): a, c, t, g, unknown or other
  modified_base (475)..(475): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttctggtattcacgtttacctcctatagtatcaacgtggtgcgccacggccgctcggacaacgcctgagtggagtgggagtcgggaccgaacccctaacncgtggtcgtcactagtcgtccttcaccctatcccgtaccgggacncgtaccttacgactcgacccacgtaaaccctccctacccaaactaaaccacgacgtaccctaacgtagtcgggtagttcggaacggacnccgttanaccacggtctacggaaccgaccgaccgggtccttacgtacttacgtcgtcgacggtacgtaccgtcccgaacgttacgtcgggcgaccggtcccgttacgggcgacgggtcccggtaccgtttggtacccgttcggttccgggggtaaccgcggggtaaccccgg

SEQ ID NO: 394768 - DNA, 671 bp, Homo sapiens
  misc_feature: GZ8MTXP01BC4C5.17.25.C03.1.454.CMB.2.raw
  modified_base (213)..(213): a, c, t, g, unknown or other
  modified_base (235)..(235): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggctnagtgagtctctgcagtcttcgngtattctacgtttacctctatagtactcaacgtgggtcgccgccgaggccgcgtacggaaccaacggaccgtggaggtgggagtgggacgtcgggaccgtaaaccctagtcggttggtcgtacacgtagttccgttacccttaccgaacccgtacgttcccccgtaacccggggaactaaccgtaaccctttaaccgacgtaccggaaccccaaccgtaaccttccctaaccaaactaaaccgacacgtaccctagtaaggtgggtagttcgggagtacgtccgttagaccacggttaccgtacggaaccgtaccggtaccgtccgttactttacgtacggtgcggtacgacgtccgtccgacgttacgtccggagcccggacttacgggcttacggtccgtcttaacgcgttcgggcgggtccgaagggtccccg

SEQ ID NO: 394769 - DNA, 552 bp, Homo sapiens
  misc_feature: GZ8MTXP01AGOH5.17.25.C03.1.454.CMB.2.raw
  modified_base (252)..(252): a, c, t, g, unknown or other
  modified_base (324)..(324): a, c, t, g, unknown or other
  modified_base (331)..(331): a, c, t, g, unknown or other
  modified_base (366)..(366): a, c, t, g, unknown or other
  modified_base (427)..(427): a, c, t, g, unknown or other
  modified_base (463)..(463): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaaggcttctggattcacgtttaccncctatagtatcaactgggtgcgccaggcccgctggacaacgcctgagtggatgggatcgggacaaccctaancgtggtntcactagtcgtcttcacccatcccgtaccgggacngtaccttaccatcgaccacgactcctacaataaacacacgcctacagtggagttgaggacncctgacagttcacgacgacacgggtcctctattacngtcgcgagacgtccccaagacgtcccgggttgacgtccttacggcacggtccgtaccttgaccgtttcggcggggtccaaggggtcccg

SEQ ID NO: 394770 - DNA, 614 bp, Homo sapiens
  misc_feature: GZ8MTXP01CYK2W.17.25.C03.1.454.CMB.2.raw
  modified_base (211)..(211): a, c, t, g, unknown or other
  modified_base (230)..(230): a, c, t, g, unknown or other
  modified_base (246)..(246): a, c, t, g, unknown or other
  modified_base (315)..(315): a, c, t, g, unknown or other
  modified_base (345)..(345): a, c, t, g, unknown or other
  modified_base (361)..(361): a, c, t, g, unknown or other
  modified_base (407)..(407): a, c, t, g, unknown or other
  modified_base (448)..(448): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggttgcagcagctacaagtgcccactcccaggtgcagctggtgcagtctggggctggaggtgaagagccgtgggctnagtgaggtctctgcagctntggattcacgtttacnctatatatcagtgggtgcgccgaggccgctggacacgacctgagtggagtggagtgggaccaaccctanacgtggtagtcacagtccgtcctcaccctntcccgtaaccgggacncgtaccttaaccatacgaccacgaacctcctaccaaacgtaaaccncacgacctaacgagtacgggtagttggaggacgcctagacncttcgtacgaccgaccgaccgggtccttaccgtatttacgcggtcgacggacgcgttaacccacggttacgtccgggttagaccggtcccgttaacgggcgaccggtcccgggttcccgtttcggtacccgtttccgggaccgggggtccgaacgggggtccccgg

SEQ ID NO: 394771 - DNA, 864 bp, Homo sapiens
  misc_feature: GZ8MTXP01ELD3L.17.25.C03.1.454.CMB.2.raw
  modified_base (267)..(267): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagacgcgtgggcctgagtgaacggtctctgacgaaggtcttcgtggtactttacctaccgttttaccnccttaataggttataccgaacgtgggtgccgccgaaggcccgacgtcgggaaccaaccgtaccgttggaggttagggagtacgggggacgttacgggggaaccctaaacccccttaaagtacgtttacgggggttctacgtaaccgtaaggtttccccggttacccttttaccaaaccccgtaccgttacccccggttaaaccccggggggaacttaacccgggtaacctttttaaacccgaaacgttaacccggaaacccccgtaaacccggtaaaccccgttttccccaaaacccttaaaactaaaaaaccccacccggtaaaccgtaacccccttaaagtaaaccgggtttacggggtaaggtttaacgggaacggtaacccgtcccgttagaaaccgttaacgtcgttaaccggggaacctaaccccggtcgggttaacccccttagtttaaacgttccggttaggtcggaaccggttacggcccgtaacccgagggttacccgtcggggttacgaaccggtaccggttaccgcggcggtcccgggttcttaacggtcggttcgggccgggggaacgttaaccggggtccccg

SEQ ID NO: 394772 - DNA, 567 bp, Homo sapiens
  misc_feature: GZ8MTXP01AHPE4.17.25.C03.1.454.CMB.2.raw
  modified_base (224)..(224): a, c, t, g, unknown or other
  modified_base (279)..(279): a, c, t, g, unknown or other
  modified_base (305)..(305): a, c, t, g, unknown or other
  modified_base (377)..(377): a, c, t, g, unknown or other
  modified_base (416)..(416): a, c, t, g, unknown or other
  modified_base (549)..(549): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccatcctccctgtctgcctcgtggtgggggtcagagtcaccatcacttgccganaagtcaacggtacttaaaactatttaaatggtatcagacagaaacctggaaaacnccccagacctctgactctcgtggtcnctactccactcgtaggcgaaggtcggccgttacccattcggaggtttcccgaggtggacgaggtgaattcgngggactagtatttacaacttcacacactaccaccactcncgacaacgtagagtatgacacaattcgtaacgtctacgtacaactagtactacgtaccgttccctcgtcgtacgtttcggccgtaagggaacttaaggttcgaataacgaacgaaacgttacgttggtcgacncgacctcttatcgttctc

SEQ ID NO: 394773 - DNA, 551 bp, Homo sapiens
  misc_feature: GZ8MTXP01A7BE8.17.25.C03.1.454.CMB.2.raw
  modified_base (254)..(254): a, c, t, g, unknown or other
  modified_base (274)..(274): a, c, t, g, unknown or other
  modified_base (326)..(326): a, c, t, g, unknown or other
  modified_base (367)..(367): a, c, t, g, unknown or other
  modified_base (403)..(403): a, c, t, g, unknown or other
  modified_base (413)..(413): a, c, t, g, unknown or other
  modified_base (415)..(415): a, c, t, g, unknown or other
  modified_base (445)..(445): a, c, t, g, unknown or other
  modified_base (469)..(469): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttaccncctatagtatcaactgggtncgccaggcccgctggacaacgcctgacggtggatgggatgggacaaccctanactggtgtcacagtccgtcttcacccatccctaccgggacngtacctacatcgaccagaacctccaccgaataaacncgagcctaangnggtagttgacgacgcctagaccaaggttcngacgacacgggccctgtattacgngtcgacgacaccgtccgagcgtcggacgacgtcccgttaggcgttcgtccgtacttgaccgttcggcgggccgttaagggcc

SEQ ID NO: 394774 - DNA, 752 bp, Homo sapiens
  misc_feature: GZ8MTXP01A14TI.17.25.C03.1.454.CMB.2.raw
  modified_base (213)..(213): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctnagtgaaggtctctgcgaaggtcttcgtggtattctacgtttacctctatagtatcaacgtgggtcgccgccgacggcccgtacgtacggaaccaacgtaccgtggaggtgggacgtgggggacgttcgggggaacctaaaccccgtaacgacgttggtacgtacacgtacgttccgttaccttaccacccgtaccgtcccgtaacccgggaactaacgtacctttaacccgacgtaccgaacccaacgtaaacctccctaaccaaactaaaccacctacgacccctaagtaaggttcggggtaagtacgggagaccgtacgtacgtacgtcggttacgaaaccggaaccgtaccgggtacccgtccgttacgttacgttacggttcgccggtaagaacccgttaccggaacccgtaaaggttcccgggttcggaccgaacccggtccggttaaccgggccgttaccgggttaacccgtttccgttaacggttccgggttaccgggggaccggggaacccggttaacggggttcccccgg

SEQ ID NO: 394775 - DNA, 669 bp, Homo sapiens
  misc_feature: GZ8MTXP01BDT4B.17.25.C03.1.454.CMB.2.raw
  modified_base (214)..(214): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctnagtgaggtctcctgcaaggtcttcgtggtattctacgtttacctctatagtatcaacgtgggtcgccgccgaggccgctacggaccaacgacctggaggtggagtgggatcgggggacctaaaccccgtaatacgtggttcgtacacgtagttccgttccttccgaaccccgtacgtcccggaaccgggaactaacgtacctaaccgtagtacccgaacctaaccgtaccttaccctaacaaactaaaccgacacgtacctacgtaagtcggtaagttacggagaccgtacgtacgactacggtacgtacggaaccgtaccggtaccggtaccgtttacgttacgttacgtcgtacggacgtaccggacccgtaaccgtacgttccggtccggttacgaccgtaaccggcggcgacgtccggttctaacgtcgttcgggacgggtcgcgggtccg

SEQ ID NO: 394776 - DNA, 622 bp, Homo sapiens
  misc_feature: GZ8MTXP01EBHC4.17.25.C03.1.454.CMB.2.raw
  modified_base (251)..(251): a, c, t, g, unknown or other
  modified_base (272)..(272): a, c, t, g, unknown or other
  modified_base (283)..(283): a, c, t, g, unknown or other
  modified_base (319)..(319): a, c, t, g, unknown or other
  modified_base (326)..(326): a, c, t, g, unknown or other
  modified_base (429)..(429): a, c, t, g, unknown or other
  modified_base (445)..(445): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggattcacgtttaccnctatagtatcaacgtgggtcncgccaggccgntggacacgactgagtggatggatgggacaaccctancgtggtntcacagttcgtccttaccgaccctagtccccgtaaccggggaactcgtaccttaacccatacgaaccctaacgaactccctaccaataaaccgcacgacctanacgtggattgaggacncctagacagtcgtagaccgtacacgggtcctacttataccgtgtcggacgtaacgccgtaacccgtaacggcgtcccgggttgaaccggtcccgttaaccgggccttaaccggggtcccggttaccgttttcggaccgttttcgggaccggggggttaacccgaacgggggtccccg

SEQ ID NO: 394777 - DNA, 603 bp, Homo sapiens
  misc_feature: GZ8MTXP01B75Z1.17.25.C03.1.454.CMB.2.raw
  modified_base (260)..(261): a, c, t, g, unknown or other
  modified_base (280)..(280): a, c, t, g, unknown or other
  modified_base (306)..(306): a, c, t, g, unknown or other
  modified_base (371)..(371): a, c, t, g, unknown or other
  modified_base (383)..(383): a, c, t, g, unknown or other
  modified_base (407)..(407): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccactccctccctgcctgcctcgtggtgggggtcagagtcaccatcacttcgaccggacagtcacggtacttaaactatttaaatgtannagcaagaacctaggaaacnccccagaccctctagatctcgtggtnctactccactcgtggaccgtaaggtcggcctacccgagtcggagttccaggtgcgaggtgaatgnggacagtacttnaactctcacctatccgactactcngacctaacgtgacgtattcggcactaatccttactacttagtaccaaacgtagtaacgttccgtaccgtttccccgacgttccttacggtttaccgggccggtaaagggggtaccccttaaaaggttcgggaaacttacgaacgaaaccgttgttacggtcggacttcggacctacgttacttccgttcgtttccc

SEQ ID NO: 394778 - DNA, 595 bp, Homo sapiens
  misc_feature: GZ8MTXP01DYOW7.17.25.C03.1.454.CMB.2.raw
  modified_base (255)..(255): a, c, t, g, unknown or other
  modified_base (275)..(275): a, c, t, g, unknown or other
  modified_base (433)..(433): a, c, t, g, unknown or other
  modified_base (482)..(482): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgttttaccnctatagtatcaacgtgggtncgccgtaggccgctggaacaacgacctgagtggagtgggatcgggggaccaaaccctaacgcgtggtacgtcacgtagtccgtccttacacccactcccgtaaccgggactcgaccttaccatacgaccacgactccctacaataaacacagacctanacgtggtagtgagacgctagacagtcaggtaaccgacgaccggtccgtntaacgttacgtcgtcgacgacgtacgcccacggacgtccggttagacgtcccgttaacggcgacggtccggtcctttcggactttccgggacgggcccgaagggtaaccccgg

SEQ ID NO: 394779 - DNA, 822 bp, Homo sapiens
  misc_feature: GZ8MTXP01BK7KN.17.25.C03.1.454.CMB.2.raw
  modified_base (277)..(277): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtacccactcccaggtgcagctggtgcagtctggggctggaggtgaagagccgtggggcctcgagtgaaggtctcctgcaaggcttctggacttcacgtttacctctatagtatcaacgtgggtcncgccaggccgcgtggaccaacgcctgaggtggatgggggggatacggggaccgtaaaccccgtaacgacgttgggtcgtaccacgtagttcgttcccctttaccacccgtacgtccccggtacccggggaaacctaacggtaaccctttaacccgaacgttacccgggaaacccctaaccggtaaacccttcccctaaacccctaaaacttaaaaacccacccgtaaacggtacccccttaaaccgtaacggtttaacggggtaaacggttttagggaacggggtaaccgtaccccgtttaagggaaaccctacgtttaccggaacggtaaaccccggtaaccgtaccggggttaccctttaccgttaacgtttacccgtaggttacgaccggtaacggtaccgtaccccgaacggtaccgttaccggggtacgaaccggtacccgggtaacggccggttacgggttccccgggtttaacgtttccgggtaaccgttttcccggggacgggggacccgtaacgggggttaacccgttccccgggg

SEQ ID NO: 394780 - DNA, 673 bp, Homo sapiens
  misc_feature: GZ8MTXP01CX2CF.17.25.C03.1.454.CMB.2.raw
  modified_base (227)..(227): a, c, t, g, unknown or other
  modified_base (286)..(286): a, c, t, g, unknown or other
  modified_base (313)..(313): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtggggtcagagtccaccatcacgttcgaccgganaagtctacggtacttaaaaacctatttaaatggtatcagacaagaaacctaggaaaacnccccaagacctcctgatctcgtggtcncactcccacttcgtgcgtaaggtcggcccgttcccagtcggtacggttcccagggtcggacgtagggtggtaaacgttcggtgggggaacctaaggttattttaccaaacttcctaccaacctattacccaaccaccgttctacggaccctaaaccgtggaaggtaacttggtacacttaaacttcccttaacgtaacttggttaaccaacgtaagttacgttacctacccgtttccccgtctccgttacgttttcgggaacccgtaagggggttaaccttaaaggtttaggaattaacgaaccgttaaaacgttccgttagtccgggactaacgcctaacttcttccgttcgtttaacc

SEQ ID NO: 394781 - DNA, 848 bp, Homo sapiens
  misc_feature: GZ8MTXP01EQKG4.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctgagtgaggtctcctgacaggtcttcgtggtattcgtaccgtttacctctaatagtactacgaacgtgggtcgaccgtccgacgggcccgtcgtacgggaaccaaccggtaccgtgggaggttggggaagttgggggaacgttaccgggggaacccctaaaaccccgttaacgtaccggttgggttacgtaccgtaaacgtacggtttcccgttacccctttaccgaacccccgtacggttccccccggtaaacccgggggaactaaccggttaaaccctttaacccgaaagttaccccgaaaacccccgtaaccggtaaacccctttacccctaaaccctaaaacttaaaaacccggacctaaaccgggttacccccttaaaggtaacggttacggggttaaggttacgggaaccgggaccgtcccgtaaaggtaaccctacggttacgttaaccggaaaccccgtaccggtaaccgggttcccgtttactttaaacgtttaacccggtggtaccggaccgttaaccggcccgtaacccgtaaggttccggttaccgggagaccgtacccgttacgggcttccgggtccggttcgtttaacggccgttcggggcgggaaccgttaaggggtccccg

SEQ ID NO: 394782 - DNA, 628 bp, Homo sapiens
  misc_feature: GZ8MTXP01EPC7R.17.25.C03.1.454.CMB.2.raw
  modified_base (230)..(230): a, c, t, g, unknown or other
  modified_base (265)..(265): a, c, t, g, unknown or other
  modified_base (490)..(490): a, c, t, g, unknown or other
  modified_base (605)..(605): a, c, t, g, unknown or other
  modified_base (616)..(616): a, c, t, g, unknown or other
tcagcgtagactagcacgaccggtgctcgatttagtagtgtagatttggggtttggggggagtcagtctcagtcaggacacagcatggacatgacgggtccccgctcagctcctggggctcctgctactctggctccgagctgccagatgtgacatccagatcgacccagtcctccactccctccctgtctcgcctcgtggtggggtcagagtcacatcactcgaccganagtcacggtaacttaaaacttatttaaagtggtancagacaagaaacctaggaaaaccgccccaagaccctctgacttcgtgtggtcaccactccacttcgtaggaccgtaaggtcgggccttacccagttcggtaaggttcccagggtggacaggtggaaacttcggtaagggactagtactttacaacttcacacctatccaaccgtctcacgactaaacgtgtaggtattcgacactaaattcctaacttaacgttnaacctaacgacgttacgttacctacggtttaccccctgtctttaccggttacggaacccggtaaaggggtaaaccttaaagggtacaaagtaactaaacgaaacgttcttggcgntaacgcacttnttcgttcgttcc

SEQ ID NO: 394783 - DNA, 564 bp, Homo sapiens
  misc_feature: GZ8MTXP01C28RF.17.25.C03.1.454.CMB.2.raw
  modified_base (221)..(221): a, c, t, g, unknown or other
  modified_base (307)..(307): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctcgtgtgggggtcagagtcacatcacttgccgganaagtcacggtacttaaaacctatttaaatggtatcagacaagaaacctaggaaaacgccccaagaccctcctgactcgtctggtcncactccactctgacgaagtcggccgtcccagtcgaggttccaggtggctagtggaatcgtgggacagtactttcaactctacacatccacctctctacgacaacgtggaagtcttgacgactaattcctatactgtaacaacgtagtacgttactcgttacccctgtccgttacgtttcggaccggaagggtaacttaaaggtgaaagacgttaacgaaacgttcgttggtcgctgaccacttcttcgttcgtttcc

SEQ ID NO: 394784 - DNA, 729 bp, Homo sapiens
  misc_feature: GZ8MTXP01D9YJ4.17.25.C03.1.454.CMB.2.raw
  modified_base (210)..(210): a, c, t, g, unknown or other
  modified_base (245)..(245): a, c, t, g, unknown or other
  modified_base (326)..(326): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggctnagtgagtctctgcagctcgtgattcacgtttaccnctatagtatcaacgtgggtcgcgccgaggccgcgtacggaccaacgcctggagtggagtgggatcgggacctaaccctaanacgtggtcgtcacgtaggttcctccttaccacccgtacgtccccggtaacccggggaactaacggtaaaccctttaaccgaaacgttaccggaaacccccgtaaccggtaaacccctttaccccgtaaaccctaaagttaaaaaccccacgtaaaccggtaccccttaaacggtaacgtacgggggttaaggtttacgggaaacggggaacctcccgtaggtaaccctaagggttccgtaacgggaacccgtacccgtaaccggggtcccgttactttaagtttaccggtgtacggaccgtaacgtaccgtaaccccgaggttacgttcccgggaagccgtaccgacggcgaccgggtcgtttcccgttggtaccgttcgggcggggcccgaagggggtcccg

SEQ ID NO: 394785 - DNA, 714 bp, Homo sapiens
  misc_feature: GZ8MTXP01EY4WJ.17.25.C03.1.454.CMB.2.raw
  modified_base (214)..(214): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctggaggtgaagagccgtgggcctnagtgaaggtctctgcaggtcttcgtggtattctaccgtttacctctaatagtatcaacgtgggtgccgccgaggcccgcgtaggaacaacgcctggagtgggagtgggagtcgggaccgaaaccctaacacgttggtcgtacgacgtagttccgttaccttcgaccctacgttccccgtaacccgggaactaacggtaaccctttaacccgaattacccgaaacccgtaaccgaaccttcccctaacccaaaataaaacccgaccgaacgtaccctaactacgttaggggtagttagggacgggaccgtaccgtacgaacctacgtcgtaacgggaaacccgaaccggtacccggtcccgttacgtttaaacgttaccgttggtacgacggtacgtaaccgtaacccgacgttaccggtccggttagaccgtacccgttacggcgaccggtccggttcgtttcgaccggttcggaccggggaaccgttaacgggtccccg

SEQ ID NO: 394786 - DNA, 734 bp, Homo sapiens
  misc_feature: GZ8MTXP01EBGVL.17.25.C03.1.454.CMB.2.raw
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtcgcccactcccaggtgcagctggtgcagtcgtggggctggaggtgaagagccgtgggcctcagtgaaggtctctgcagcttctgattcacgtttacctctatagtatcaacgtgggtgcgccgacggccgcgtaggacaacgacctggagtggagtgggagtcggggaccgtaaaccctaacgacgttggtcgtacaacgtaggtttcccgtcctttaccaacccctactccccgtaacccgaaagggaacctaaacggtaaaccctttaaacccacgttacccgaaacccgtaaaccgtaaacccttacccctaccaaaacgtaaaaccacgtaaccgtaacccttaacgaggttacgggtaaggttcggaaacggggtactacccgtaggaacccttaaacgttccgttaacggaaccccgaaccgtacccggtcccgtttattaaacgtttaccgtgggtagcccggaagtcccgttaaccccgacggtacgttcccgggtaagaccggttacccggttcggccgtaacggtcccggtcttttcgggaccgtttcgggtcgggggcccgtaacgggg

SEQ ID NO: 394787 - DNA, 568 bp, Homo sapiens
  misc_feature: GZ8MTXP01DQSMH.17.25.C03.1.454.CMB.2.raw
  modified_base (210)..(210): a, c, t, g, unknown or other
  modified_base (270)..(270): a, c, t, g, unknown or other
  modified_base (320)..(320): a, c, t, g, unknown or other
  modified_base (328)..(328): a, c, t, g, unknown or other
  modified_base (367)..(367): a, c, t, g, unknown or other
  modified_base (390)..(390): a, c, t, g, unknown or other
  modified_base (407)..(407): a, c, t, g, unknown or other
  modified_base (431)..(431): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaagtctcctgcaggctctggattcacgtttacctcctatagtatcaacgtgggtcncgcaggccgctggacaacgacctgagtggatgggatggggcaaccctaanacgtggtntacacgagtcgtcttcacccgtatcccgtaaccgggacngacttaaccagtcaccacgtacnccctacaataaacacanacctacagttaggagttgacgganacctgaccatcgtgacgacacggcctactattacctgtcgcgaacgcggtccccaagttacgtcccggggttgaccggtaccgacggcgttacggtccggtccgttcggtcgtcgggacgggtccgaaggggtcccg

SEQ ID NO: 394788 - DNA, 696 bp, Homo sapiens
  misc_feature: GZ8MTXP01B9YQ2.17.25.C03.1.454.CMB.2.raw
  modified_base (212)..(212): a, c, t, g, unknown or other
  modified_base (257)..(257): a, c, t, g, unknown or other
  modified_base (336)..(336): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagcgtgggctnagtgaaggtctcctgacaggtcttcgtggtattctaccgtttacnccttaatagtactcaacgtgggtgcgccaggccgctggaacacgctggagtggagtgggatcggggacaaacccgtaancgtggtctacacgtagtccgttactacaccctacgtcccgtaaccgggactaacggtaccttaacgactacgaacccacgtaaacctccctaccaaactaaaacaccgacgtaccctaagagttaggggtacgttgggaacggacgtcccgtaggaaccttaacggtcgttaacgggaacccgtaaccggtaccggggttaccccgttaatttaaccgttacggttaggtacggtaccgaacggtacccggtaacccgtaaacggttacggttcccggaggaaccgtcccggttaacggcgttaaccgggtcggttaccgtttcgacggtttccgggacgggccggttaacggggtcccg

SEQ ID NO: 394789 - DNA, 654 bp, Homo sapiens
  misc_feature: GZ8MTXP01EM9TE.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagacgcgtgggctgagtgacgtctctgacgagtcttcgtgtattcgtacgtttacctctatagtactacagtgggtcgccgtccgacggccgcgtacggaaccaacggacctggaggtggagtagggagtcgggacctaaaccctaacgcgtggtcgtacaacgtcggttccgtccttaccacccgtactcccggaaccgggactaacgtaccttaaccagtacccgaaaccaccgtaacctaccctaactaaactaaaccactaacgacctaagtacgttggtaaggttagacggacgtccgtacgactacgtcgtacggaacccgacgtaccggtccttacggttacttacgtgtcgacggtacgtccgtaacccgacgttaccgtcggttagaccgtccgttacgcgacggttccggtccttgtcggtcggttccgggcgttaacggtcccg

SEQ ID NO: 394790 - DNA, 558 bp, Homo sapiens
  misc_feature: GZ8MTXP01D4PTK.17.25.C03.1.454.CMB.2.raw
  modified_base (247)..(247): a, c, t, g, unknown or other
  modified_base (266)..(266): a, c, t, g, unknown or other
  modified_base (320)..(320): a, c, t, g, unknown or other
  modified_base (420)..(420): a, c, t, g, unknown or other
  modified_base (438)..(438): a, c, t, g, unknown or other
  modified_base (496)..(496): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgagtctctgcaggcttctggattcacgtttaccnctatagtatcaactgggtncgccaggccgctggacaacgacctgagtggagtgggatgggacctaaccctaancgtggtgtcactaggtcgtcttacacccactcccgtacccgggacaacgtaccttaccatacgacccaacgaactccctacaataaaccacagccctaanagtggagttcggagtacncagacagtcgtagacgacgacggtaccgtctattacgtgtgcgagcgtccgaacgttntccgggttgacgtccttacgggcacgtccgtcgttgactcggttagggccgaaggggtcccg

SEQ ID NO: 394791 - DNA, 653 bp, Homo sapiens
  misc_feature: GZ8MTXP01EIDTW.17.25.C03.1.454.CMB.2.raw
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtgggctggaggtgaagagcgtgggctgagtgagtctctgcagtctcgtgtacttctacgtttacctctatagtatcaagtgggtgccgcgaggccgcgtaggacaacgactggagtggagtggagtcgggaccgaaccctaacgacgtggtacgtacacgtacgttccgtccttaccgacctacgtcccgtaacgggaactcgtaccttacgacgtccgaaacctacgtaacctacctacaaacgtaaaccacgtacgaccttagaggttaggtagttcgaacgccgtctaagacctcggtcgtaccggaaccgtaccggaaccggtccttacttacgttaccgtgtcggaaccggttacgccggtaaccccggtaagttaccgggtccgggttacgaccggtacccggacgggcttacgggtcccgtcctttcgggaccgttcggggacggggccgaacgggtccccg

SEQ ID NO: 394792 - DNA, 636 bp, Homo sapiens
  misc_feature: GZ8MTXP01BW05N.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcaggtctggggctggaggtgaagagccgtggggcctgagtgaaggtctcctgaccaaggtcttcgtggtattctaccgttttacctcctatagtatcaacgtgggtcgcgccgaggccgcgtaggacaacgccgtgaggtggagtgggatcgggggactaaaccctatacgtggtctcacgtacgtccgtcttacgaccctagtcccgtacgggacaagacttaccataccgaaccacgaactcctacaataaacacacacctagacgtagggtagttaggaacggcgaccgtacgacctaggtcgtacggaaccgaccgaacggtcccgttacttaacgttaaccgtggtcgacggacggtacccgtaaccgacggaacgtccgggttacgacggtcccgttaacgggcacggtccggtccgttcgtacgttcgggacgggtcgttaacggggcccg

SEQ ID NO: 394793 - DNA, 685 bp, Homo sapiens
  misc_feature: GZ8MTXP01BLBCY.17.25.C03.1.454.CMB.2.raw
  modified_base (266)..(266): a, c, t, g, unknown or other
  modified_base (287)..(287): a, c, t, g, unknown or other
  modified_base (313)..(313): a, c, t, g, unknown or other
  modified_base (378)..(378): a, c, t, g, unknown or other
  modified_base (639)..(639): a, c, t, g, unknown or other
tcagcgtagactagcacgaccggtgctcgatttagtagtgtagatttggggtttggggggagtcagtctcagtcaggacacagcatggacatgagggtccccgctcagctcctggggctcctgctactctggctccgagctgccagatgtgacatccagatcgacccagtcctccactccctccctgtctcgcctcgtgggtggggtcagacgtcaccatctacgttcgaccgacagtcacggtaacttaaactatttaaatgtancagacaagaaccgtagaaacnccccagacctctgactcgtcgtggcncactcccactcgtgacgagtcggccgtaccagtcggtaggtccaggtgcgtaggtgaacgttcgngggactagttacttacacttcctacacctacgtccaaccctcgttcacggtaaccctaaaccgttgggtaaacggttgtttaggacccgtaacttaaaccgtttacccgttaacccttaagttacccgggaaacctaaacggtacggttaacccgttaaccggtttcccccttaccccgttacgtacccgttttacggtaccgggtaccgggaaacgggtaaccttaaggggttcaaacgtaacctacggttaaaaccggnttggggaacctccttaacgaccctaccgttactttccgttcgttcc

SEQ ID NO: 394794 - DNA, 688 bp, Homo sapiens
  misc_feature: GZ8MTXP01DLWFK.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagagccgtggggcctgagtgaaggtctcctgcaaggtcttcgtggacttctaccgtttacctcctatagtatcaacgtgggtgccgccgaggcccgcgtaggacaacggacctggagtggagtggggagtgggggacccgtaaacccttaacgacgttggtctccgacgtagttccgttccttaccaccccgtagttccccgtacccggggaactaacggaaaccctttaacccagttaccgaaccccacggtaaaccctcccctacctaactaaaaccacacgacctacgtagtagggtaggttaggaacggtacgcctacgactatccgtacggaaccgacgtacccgggtccttacgttaactttaacgtcgtacggacgacggtccgtaaccccgaacgttacggtcccgggttagaccggccgttacgggccacgggtcgttccgttcgtaccgtcgggttcggggccggttaacgggtcccgg

SEQ ID NO: 394795 - DNA, 792 bp, Homo sapiens
  misc_feature: GZ8MTXP01DY9A9.17.25.C03.1.454.CMB.2.raw
  modified_base (232)..(232): a, c, t, g, unknown or other
  modified_base (244)..(244): a, c, t, g, unknown or other
  modified_base (254)..(254): a, c, t, g, unknown or other
  modified_base (267)..(267): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagcgtgggcctnagtgaggtctcngcagcttcgngatcacgttaccnctatagtatcaagtggtgccgccacggtccgcgtcggaaccaacgaccgtggacggtaggagtgggaagtcggggacctaaaccctaaacgcgtggggtctccaacgtaacgggttcgttccgtttacccaaccccgttaaccgttcccccggtaaccccgggggtaacaaacgggttaaaccccttttaacccgaacgttaccggaaacccccgaaaccgtaaaacccctttcccctttaaaccccaaaaacgtttaaaaacccaaacccggaacccgttaaccccctaaacgtaaagggttacccgggggtaaagggttttacggggaaacgggttacgaccccggtttaggaaaaccttcggtacccgttaacggggaaacccgtaccgggtaaacccgggtcccggtttaaccttaagtttaaccgttggggttaccgacggaaacggttaccgttcccgaacggttaccggttccggggaacgaaccggtaccgttcgggcgtaacggttcggtttcccg

SEQ ID NO: 394796 - DNA, 597 bp, Homo sapiens
  misc_feature: GZ8MTXP01DR6SG.17.25.C03.1.454.CMB.2.raw
  modified_base (214)..(214): a, c, t, g, unknown or other
  modified_base (275)..(275): a, c, t, g, unknown or other
  modified_base (342)..(342): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctnagtgaaggtctcctgcaggcttctggattctacgtttacctctatagtatcaagtgggtcncgccgaggccgcgtggaacaacgacctggagtggagtgggatcgggaccaaaccctaagacgtggtntcacgagttcgtccttacacccatcccgtaccgggacaacgtacttaccatcgaaccacgtaacctccctacaaataaaccacacgcctaacgagtaggagttggaggacgcctaagactagtctaggaaccgaccgacggccccgttataacttaccgtgtgaccgtagaccgtaaccacgttaggtcccggttagacgtccgttacggcgttaggccggtacttgaccgttggacggggccgaaggggtcccg

SEQ ID NO: 394797 - DNA, 641 bp, Homo sapiens
  misc_feature: GZ8MTXP01DSIXG.17.25.C03.1.454.CMB.2.raw
  modified_base (213)..(213): a, c, t, g, unknown or other
  modified_base (223)..(223): a, c, t, g, unknown or other
  modified_base (233)..(233): a, c, t, g, unknown or other
  modified_base (236)..(236): a, c, t, g, unknown or other
  modified_base (248)..(248): a, c, t, g, unknown or other
  modified_base (267)..(267): a, c, t, g, unknown or other
  modified_base (279)..(279): a, c, t, g, unknown or other
  modified_base (375)..(375): a, c, t, g, unknown or other
  modified_base (418)..(418): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctnagtgaagtcnctgcagtctntgnttcacgtttacnctatgtatcacgtgggtcncgccgaggccgngtcggaacacggtacctggagtggagtggggaatcgggaccgaacccctagacgtgggttcacactgttccgtcctacaccctatccgaaccggancgtacctacgactcgaacccactaacctcctacaaagaaaccncgacgtaccctaagagttagggtaagtggaacgggaacctccgtacgacgtacgtcgtaacggaccgtaccggaccgttccgttatttacgtacgttcggtaccgacggtacgacccggtaacccgtacgggttaccggtcggttacgccgtacccggcggcgttaccgggtccgttacgttccgggtacgttcgggggaccggggtaaccgaacggggcccg

SEQ ID NO: 394798 - DNA, 623 bp, Homo sapiens
  misc_feature: GZ8MTXP01BBZ7D.17.25.C03.1.454.CMB.2.raw
  modified_base (277)..(277): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcagtcttctggattctaccgtttacctcctatagtatcaacgtgggtncgccgaggccgcgtggaacaacggcctggagtggagtgggagtcggggacctaaacccctacgacgtggtctacacgtagtccgtaccttcacccgtacgtcccgtaacccgggactaacgtaccttaccagttccgaacccacgtaaacctcccacctaaactaaaccgacacgacctacgacgtagggtagtggacggacgtcctagactacgtcgtacggaccgaccggtaccgtccggtcttagttacctggtcgaccggtagacccgtccgaagttccgtaccggttgacgccgttacggcacggtccgtcgttgtaccgttcgggcggccgttggcccgg

SEQ ID NO: 394799 - DNA, 599 bp, Homo sapiens
  misc_feature: GZ8MTXP01DDZ2P.17.25.C03.1.454.CMB.2.raw
  modified_base (209)..(209): a, c, t, g, unknown or other
  modified_base (377)..(377): a, c, t, g, unknown or other
  modified_base (421)..(421): a, c, t, g, unknown or other
  modified_base (439)..(439): a, c, t, g, unknown or other
  modified_base (476)..(476): a, c, t, g, unknown or other
  modified_base (523)..(523): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagctgggctnagtgaggtctcctgcaaggcttcgtggattcacgtttacctctatagtatcaacgtgggtgcgccgaggccgctggacaacgacctgagtggacgtgggatcgggactaaccctaagacgttggtctcacgtagtccgtccttccgaccctatcccgtaaccgggacncgacttaccatcgaccaacgactccacaataaacacagcctaanagtgggattacggagacnccgtagaccagtcctaggaacgaccgacggtcccttntaagttacgtggtcgacgtagcccggtccccaaggttcgttcccggngaaccgtcccgttacgggcaacggtccgggtaccttttcggacctttcgggcggggtcccgaagggggtaaccccg

SEQ ID NO: 394800 - DNA, 673 bp, Homo sapiens
  misc_feature: GZ8MTXP01BU1CE.17.25.C03.1.454.CMB.2.raw
  modified_base (296)..(296): a, c, t, g, unknown or other
  modified_base (559)..(559): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctccgtgacaaggtcttcgtggtattcgtaccgttttaccctcctatagtatcaacgtgggtgccgccaggccgngtggaaccaacgacctggacgtggagtgggatcggggaccaaccctaacgacgttggtctacacgaggttcgtccttaccacccactcccgtaccggggaactaacgtacctttaaacccgagttacccggaacccaaccgtaacctcccctaccaaactaaaccacgaacgtaccctaagagttcgggtaagttaggacgtacgtacccgttagaccctaggtcgtacggaaccgaccgaacggtcccctattacgttaccngttcgacgaacgtccgtaacccgaacggttctcccgggttagacggtcccgttacggcgttaccggtcgggtcctttaagccgttacgggttcgggaaccgttgggtaacccgg

SEQ ID NO: 394801 - DNA, 636 bp, Homo sapiens
  misc_feature: GZ8MTXP01BYXNV.17.25.C03.1.454.CMB.2.raw
  modified_base (528)..(528): a, c, t, g, unknown or other
  modified_base (592)..(592): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctggaggtagaagaacgccgtggggcctcgagtgaacggtctcctgacaggtcttcgtggtacttctaccgtttacctcttatagtatcaacgtggtgccgccgaggcccgcgtaggaaccacgaccgtggacgtggagtgggagtacgggaccgtaaaccctaacacgttggtacgtcacgtagttccgtaccttaccaccctacgtcccgtaaccgggactaacgtaccttacactacgaccaaccgtaacctacccacctaactaaaccgacacgtacctacgagtaggagttagaagtcgacgtagacgattcgagaccgacgaccggtcccttnttaacttcgtgtcggacgtacgcgtccccgaagttccgtacggttggaaccgtccgacgccggngtccggttcttcggtccttcggggcggggtcaacgggggtcccg

SEQ ID NO: 394802 - DNA, 660 bp, Homo sapiens
  misc_feature: GZ8MTXP01BE9P9.17.25.C03.1.454.CMB.2.raw
  modified_base (259)..(259): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctcctgcaaggtcttctggtattctaccgtttaccnctatagtatcgaacgtgggtcgccgccgaggcccgcgtaggaccaacgaccgtgaggtggagtgggagtcgggacctaaccctagacgtgtcgtcacgtagtccgtccttacgaccctagtccccgtacgggactcgaccttaccatcgacccacgaaccttcccacaagtaaaccacgagtacccaagtacgtgtacgttgacgtacgccagacctagtcctaggaaccgaccgtaaccggtccttacgttaattacgttcggtcgacggaaacggttccgaacccgtaaacgttccgggtccgggttacgaccgtccggttaacccggggttcgaccgggtcccgttcccgtttaaggtcccggttcggggaccgggtaaccggttaaccggggtcccg

SEQ ID NO: 394803 - DNA, 584 bp, Homo sapiens
  misc_feature: GZ8MTXP01D53CK.17.25.C03.1.454.CMB.2.raw
  modified_base (217)..(217): a, c, t, g, unknown or other
  modified_base (302)..(302): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctgtggggtcagagtcacatcatgcganagtcgacgtacttaaactatttaaagtgtatcagacaagaaacctaggaaaaccgccccaagaccctctagacttctcgtggtcncactccactcgtgacgagtcggcctaccagtcgtaggttccaggtgacgtaggtgtaactcgtgggactagttacttacactctacactactaccacctactcgtcacaccgttaggagtattgactactaattaccttactacttcgtaacaactagttaccgttaccgtaccgttcccctcgtaccttacgtttcgggaccgtaaggggaaccttaaaggttacgagtaacgtaacaacggttacttgggtaactcgtcgaccacttcttccttcgttcc

SEQ ID NO: 394804 - DNA, 658 bp, Homo sapiens
  misc_feature: GZ8MTXP01BINPT.17.25.C03.1.454.CMB.2.raw
  modified_base (251)..(251): a, c, t, g, unknown or other
  modified_base (333)..(333): a, c, t, g, unknown or other
  modified_base (507)..(507): a, c, t, g, unknown or other
  modified_base (650)..(650): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctgagtgagtctctgcagtcttctgtattctacgtttacnctatagtatcaagtgggtcgccgcgacggccgcgtaggacaacgctggaggtggagtggggagtcgggaccaaacccgtaancgtggtctacgaacgtacggttccgtaccttaccgaaccctacgtaccccggtaacccgggaactaacggtaaccctttaacccaagttacccggaaaccctaaccgtaaccttacccctaaccaaataaacccacacgtacctaacgtagtcgggtagttacggaagggtccncgtagactagtacgtagaaccgaccgtaccggtccctattaacgttacgtcgtcgcgtaacgtccgtaacccgacggttacggtccgttgaaccggtccgttacgcgaccgtcggtccttaaggtcccgtggcgggtaaccgngggtcccg

SEQ ID NO: 394805 - DNA, 613 bp, Homo sapiens
  misc_feature: GZ8MTXP01EYJDM.17.25.C03.1.454.CMB.2.raw
  modified_base (434)..(434): a, c, t, g, unknown or other
  modified_base (605)..(605): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctgagtgaaggtctctgcaaggcttctggtattcctaccgttttacctcctaatagtatcaacgtgggtcgccgccagggcccgcgtaggaccaacgcctggagtggagtgggagtcgggacgaaacccctacgcgtggtcgtcactagtccgtcctaccaccctatccccgtaaccgggactgtacttaccatcgaccctacgaccctccaccaataaaccncgacgtcctactagtgggtacgtggaagcgcctagacctagtcgtacggaaccgaccgtaccgtccgttacgtattaccgtggtcgacgtacgtcgtccccgagttacgtccggttgaccgtccgttacgcgacggtccgtccgtttgaccgttcgggttcggggaaccgngggtcccg

SEQ ID NO: 394806 - DNA, 768 bp, Homo sapiens
  misc_feature: GZ8MTXP01ALDGF.17.25.C03.1.454.CMB.2.raw
  modified_base (260)..(260): a, c, t, g, unknown or other
  modified_base (283)..(283): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctcgagtgaaggtctcctgcaaggtcttctggtattcctacgtttaccncgttatagtatcaacgtgggtcncgccgaggccgcgtcggacaacgccgtgagtggatgggagtcgggggaccaaacccgtacgagttcggttacgccgaacgtagttccgttccttaccgacccgtacgttccccgtaaacccgggaataaccggtaactttaccccagtaccgaaccctaacgaaccttacccctaccaaataaaccaacacgtaaccgtacgtaacgttcgggtaagtttacgggaacggtacgacccgtaggaacctacggttcgtacggaaccgaccggtaccggtccctacgttaacgtttaccgtaggttcggaccggtaacgtcccgggtaacccctaccgggttaccgggtttacccgggacggtcccggtacccgggttaacccgggggccttaaccgggttcccgggttacccgttttaaccggggttaaccggtttacccgggggttcccgggggaacccgggttaacgggggttaacccccgggg

SEQ ID NO: 394807 - DNA, 676 bp, Homo sapiens
  misc_feature: GZ8MTXP01ANQ9S.17.25.C03.1.454.CMB.2.raw
  modified_base (255)..(255): a, c, t, g, unknown or other
  modified_base (344)..(344): a, c, t, g, unknown or other
  modified_base (377)..(377): a, c, t, g, unknown or other
  modified_base (422)..(422): a, c, t, g, unknown or other
tcagcgtagactagcacgaccggtgctcgatttagtagtgtagatttgggtttggggaaccacatctgccctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctacctgcaaggcttctggtattcacgtttaccncctatgtatcaacgtgggtgcgccgaggccgctggacaacgcctgagtgagtgggaatcgggggacaaaccctagacgtggtgtacacngttccgtcttcaccctactccgtaaccggttanaacgtacttaccgatacgacccaacgacctcctacaataaaccanacgtccctaagacgtcgggtaattgggacgagtacccgttagaccaggttccgtagaccgaacgtaaccgggcccttacttaacgttaaccttggtcggacgttaacggacgttcccccggaagttaaccggtttccccgggagtaacccgggacccgttaaacccgggccgttccggggtcccgggtttcccgtttccgggaaaccgtttttcccggggcggggggaaccttaacggggggttaacccccggg

SEQ ID NO: 394808 - DNA, 653 bp, Homo sapiens
  misc_feature: GZ8MTXP01BGT3W.17.25.C03.1.454.CMB.2.raw
  modified_base (254)..(254): a, c, t, g, unknown or other
  modified_base (339)..(339): a, c, t, g, unknown or other
  modified_base (371)..(371): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtgggcctcagtgaaggtctctgcaggtcttcgtggattctacgtttaccnctatagtatcaacgtgggtgcgccagggcccgtcgtggaaccaacgaccgtggaggtggagtgggatcggggaccaaaccctaancgtggtctcacgtagtcgtccttaccaccctntccccggtacccgggacaacgtaccctttaacccagtccgaacccaaccgtaacctcccctaccaaataaaacccactacgcccctaagacggttaggtagttaggacggtacgcccgttagaaccctgtacgtcggaaccgaaccggtaccggtccgttacttacgttaccgtgtcggacgtaacgccggtaacccctaaggttacgtccgggttagaacgcccgttacgggcacgggtcccgtccgttggaccgttcggcggggcgttaacgggtccccg

SEQ ID NO: 394809 - DNA, 617 bp, Homo sapiens
  misc_feature: GZ8MTXP01CDJ0I.17.25.C03.1.454.CMB.2.raw
  modified_base (262)..(262): a, c, t, g, unknown or other
  modified_base (283)..(283): a, c, t, g, unknown or other
  modified_base (348)..(348): a, c, t, g, unknown or other
  modified_base (355)..(355): a, c, t, g, unknown or other
  modified_base (439)..(439): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagagccgtggggctcgagtgaaggtctcctgcaggtcttcgtggtacttctaccgttttaccnctaatatatcaacgtgggtcncgccgacggccgcgtcggaacaaccgaccgtggaggtggagtggggatcgggacctaaaccctancgtggtntcacgtagtcctcctacaccctactcccgtaacgggactaacgtacttaccagtcgaaccacgtaacctcctaacaataaaccncacgtacctaacgtagtacgggtagtagaggacgctagactagtcgtagaccgtacgccgtccgtacttagtacgtgtacgacgtacgccgtaaccgacgttcggtccgggttagaccgtccgttaacgggcacgggtccggttccttcggcgttcgggacgggccgaacgggtcccg

SEQ ID NO: 394810 - DNA, 792 bp, Homo sapiens
  misc_feature: GZ8MTXP01A3J0M.17.25.C03.1.454.CMB.2.raw
  modified_base (262)..(262): a, c, t, g, unknown or other
  modified_base (286)..(286): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagacgccgtggggcctgagtgaggtctcgtgacaggtcttgtggtacttctaaccgttttaccncttatagtactacgaagtgggtcncgccgacggccgagtacggaaccaacggtaccgtggtaaggtgggaagtgggggtacgtacgggggaacccctaaaccccgttaagtcggttggtcgtacaaacgtggttccttcccttaccacccgtcgttaccccggaacccgggaactaacgtaaccttacccgatacccgaacccaacgtaaccctaccctaaccaaacgtaaaccaccgtaacgtacccctaaagtacggtacgggtaaggttacggaaacggtccgaacccgtagtaacccgtacggttaccgtaaccggaaacccgtaacccggtacccgggttccccgttaatttacgtttaaccgggtcgggtaccgaaccggtaccgtacccggtaacccgtaacggttaccggtaccggacgtacccggtacccggttaaccgggccggttaccgggttcccggtttaccggtttccgggttaccgggtccggggttaccggggtaaccggttaaccgggtcccg

SEQ ID NO: 394811 - DNA, 591 bp, Homo sapiens
  misc_feature: GZ8MTXP01DQJTS.17.25.C03.1.454.CMB.2.raw
  modified_base (224)..(224): a, c, t, g, unknown or other
  modified_base (305)..(305): a, c, t, g, unknown or other
  modified_base (369)..(369): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcacatcacttgccgganaagtcacggtacttaaaactatttaaatggtatcagcaagaaactaggaaaacgccccagaccctcctgactctctggtcncactccactctgaccgaagtcggcctcccagtcggagttccaggtggcagtggaatcgtggganagtatttacatcctacaccatcaccactctgacaactgaggtattgtacactaatctaacgtactacgtacaaactaagtacgttacctaccgtttacccctcgtcgtaccgttttacgggaccgtaaacgggggtaaacccttaaaggttacgaacgtaacgttaacgaaaacgttacgttacggtaacggtacgtcgaccaccttacttcttcgtttccc

SEQ ID NO: 394812 - DNA, 733 bp, Homo sapiens
  misc_feature: GZ8MTXP01ESNTE.17.25.C03.1.454.CMB.2.raw
  modified_base (259)..(259): a, c, t, g, unknown or other
  modified_base (500)..(500): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaaggtctccgtgcaagtcttctggtattctacgtttaccncttatacgtatacgaacgtgggtcgccgtaccgagggccccgacgtacggaaccaaccggtaccgtgggaaggtggggaagttgggggaagtcgggggaaccctaaaacccccgttaagtaccgttgggtacgtacgacgtaggttccttccgttaccaccccgtacgtccccggtaacccgggaactaacgtaccttaccattaccgaaccctaacgaccttccctaaccaaataaaccncgaacgtaccctaataaggtcgggtaagttcggaagggacctcccgttaaggacttacgggtacgttacgggaaccgtaccgaacccgggttccgttattaaacgtttccgtggaccgtacgtacgtaccgtcccgaaggttacgttcccgggggagaccggtccgttacggttccgacgggttcccgtttcgtttaacggcggttaccggggccgggtaaccgaacgggtcc

SEQ ID NO: 394813 - DNA, 633 bp, Homo sapiens
  misc_feature: GZ8MTXP01DWUPI.17.25.C03.1.454.CMB.2.raw
  modified_base (473)..(473): a, c, t, g, unknown or other
  modified_base (488)..(488): a, c, t, g, unknown or other
  modified_base (581)..(581): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctgaggtagaaaagccgtgggcctcgagtgaagtctctgcaagcttctggtacttctaccgtttacctcctatagtactcaacgtgggtgccgccgaggcccgtcgtacggaaccaacgacctggacgtggagtggggacgtacggggaccgaaaccccgtaacgtacgtggtctaccgacgtacgttcgttcccttaccaccctacgtcccctaccgggaaaccaacgtaacctaccatccggaaccaccgtaacctcctaccaataaacgactacgacctanagtggtagtagaggncctgactataccgtagaccgtacgaccggtcctctaacgtcgtgtacgcgacgtcgtcccgaacgtacgttccgtagggcaaaccgtcggacncggttccgtaactttgaaccgtttgggcggttcccgaaggttccgtccccgg

SEQ ID NO: 394814 - DNA, 631 bp, Homo sapiens
  misc_feature: GZ8MTXP01AVL3B.17.25.C03.1.454.CMB.2.raw
  modified_base (232)..(232): a, c, t, g, unknown or other
  modified_base (268)..(268): a, c, t, g, unknown or other
  modified_base (294)..(294): a, c, t, g, unknown or other
  modified_base (318)..(318): a, c, t, g, unknown or other
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatcgacccagtctccactccctccctgtctcgcctcgtggtcgggggtcagacgtccaccatccactgccgganaagtcacggtacgttaaaacctatttaaatggtacncagcaagaaaccctaggaaaaccccnccagtacctctagtctctgtgacnctactcctactcgagacggtacggtccggtacctacctagtcggtagtccgaggtgacgaggtgaacgtggaaggtactagtattacactccacacctactacctacctacgtcacgaccgtaacgtaggtacgtacgttacgtactaactacttactacgtacgtacgtaacgtaaacgtacgttacgttaccgtacccgttaccctcgtaccgttacggttaccggacgggtaacggtaacgttaagtacgaacgtaacgtaacgttaacgttcgttcgtcgtcgtctactacgttcttccgttcgttccc

SEQ ID NO: 394815 - DNA, 645 bp, Homo sapiens
  misc_feature: GZ8MTXP01AFE5R.17.25.C03.1.454.CMB.2.raw
  modified_base (214)..(214): a, c, t, g, unknown or other
  modified_base (225)..(225): a, c, t, g, unknown or other
  modified_base (273)..(273): a, c, t, g, unknown or other
  modified_base (523)..(523): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctnagtgagtctcngcagtctctgtattctaccgtttacctctatagtatacacgtgggtcnccgcgacggccgctaggaccaacgacgtgagtggagtgggatcggggaccaaccctaacgtacgtaggtcgtacacgtagttccgttaccttccacccgtactcccgtaacccgggactaacgtacccttaaccactacgaaccctaacgaaccctccgttacaaaactaaacgacacgacctagacgtggagttaggagcgtctgtacacgtcgtaggaccgaccgtcggtccgtactacgtttaccgngtcgacgtagcccggtcccaacgggttaccttccgggagcccggacccggttacggcttaccgggtccggttaccgtttcgggtaccgtttcggggccgggggtaacgggttcgggtccccg

SEQ ID NO: 394816 - DNA, 603 bp, Homo sapiens
  misc_feature: GZ8MTXP01DARWZ.17.25.C03.1.454.CMB.2.raw
  modified_base (294)..(294): a, c, t, g, unknown or other
  modified_base (299)..(299): a, c, t, g, unknown or other
  modified_base (309)..(309): a, c, t, g, unknown or other
  modified_base (413)..(413): a, c, t, g, unknown or other
  modified_base (429)..(429): a, c, t, g, unknown or other
  modified_base (434)..(434): a, c, t, g, unknown or other
  modified_base (481)..(481): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatccctcctgtctcgcctcgtggtggggtcagagtccacatcactcgccgacaagtcacggtacgttaaaactatttaaagtgtatcagcaagaaaccaggaaaccccagtacctctgatcngtggncatccactgngacgagtcggtacctacccgagtcggtacgttccgaggtcggtatacggtggaacttacgggtgggactagttactttacaactcgtacacctacacacctacnctagacacgtgggatnttganactaagttcctacgttactgtaacacgtagtacgtacctcgttcccncgtccttacgttcggaacccgggtaagggtaaaccttaggttaacgacgtaactaaccggttaaaacgttccgttggttaacggacctcgtaacccacgttactttccggaacgttttcccc

SEQ ID NO: 394817 - DNA, 770 bp, Homo sapiens
  misc_feature: GZ8MTXP01BJ5YA.17.25.C03.1.454.CMB.2.raw
  modified_base (215)..(215): a, c, t, g, unknown or other
  modified_base (280)..(280): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctgaggtgaagaagccgtggggcctnagtgaaggtctcctgcaaggcttcgtggtattctaccgtttacctctatagtatcaacgtgggtncgccgaggccgcgtcggaacaacgacctggagtggagtggggatcgggaccgtaaaccctaagacgtggtcgtacgactaggttccgtccttaccacccgtactccccgtaacccggggaactaaccggtacctttaacccgattaccgaacccgtaaaccgaaaccttacccctaacctaaaactaaaacccacaacggtacccctaagtaacgttagggtaacgttaggaacggaacgtccgtaagaccgtagttaccgtaacgggaacccgtaccggaaccggggtccctttaacgttaacgtttaaccggtggtaccgggaaccgtaacggtaaccccggtaaccccgtaacgggttaccggttaccccggggttgaacccgggtaccccggttaaccggggcgttacccgggtcccggtttaccgttttaacgggtaaccggtttccggggaccgggggtaacccgttaacgggggtaaccccgg

SEQ ID NO: 394818 - DNA, 661 bp, Homo sapiens
  misc_feature: GZ8MTXP01A86VL.17.25.C03.1.454.CMB.2.raw
  modified_base (338)..(338): a, c, t, g, unknown or other
  modified_base (442)..(442): a, c, t, g, unknown or other
  modified_base (513)..(513): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctgagtgaagtctctgcagtctcgtggtacttctacgtttacctctatagtatcaagtgggtcgccgccgaggcccgcgtaggacaacgaccgtggagtggagtgggatacgggaccaaaccctaancgtggtctacacgtagttccgtaccttcaaccctacgtcccgtaaccgggaactgtacccttaacgatacgaaccctaacgacctaccctacaaataaacccgnactacctagagtggagtcgaagctaccgagacctgttcgacgaccgacggcccggtcttcgtaatttacgngttacggaccgtaacggtccccgttcccgaaacggttcgttaccccgggaagccccggtacgttaacccggggcgttaacccgggtcccggtttccgttccgtaacccgggtttcggggacccggggtccgttaacggggtccccggg

SEQ ID NO: 394819 - DNA, 758 bp, Homo sapiens
  misc_feature: GZ8MTXP01EQ89D.17.25.C03.1.454.CMB.2.raw
  modified_base (212)..(212): a, c, t, g, unknown or other
  modified_base (274)..(274): a, c, t, g, unknown or other
  modified_base (286)..(286): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctnagtgaaggtctcctgcaaggcttctggattctacgtttacctctatagtatcaacgtgggtncgccgaggccgntggacaacgcctgagtggagtgggatcggggaccgaaccctaagccgtggtcgtcgaacgtgttccgtccttaccaccctatccccgtaccggggaactaacggtacctttaaccgactacggaaccccaacggtaacccttaccctacccaaacttaaaaccaccgtaacggtaccctaaacgtagttacggggtaacgtttacggaacgggaacgtccgttacggaacttaacgtcgttacggaaccggtaacccgtaccggggtcccctttacgttaaacgtttaacccggtttggtaccgggtaaccggtaaccgtaccgggttaacccccgaaacgggttaccggttacccgggggttacgaccggtaccccggtttaacggggcccgttaaccgggttcccgggttaccgtttaacggtaccggttccgggttcgggggaaccccggttaacggggtaaccccggg

SEQ ID NO: 394820 - DNA, 644 bp, Homo sapiens
  misc_feature: GZ8MTXP01A5BWU.17.25.C03.1.454.CMB.2.raw
  modified_base (232)..(232): a, c, t, g, unknown or other
  modified_base (264)..(264): a, c, t, g, unknown or other
  modified_base (285)..(285): a, c, t, g, unknown or other
  modified_base (296)..(296): a, c, t, g, unknown or other
  modified_base (309)..(309): a, c, t, g, unknown or other
  modified_base (323)..(323): a, c, t, g, unknown or other
tcagcgtagactagcacgaccggtgctcgatttagtagtgtagatttggggtttggggggagtcagtctcagtcaggacacagcatggacatggagggtccccgctcagctcctggggctcctgctactctggctccgagctgccagatgtgacatccagatcgacccagtcctccactccctccctgtctcgcctcgtggtggggtcagacgtcaccatcactcggccganaagtcacggtaacttaaactatttaaatgtancagacaagaaactaggaaacncccagacctcngactctcgtggtnactactccactcgnggacgaaggtcggccgtacctagtcggtaggttcgaggtggcgtaggtggtaactcgggtgggactaagttatttaccaacttccacaacctactcccgaacctactctacggaacctaaccggtggtaaggttattacggtactaacctaatttacctaacgtacgtacggtaaccaacgtagtaaccgttaccgtcccgttaccccgtgtacccttacgggtttcggaacccgggtaaagggtaaccttaaaggttgaaacgtactaaacgttaaacgcgttcggtcgacgtcgaccacttacgttccttcgttaaccc

SEQ ID NO: 394821 - DNA, 776 bp, Homo sapiens
  misc_feature: GZ8MTXP01BVEK5.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaacggttctcgtgacaaggtcttcgtggtattcctaccgttttacctctaattagtactcgaacgtggggtcgccgaccgaagggcccgtacgtaccggaaacgaaccggtaccgtgggaggtacgggaggttacgggggaacggttaccggggggaacccctaaaaccccgttaaacgtaccggttagggttacgttaccgaaccgtaggttccccggttacccctttacccgaacccctaccgtaccccgtaacccgaacggaacccgtaacggttaaaccccttaactaaccgtaccgaaacccccgaaacctaaccccttaccctaaccctaaactaaaaccacctaaccggtacccttaaacgacggttaagggtacggttaggacgtaccgaccgtacgaacctagtaccgtacggaacccggacgtaacccggtccgttacgttaacttcggtgtaccgtacggacgaacccggtcccgagtaccgttcgtacgcgttccggcgacgaacgtcgggttcttcgtccgttacgggtcgggccgtaacgggg

SEQ ID NO: 394822 - DNA, 713 bp, Homo sapiens
  misc_feature: GZ8MTXP01C6MO6.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagacgccgtgggcctcgagtgaggtctccgtgacaaggtcttcgtggtacttctaaccgttttacctccttaatagttatacaacgtggggtacgccgaccgagggcccgcgtacggaacaaccgaccgtggaggtggagtagggggagtcgggggaccctaaacccccgttaacgtacgttgggttctacgacgtacggttccgtcccttaccacccgtactccccggtaaccgggaacaacgtaaccttacccgaatccgaaccaaccgtacctccctacaaactaaacgacacgacctacgagtggaacgttaggacggacgtcctacgtactacgttacgacgaacccgacggacccggttaccgttacttaacttaccgtggtcgacggtaccggtaacctccccgaagttaccggtccggttcgaaccggcccgttaacgggcttaccggcccggtttacccttgggtacccgttcgggttcggggaacccggttaagggtaaccccgg

SEQ ID NO: 394823 - DNA, 766 bp, Homo sapiens
  misc_feature: GZ8MTXP01DFGZN.17.25.C03.1.454.CMB.2.raw
  modified_base (279)..(279): a, c, t, g, unknown or other
  modified_base (360)..(360): a, c, t, g, unknown or other
  modified_base (626)..(626): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggctgagtgaaggtctctgcaaggtcttcgtggtattcgtacgtttacctctatagtatacaacgtgggtcnccgccaggcccgacgtcggaacctaaccggacctggaggtcgggaagttgggggagtacgggggacctaaacccgtaaacncgttggtacgtcaacgtaggttccgttccttaccaaccctacgtaccccggtaaccgggaactaacggtaaacccttaacccgaagttaccgaaacccctaacggtaaaccccttcccttaacccaaaactaaaaccaccgtaaacgtaaccccttaagtaacggttacggggtaagtttacggaacggttaacgccgttagaaccagtttccgtaacggaacccggaacccggtaccgggtacccgttacttaacgtttaaccgnggtacgaccggacgtaccgttaacccgaaggttacgtacccgggttgaaccgtcccggttaacggccgaacgggtcccggttaccgtttccgggtacggttacggggttaccgggggaacccgttaacgggggtccccgg

SEQ ID NO: 394824 - DNA, 819 bp, Homo sapiens
  misc_feature: GZ8MTXP01CY3GL.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgccccactcccaggtgcagctggtgcagtcgtggggctggaggtgaaagagccgtggggcctcgagtgaaggtctcctgacaaggtcttcgtggacttctacgtttaccctctatagtatcaaacgtgggtcgccgacgacgggccgtacgtacggaactaaaccggacctgggaaggttgggaagtgggggtaatccggggggacctaaaaccccgtaaacgtaaccggttggggtcgttaaccgacgttacggttccggttccctttaccaaccccgttaaccgtacccccggtaacccgggggtaaacccaacgggttaaacccttttaaacccaaacgttccgaaacccccgtaaaccgtaaaccccttccccctaaaccctaaaacttaaaacccggaacctaacggtacccttaaaccgtagttaccggggaagtttacgggaacggacgtaccgtagtaaccgtatccgtaaggacccggaacgtacccgggtaccttaccgttacgttaacgtggtacggaccggtacggtaacccgttaaccccgaacggttacggttcccggttagaaccggtcccggttaccgggattacccgggtccggttaccgttcgggtaccgtttccggggccggggaaccggttaacggggtaacccgg

SEQ ID NO: 394825 - DNA, 794 bp, Homo sapiens
  misc_feature: GZ8MTXP01DGZZU.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggctcgagtgaaggtctccgtgcaaggtcttcgtggtattcctaccgtttacctctatagtatcaacgtgggtcgcgtccaggcccgtcgtacggaacaacgtaccgtaggaggtcggaggtggggacgtacgggggaaccctaaacccccgttaagacggttggtacgttacgacgtacggttccgttcccttaccgaccctacgttcccccggtaacccggggaactaacgtaacctttacccgaagttaccggaacccccaacgttaaccctacccctacctaaactaaaaccaccgacgtaccctaaacgagtagggttaagttacgggaacggtaccgtaccgttagaacctaggttcccggtacggaaacccgaaccggtaacccgggttcccgttaactttaaccgtttaacggtcggttacgaccggaacgttaaccccggtaaccccgtaaacgggttacccggttaccgggttacgaaaccggtccccgttaaaccgggccgttaaccgggtcccggttaaccgttttcggaaccggtttcggggttaccggggcccgggttaacggggttccccgg

SEQ ID NO: 394826 - DNA, 740 bp, Homo sapiens
  misc_feature: GZ8MTXP01EDARX.17.25.C03.1.454.CMB.2.raw
  modified_base (262)..(262): a, c, t, g, unknown or other
  modified_base (363)..(363): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaacggtctcctgcaaggtcttcgtggtattctacgtttaccnccttatagtatacaacgtgggtcgcgccgaggccgcgtggaaccaacgacctggagtggagtgggatcggggacctaaaccctaagacgtggtcgacacgngttccgttccttaccgacccagtccccgtaacccgggaacaacggtacccttaccacgtaccgaacccaaaccggtaccttacccctacctaaacttaaaaaccgcctaacggacccttaaacacgggtttacgggtaaagtttcgggaaacggcgtaccgtaggtaaacctcggttaccggtacggtaaccggtaacctacccgggggtaccctacgtttaacgttaaccgtgtccggtacgacggtacccgtaaccccgaacggaccggttccgggttagtcccggtacccgttaacgggccgttcgggtaacccggttcccgtttcggttaacccgttccgggttacgggggccgttaaacggggttccccggg

SEQ ID NO: 394827 - DNA, 695 bp, Homo sapiens
  misc_feature: GZ8MTXP01EF50D.17.25.C03.1.454.CMB.2.raw
  modified_base (214)..(214): a, c, t, g, unknown or other
  modified_base (276)..(276): a, c, t, g, unknown or other
  modified_base (288)..(288): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctnagtgaaggtctcctgcaggcttcgtggtattctacgtttacctctatagtatcaacgtgggngccgccaggccncgtggaacaacgacctgagtggacgtggggatcggggacctaaaccctaacgacgttggtctacgaacgtaggttcgtaccctttaccaaccctacgttaccccggtaacccgggaacaacggtaacctttaacccacgttacggaacccctaaaccgtaaaccttacccctaccaaaagtaaaaccaacctacgtaccctaagtagtacgggtaagttaggaacggacgccttaagacctaacgttccgtaacggaaccgaccgtacgggtccccgtattaacgttaccgtgtacgacgtacgcgtaacccgtaagttcggtccggttaggaccgtcccgttaacggcttacgggtccggtccgtttcggtaccttcggggttacggggccccgaaggggtccccg

SEQ ID NO: 394828 - DNA, 635 bp, Homo sapiens
  misc_feature: GZ8MTXP01DVMHD.17.25.C03.1.454.CMB.2.raw
  modified_base (234)..(234): a, c, t, g, unknown or other
  modified_base (291)..(291): a, c, t, g, unknown or other
  modified_base (315)..(315): a, c, t, g, unknown or other
  modified_base (473)..(473): a, c, t, g, unknown or other
tcagcgtagactagcacgaccggtgctcgatttagtagtgtagatttggggtttggggggagtcagtctcagtcaggacacagcatggacatggagggtccccgctcagctccgtggggctcctgctactctggctccgagctgccagatgtgacatccagatcgacccagtcctccacttccctccctgtctcgtcctcgtggtgggggtcagatccacatcactcgaccganaagtcgaacggtaacttaaaacttattaaatggtatcagacaagaaaccaggaaacncccagtacctctgactctgtggtnactactccactcgagacgtaacgtcggtacttaccgtagtcggtaggtttccagggttggcgtaggtcggtaatcggtaaggggaactaaggttactttaccaacttcctacccaaccctattacccaacctacggtctacggacctacgtagagttntgactactaactactaacgttactactaacaacgtactaccgttacctacccgttccgtcgtaccgttacggttacggacggtaacggaacttaaaggtacaaataaacgtaacgaacgttacgttcggtcgtactaacacctacgttcttccttaacgtcc

SEQ ID NO: 394829 - DNA, 660 bp, Homo sapiens
  misc_feature: GZ8MTXP01DMQR9.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagaagccgtggggctcagtgaaggtctctgcaggcttcgtggtattctaccgtttacctcctatagtatcaacgtgggtcgccgccgaggcccgcgtaggaacaacgacctggagtggagtgggagtcgggacctaaccctaagacgtggtcgtcagagtccgtcttacaccctactcccgtaaccgggacaacgaccttaccatacgacccaacgtaacctccctaacaaataaaccacacgacctacgtagtggtaggttgaggtacgcctagactacgtcgtacggaacgaccgaccgggtcccttacgtttaacgttaccgttgaccggtaccgaaacggtcccgttaaccccgaaacgttccggtccggttacggaccgtaacccgttacggggccacgggtcccgttacgtttcgaacccggtttcgggcggggaaccggaaccggggtaacccg

SEQ ID NO: 394830 - DNA, 642 bp, Homo sapiens
  misc_feature: GZ8MTXP01BK674.17.25.C03.1.454.CMB.2.raw
  modified_base (239)..(239): a, c, t, g, unknown or other
  modified_base (258)..(258): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtcgcagctggtgcagtcgtggggctggaggtgaagagccgtgggcctcgagtgaaggtctcctgacaagcttntggtattctacgtttaccnctatagtatcaacgtgggtcgcgccgaggcccgcgtcggaacacgacctggaggtggagtgggagtcgggggacctaacccctaagtacgtggtcgtacacgtgtcgtccttacacccgtctcccggtaacgggactaacgaccttaccgactaccgaaccaccgaactccctaccaaataaacactacgtaccctaagtagtagggtaacttagggacggacgtcctagaacctaggttcgtacggtaaccgacgtaccggtccgtacgttaattaccgtgtacggcgtaacggccgtaacccgacgcggtcccggttgacgtccgttacggcttacgggcgttccttaagtccgttcgggagggtccgttaacgggaacccg

SEQ ID NO: 394831 - DNA, 638 bp, Homo sapiens
  misc_feature: GZ8MTXP01BOIWY.17.25.C03.1.454.CMB.2.raw
  modified_base (450)..(450): a, c, t, g, unknown or other
  modified_base (482)..(482): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctgagtgaggtctcgtgcgagtcttcgtgtattctacgtttacctctatagtactcgaacgtgggtcgccgccgacggcccgcgtacggaacacgaccgtggaggtggagtggagtcgggacctaaaccctaagtcgtgtcgtcacgtcgttccgtccttaccaacccgtagtaccccgtaccgggaacaacgtaccttacccgataccgaacccacgtacctccctacaaactaaacncacgacctagaagtggtacgtggaacggtacnccgtagacctaggtcgtacggaaccgtaccgaccggtcccttagttacgttacgtagtcgaccgtacgtccgtaacccgtacgttacgtacggttgaccgtccgttacggcgacgtcggttccttaagtccgtcggccggggtcgaacgggtcccg

SEQ ID NO: 394832 - DNA, 581 bp, Homo sapiens
  misc_feature: GZ8MTXP01EHLBO.17.25.C03.1.454.CMB.2.raw
  modified_base (210)..(210): a, c, t, g, unknown or other
  modified_base (251)..(251): a, c, t, g, unknown or other
  modified_base (271)..(271): a, c, t, g, unknown or other
  modified_base (323)..(323): a, c, t, g, unknown or other
  modified_base (500)..(500): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaaggtctcctgcaaggcttctggattcacgtttaccnctatagtatcaacgtgggtncgccgaggccgctggacaacgcctgagtggatgggatgggactaaccctaancgtggtcgtcacgagtcgtccttcacccgatcccgtaaccgggactcgacttaccatacgacccaacgtacctccctaccaactaaaccgacaacgaccctagaacgttagggtagttacggaggacgtaccgtagacctagttcgacgaccgtaccgaccggtcctactattaccngtgacgtagcgtaacccagagtccggttgacgcgttacggcaggcggtacttgaccgttcggcgggccgttggggaacccg

SEQ ID NO: 394833 - DNA, 614 bp, Homo sapiens
  misc_feature: GZ8MTXP01BB9LP.17.25.C03.1.454.CMB.2.raw
  modified_base (228)..(228): a, c, t, g, unknown or other
  modified_base (283)..(283): a, c, t, g, unknown or other
  modified_base (308)..(308): a, c, t, g, unknown or other
  modified_base (415)..(415): a, c, t, g, unknown or other
  modified_base (437)..(437): a, c, t, g, unknown or other
  modified_base (533)..(533): a, c, t, g, unknown or other
tcagcgtagactagcacgaccggtgctcgatttagtagtgtagatttggggtttggggggagtcagtctcagtcaggacacagcatggacatgagggtccccgctcagctcctggggctcctgctactctggctccgagctgccagatgtgacatccagatgacccagtcctccatccctccctgtctgcctcgtggtgggggtcagagtcaccatcacttgccgganaagtcacggtacttaaaactatttaaatgtatcagacaagaaacctaggaaaacnccccagaccctctgatctgtggtcncactcccactcgtgacgaagtcggccttacccagtccggaggttccaggtggcaggtcggaaattcgtgggaactagtactttacaactctacacctataccaaccnctcgacaacgtagagtattcgnactaatcgttaactactagtaccaaagtagtaacttaccgaccgtttcccctagtactacggtttcggacccgaagggggtaaacctaaagggttnaaacggttactaaaccgaaaacggttacgtttgggacggtaacctacggaactaaccttcgttaccgttcgttccgttaac

SEQ ID NO: 394834 - DNA, 642 bp, Homo sapiens
  misc_feature: GZ8MTXP01BT6U9.17.25.C03.1.454.CMB.2.raw
  modified_base (264)..(264): a, c, t, g, unknown or other
  modified_base (285)..(285): a, c, t, g, unknown or other
  modified_base (349)..(349): a, c, t, g, unknown or other
  modified_base (354)..(354): a, c, t, g, unknown or other
  modified_base (383)..(383): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtgggcctcgagtgaacggtctccgtgacgaggtcttcgtggtattctaccgttttaccnccttatagtatcactgggtcncgccaggccgcgtaggacaacgctggacgtggagtggagtcgggaccaacccctagacgtggtntcagngtcgtcctacacccactcccgaccggacncgacctacatcgaccacgacctccacaataaccacacgtaccacagtcggtagtgacgagcctagactacgtacgtacggaccgacgaccgtccgtacttaagtttaccgtggtcgacggaacgtcccgtaaccgaacgttaccggggttaccggttcgaaccggtcccgttaacgggttccgttacgggtcccggtttacgtttaaccggtaccggtttccggggacgggggaacccggttaacgggggttcccccgg

SEQ ID NO: 394835 - DNA, 734 bp, Homo sapiens
  misc_feature: GZ8MTXP01BQAUC.17.25.C03.1.454.CMB.2.raw
  modified_base (287)..(287): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcaggtcgtggggctggaggtgaagagccgtgggcctgagtgaaggtctccgtgacaaggtcttcgtggtacttctaccgtttacctctaatagtatacaacgtgggtcnccgccgaggccgctaggacaacgcctggagtggagtggggagtcggggacctaaacccgtagacgttggtcgtacacgtacggttccgttccttaccgaccctacgtccccgtaacccggggaactaacggtaacctttaaccgacgttacccgaaaccccgtaaccggtaaacccttacccctaaaccgtaaactaaaacccgaacaccggtaaccctaacgtaacggttagggtaacggttaggaacgggacgtacccgtagaacctacggttcgtaacggtaacccgaccggtaccggtccgttacttaacgttaccgtggttacggacgtacggtacccgtaacccgtaacggttacgtccgggttacgtaccggccgttaaccggcgttaccggccggtttcccgttgtaccggttcgggcggggtccgaaggggtccccgg

SEQ ID NO: 394836 - DNA, 602 bp, Homo sapiens
  misc_feature: GZ8MTXP01AXE5F.17.25.C03.1.454.CMB.2.raw
  modified_base (212)..(212): a, c, t, g, unknown or other
  modified_base (281)..(281): a, c, t, g, unknown or other
  modified_base (372)..(372): a, c, t, g, unknown or other
  modified_base (433)..(433): a, c, t, g, unknown or other
  modified_base (538)..(538): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggcctnagtgaaggtctcctgcaaggtcttcgtggtattctaccgttttacctcctatagtatcaacgtgggtcncgccgaggccgcgtggaccaacgcctggagtggagtggggatcgggaccaaaccctagacgtggtactcacgtagtccgtccttacacccngtcccgtaaccgggacaagtaccttaaccagtccgaccacgtactccctaccaataaaccncacgacctacgagtaggacgtgacggacacctagacagtcgtagaccgacgacgggtcctacttaacttcgtgtcggaccgagtccgtaacccagcgttccgggngtacggccgttacggcacggtcgggttcctggtaccgttcgggcggggaacgaacggggtcccg

SEQ ID NO: 394837 - DNA, 748 bp, Homo sapiens
  misc_feature: GZ8MTXP01BNNR5.17.25.C03.1.454.CMB.2.raw
  modified_base (241)..(241): a, c, t, g, unknown or other
  modified_base (319)..(319): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccatccctccctgtctcgtccttcgtgggtgggggtcaggtacgtccaacatcacgttcggaccggtaanaacgtacgaacggttaacgttaaaaaccttattttaaagtggtactacgagactaaacgaaaccgtaggaaaaccccnccgtaacgtacctcacgtactcgtgtagtctactaccgtacctacgtcgtacggaacggtacggtccggtacccgtaccgtaggtacggttaggtaccgaggtcggagtaggtacggtaacttacggaacgggtaactaacgtttacttaactaacctacctacctaaccgtacctacctaacctacgtacctacgtaaccgtaacggtaggttacgtacgttagacgtaactaactttacctaacggttaacttacgtaaaccgtaaacgttacgttaaccgttacccgttaccgttacccgtacgttaccgttaacgggttaccggaaccggtaaacgggttaaaccttaaggtacgaaacgtaacgtaaacgttaacggttgttacggtctacgtaaccgtaactccgttattccgttaacgttcg

SEQ ID NO: 394838 - DNA, 746 bp, Homo sapiens
  misc_feature: GZ8MTXP01BM56X.17.25.C03.1.454.CMB.2.raw
  modified_base (215)..(215): a, c, t, g, unknown or other
  modified_base (226)..(226): a, c, t, g, unknown or other
  modified_base (273)..(273): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtcgcccactcccaggtgcagctggtgcagtcgtggggctggaggtgaagagccgtgggcctnagtgagtctcngcagtcttgtgtattctaccgtttactctatagtatcacgtgggtcncgccgaggccgcgtacggaaccaacggaccgtggaggtggagtgggagtcggggaccgaaccctaacgcgtggtcgtcagtcgtcgtccttaccgaccctcgttccccgtaaccgggactaacgtaccttaacccacgtaccgaaacccctaacgtaaacccttacccctaaccaaaactaaaacccgaccaacgtacccctaaggaacggttcgggtaaggttcggaaggtaccgtccgttaggaacctacgggtccgtaacggaacccgaaccggtaacccggggttccttaagttaccgttacgttcgggtacggtaccgacgggtaacccgttccccgaaacgggttaccggtaccggttcgggaacccgtcccgggttaaaccgggccttaccgggggtcccgtttaccggtttcggttaacccggttcccggggacgggggtaacccggttaacgggggtcccccgg

SEQ ID NO: 394839 - DNA, 584 bp, Homo sapiens
  misc_feature: GZ8MTXP01BOFY4.17.25.C03.1.454.CMB.2.raw
  modified_base (328)..(328): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttctcggtggcagcagctacaagtgcccactcccaggtgcagctggtgcagtcgtggggctgaggtgaagaagcctggggcctcagtgaaggtctcctgcaaggcttctggattcacgtttacctctatagtatcaacgtgggtgcgccaggccgcgtggacaacgacctgagtggatgggatgggaccaaaccctaanacgtggtgtcactagtcgtccttcaccctactcccgtaccgggacaacgtaccttaccatcgaacccacgaaacctccctaccaataaacacacgacctacagtcggagttgaggacgcctagaccagtctgaaccgacgaccggtccgtctattacgtgtcgcgtagccgtcccaaggttacgtccgggttgaccgtccgttacggccaggtcccggttccttgaccgttcggttacggggccttaaggggcccg

SEQ ID NO: 394840 - DNA, 748 bp, Homo sapiens
  misc_feature: GZ8MTXP01AYECA.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagacgccgtgggcctgagtgaaggtctccgtgacaggtcttgtggtattctaccgtttacctactatagtatcaacgtgggtcgccgccgagggcccgcgtacggaaccaaccggtacctggtacggtgggaagtgggggaacgtcgggggaccctaaaccccgttaaagacgttaggtcgtactacgtacgttccgtccttacgaccccgtacgtccccgtaacccgggaactcgtaaaccttacccgaatcccgaaaccgaaccgtaacccttacccctaacccaaacgtaaaacccacgtaacggtacccttaaacgtaacggtagggtacggttagggaacggtaccgtacccgttaggaacctacgtacggtaaccggaaccggtacccgaccgggttacccgttactttaacgtttacgtacggttcgaccgacggttaccgaaccccgtaggttaccgtccggttacgaccggtccgttacggccgacgtccggttccgtttaacggccgtcgggttaccggggccgttaacgggggtccccg

SEQ ID NO: 394841 - DNA, 673 bp, Homo sapiens
  misc_feature: GZ8MTXP01ACRQM.17.25.C03.1.454.CMB.2.raw
  modified_base (498)..(498): a, c, t, g, unknown or other
  modified_base (540)..(540): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaaaaagccgtggggcctcagtgaaggtctcctgcaaggcttctggtattctacgtttacctcctatagtatcaacgtgggcgcgccaggcccgcgtggaccaacgacctgagtggagtgggagtcgggaccgaaaccccgtaacgacgtggtgtacgaacgtacgttcgtacccctttaccacctacgtaccccgtacccgggaaacaacgtaacctttaaccaacgtacggaacccaaccgtaacctccctacccaaataaaccaccacgccctaagagtagggaagttgaacggtacncctagactatcgtagaccgtacacggtcctacttaagttacngtcgacgacgtacgtaccccgaagtacggttccgggtagaccggtcccgtaacgggccgttacggcccgggtttccctttaggaacccggtttccgggacgggggaccccaagggggttccccgttccccggg

SEQ ID NO: 394842 - DNA, 520 bp, Homo sapiens
  misc_feature: GZ8MTXP01AVWAG.17.25.C03.1.454.CMB.2.raw
  modified_base (220)..(220): a, c, t, g, unknown or other
  modified_base (411)..(411): a, c, t, g, unknown or other
  modified_base (425)..(425): a, c, t, g, unknown or other
  modified_base (502)..(502): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccganaagtcacgcttaaaacctatttaaatggtatcagcagaaacctggaaaacgcccagacctcctgatctctggtgacatccaatctgcgaaagtcgcgtccaatcgaggttccagtggctagtggaatcgtgggactaggatttcaaattcacacaatccaacctactctgacaaaccgtgaaggtattgancaatctactaactntacaacaagagtactataccctcgtctacttcgtcgaacggaccgaaagttagagactacaaacgaacttacgtgtncgcacttactcgttcgtc

SEQ ID NO: 394843 - DNA, 695 bp, Homo sapiens
  misc_feature: GZ8MTXP01EJSIO.17.25.C03.1.454.CMB.2.raw
  modified_base (377)..(377): a, c, t, g, unknown or other
  modified_base (412)..(412): a, c, t, g, unknown or other
  modified_base (423)..(423): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctcgagtgaacggtctccgtgacgtaaggtcttcgtaggtactttcctaccgttttaccctcctaatagtatacgaacgtgggtagcgccgacggccgcgtacggaccaacgacctggaggtggagtagggagtacgggaccaaaccctaagcgtggtcgtacacgngttccgtcctaccaccctactcccgtaaccggacncgtacttaccntacaccacgactcccacaactaacacacactacgagtaggagtagagacgtcgtacgactacgtacgtacggaccgaccgtaccggtcccgttacttaacgttacgtcggttacggaccggtacggtaacccggtcccgtaacgggttaccgttcccggggttagaccggtacccggttccggggacgttaccgggttccccggtttaccgttttcggttaccggtttccgggggttccgggggtaaccggttaacgggggttaacccccgg

SEQ ID NO: 394844 - DNA, 683 bp, Homo sapiens
  misc_feature: GZ8MTXP01EZUQG.17.25.C03.1.454.CMB.2.raw
  modified_base (251)..(251): a, c, t, g, unknown or other
  modified_base (273)..(273): a, c, t, g, unknown or other
  modified_base (338)..(338): a, c, t, g, unknown or other
  modified_base (393)..(393): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtgggcctgagtgaaggtctcctgcaggcttgtgattcacgtttaccnctatagtatacaacgtgggtcnccgccaggcccgtctggacaacgacctggagtggagtggggaatcgggggaccaaaccccgtaanaccgtgggtctacacgtagttcgttccttaccaccctatccccgtaaccgggacncgtaccttaccatccgaaccacgaaactcctaccgaactaaacgacacgcctagaagtaggaagttggaaacgggtacctcgtacgtactacgggtaccgacggaaccgaacccgtcccgggttaccttacgttaacgtttcggtcggtacgggtacgtaacggtacccgtaaccccgaacgggttaccggtccgggttacgaccggtcccggttacgggccgttaccggggttcccgttaccgttcggtaccggttcggggttaccgggggccggttaacggggtcccg

SEQ ID NO: 394845 - DNA, 571 bp, Homo sapiens
  misc_feature: GZ8MTXP01DRI3C.17.25.C03.1.454.CMB.2.raw
  modified_base (229)..(229): a, c, t, g, unknown or other
  modified_base (263)..(263): a, c, t, g, unknown or other
  modified_base (284)..(284): a, c, t, g, unknown or other
  modified_base (310)..(310): a, c, t, g, unknown or other
  modified_base (366)..(366): a, c, t, g, unknown or other
  modified_base (417)..(417): a, c, t, g, unknown or other
  modified_base (422)..(422): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccacttccctccctgtctcgcctcgtggtggggtcagacgtccacatcacttgaccganaagtcacggtacttaaaacctatttaaatgtatnagtacaagaaacaggaaaacncccaagacctctagactctcgtggtncactccactcgtgacgtaagtcgcctccagtcgacgttcagtggctagtgaatcgnggctagttacttacactctacacctatacgacctcgctgacactggaagtnttganctaatctaactctagacaacgtgtacttccgccgttaccctgtaccgttacgttacggccggaaagggtaacttaaaggttcaaacgtaacgtaacgaaaacgttcggttgtcggttaacctcctacctacttactttccgttcgttcc

SEQ ID NO: 394846 - DNA, 668 bp, Homo sapiens
  misc_feature: GZ8MTXP01A6DZC.17.25.C03.1.454.CMB.2.raw
  modified_base (324)..(324): a, c, t, g, unknown or other
  modified_base (439)..(439): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctctatagtatcaacgtgggtgcgccaggccgctggacaacgactggagtggatgggatgggaccaaccctanacgtggtctacacgagttcgtccttaccacccgtactcccgtaacccgggactaacgtaccttaaccattccgaaccaacgaacctccctaccaataaaccacctagaccctaanaagtggggtaagttgaaggaccgacctaggaacctagttacgacggaacccgaaccgtaaccggtcccgttacttaacgtttaaccgtggttagacccggtaagtacccggtaacccgacggttaccgttccggggttagaaccggacccgttacgggttcgttaaccgggtccggtccgttttaacggtaccgtttcggggttacggggtcccgaacgggggtccccg

SEQ ID NO: 394847 - DNA, 799 bp, Homo sapiens
  misc_feature: GZ8MTXP01DLIPQ.17.25.C03.1.454.CMB.2.raw
  modified_base (263)..(263): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtgaagagccgtggggctcgagtgaacggtctcctgcaaggtcttcgtggtattctacgttttaccncttatagtatcaagtgggtcgcgaccgacggccgcgtacggaacaaccgactggagtggagtgggactcggggacctaaaccctaacgacgttggtacgtacaacgtcgttccgttccctttacacccgtacgttccccggtaaccgggaactaacggtaacccttaaccgacgttaccggaaacccctaacggtaaacccttacccctaaccgtaaaaacttaaaacccgacaaccggtaaccccttaaacgaacggttacgggtaaacggtttagggaaacggggttaaccaccccgttaggaaaccttacggggttaccgttaaaccggggaaaccgtaacccggttaacccgggggtacccgttttaaccttaaggttttaacccgggtcggtacggaccggtaaccgtacccggtaacccgtaacggttaccggttaccgggacgtaacccggtaccgttacggcgttaccggttccggttaccgtttaacggtaccggttcgggacggggtaaccggttaacgggtcccg

SEQ ID NO: 394848 - DNA, 774 bp, Homo sapiens
  misc_feature: GZ8MTXP01AQO1Z.17.25.C03.1.454.CMB.2.raw
  modified_base (238)..(238): a, c, t, g, unknown or other
  modified_base (251)..(251): a, c, t, g, unknown or other
  modified_base (491)..(491): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggnttcacgtttaccncctatagtatcaacgtgggtgccgccgagggcccgcgtcggaaccaacggaccttggaggtgggagtgggggacttcgggggaccgaaacccttaacgaccgttggtacgtcacgacgttcgtaccttccaaccccgtagtccccgtaccggggaacctaacggtaacctacccgatacgaacccctaacggtaaacccttccctaaccctaaactaaaacgaccaacggtacccctaanaagttcggggaacgtttagggaacggacggtacccttggaactacttcgaacggaaccgtaccggaacccgggtcccgtttacttaaacgtttaccgtgggtacggaccggtaacgtacccggttaaccccgaacggttaccggttacccgggggttacggaacccgggttccccggttaacgggcccggttaaccggggttccccgggggtttccttttaaccgggaacccggttttccgggggttaaccggggggtccccggaaaggggggttcccccggg

SEQ ID NO: 394849 - DNA, 679 bp, Homo sapiens
  misc_feature: GZ8MTXP01DCHNU.17.25.C03.1.454.CMB.2.raw
  modified_base (366)..(366): a, c, t, g, unknown or other
  modified_base (376)..(376): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccgaggtgcagctggtgcagtcgtggggctggaggtgaagagcgtgggctgagtgagtctctgacaggtctcgtggtacttctacgtttacctactatagtatacaacgtgggtcgcgccgacggccgctacggaacaacgacgtggagtggagtgggagcgggaaccaaccctaagcgtggtcacactgtcctcctcacctcnccgaacggancgtactacatacaccacgtactcctacaaataaccacacacctagagtacggtagtaggacgacgtcgtagactacgttcggaacggaaccgtaacccggtaccgggttaccttacgtttacgttaacggtcggtaacggaccggtaaacgttacccggtaacccgtaacgggttcccggttacgggttaaccggacccgggtaacccgggttaccggccggttaccggggtcccggtttacccgtttaacggtaacccgggtttcgggggaccgggggtcccggaaaccgggggtttccccg

SEQ ID NO: 394850 - DNA, 706 bp, Homo sapiens
  misc_feature: GZ8MTXP01C8HSG.17.25.C03.1.454.CMB.2.raw
  modified_base (209)..(209): a, c, t, g, unknown or other
  modified_base (271)..(271): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcnagtgaaggtctcctgcaaggcttcgtggattcacgtttacctctatagtatcaacgtgggtncgcgaggtccgctggacaacgacctgagtggagtgggatacgggaccgtaaacccgtaacacgtggtcgtccgatacggttccgttccttaccaaccccgtaacttccccggtacccggggaaactaacggtaacctttaaacccgacttaaccggaaccccaaccgtaaaccctccctacctaaacgtaaaccaacgaacgacccttaacaaagttgggtaggttacggaggacgtaccgtagtacctagtcgtacggaaccgtacgaccgggtaccctacgtttaacgttaccgtgttacgaccgacggttaccgaacccgtaacgaccggtttcccgggagaccgggtcccgttaaccgggcgttaaccggtcggttacccgttttcggtacccgttccgggttcgggggtaaccgaacgggggtaaccccg

SEQ ID NO: 394851 - DNA, 639 bp, Homo sapiens
  misc_feature: GZ8MTXP01BTY5K.17.25.C03.1.454.CMB.2.raw
  modified_base (468)..(468): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtagaagacgccgtggggcctcgagtagaacggtctcctgacgaggtcttcgtggtacttctaccgtttacctcttatagtactacgaacgtgggtcgcgccgacggccgcgtacggaacaacgcctggaggtggagtgggagtcgggacctaaccctagcgtggtcgactacgtacgttcgtaccttaccaccctactcccggtaacggactaacgtactaccacgtacgaaccctaacgacctcccaacaaataaaccacacgtcctaanagtggtagtggagcgtctagactcgtacgtacggaccgacgaccgggtccttacttaacgttcgtggtcggacgtacgtcccgaaccgtacggacgttccggagacgtcccgttacggcgacggtccgttacgtttcgaccgttcgggttacgggccgttcgggtaacccg

SEQ ID NO: 394852 - DNA, 663 bp, Homo sapiens
  misc_feature: GZ8MTXP01CNBOM.17.25.C03.1.454.CMB.2.raw
  modified_base (227)..(227): a, c, t, g, unknown or other
  modified_base (258)..(258): a, c, t, g, unknown or other
  modified_base (276)..(276): a, c, t, g, unknown or other
  modified_base (281)..(281): a, c, t, g, unknown or other
  modified_base (301)..(301): a, c, t, g, unknown or other
  modified_base (635)..(635): a, c, t, g, unknown or other
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatgacccagtctccatccctccctgtctcgcctcgtggtcgggggtcagagtcacgatcacttgccganaagtcacggtacttaaaactatttaatgtancagcagaaacaggaaacncccanacctctgactctcgtggtcnctactacccacttcgtcgacggtaaagtcggacgttccccaagttccgggaaggtttccccaggggttcggacgtaagggtcggtaaacgttccggtaaggggaactaaacgttacttttaacaaacttccttaacaaacctaactacccaacctacgtacctacgacccgaaacctagggtacggatttaggactaacaattacccttaacttaacgtacgttaacaaacggtattaacgttaccgtacgttccccgtcgtacgttacgttacggccgtaaacgggtaaccttaaaggtagagtaagtaccgaaaagttcgttcgtaacggtntaacgacacgttcttaacgttcgttaac

SEQ ID NO: 394853 - DNA, 755 bp, Homo sapiens
  misc_feature: GZ8MTXP01BEVTV.17.25.C03.1.454.CMB.2.raw
  modified_base (594)..(594): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtacagctggtgcagtcgtggggctggagtgaagaagacgtcggcggtcctagtagtaggtacgtcctcgtcgaacgtacgttcttcggtagttacttaccgtttaaccgtttacctacttaagttagtactaacgtagggtggtccgccgacggccggtcctacggacggaaccgaaccgtacggtagggtaggtaggtagggtacgggtacgggtaccggggaacccctaaaacccctaacggtcgggttcggttactaaccgaacgttcgggtttcccccttaccctaacccgtaaccctacccggtccccggggtaaaaccggaacctaacggttacccctaaacgtacgaacccgtaaccgtaactaccctccctaaaggaaaacacacgtactactaagagggtaggttgacggagccctanactacgtcgtacggaacggtaacctccggtacgttacctattacggtgcggacgacggaccgtcccgaactacggttccggtcgcgtaacccggtggttcggccggttcccgttaacggttcaaccgggttcggggacgggaccggtaacgggttcgtccg

SEQ ID NO: 394854 - DNA, 749 bp, Homo sapiens
  misc_feature: GZ8MTXP01ATW8D.17.25.C03.1.454.CMB.2.raw
  modified_base (726)..(726): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtcgcagctggtgcagtcgtggggctggaggtagaagaacggtccgtggggcctcgaggtagaacggtctccgtgacgagtctcgtggtacttcgtaccgttacctctatacgtatacaacgtgggtcgcgccgacggccgtacgtcggaacctaaccggtccgtaggaggtaggagtacgggggacgtaccgggggtacccgtaaaccccgtaacgtaccggtaggttctaccgagtacggtacccgttacccttaccgacccgtaccgttaccccggtaacccggggaacctaacggtaaccctttaaacccgaagttaccgaaaccccgaacggtaaacccttccccaaaccctaaacgttaaaccacctaacggtaccctaactaacgggttaggtacggttaacggaacgggtacctaccgtagtacctacggttccgaacggaccgaaccggtaccggtccgttagtacttacgttggtaccgacgttacggaccgttaacccgaaggttccgtcggttccgacggtacccgttacggcgacgtcgttcgttcgngttcgggacggtcgaaggtcccg

SEQ ID NO: 394855 - DNA, 751 bp, Homo sapiens
  misc_feature: GZ8MTXP01C1ETE.17.25.C03.1.454.CMB.2.raw
  modified_base (288)..(288): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtgaagagccgtggggcctgagtgaaggtctccgtgaccaaggcttcgtggtattctaccgttttacctacctatagtatcaacgtgggtcncgcgaggccgctggacaacgacctggagtggagtgggagtacgggacgtaaaccctaacgacgtggttacgaccgaacgtacggttccgttaccttacgaaccccgtaagttcccccgtaaccggggaacctaacggttaaaccttaaacccgaaacttacgaaaccccgaaccgtaaacccttaccccaaccctaaactaaaaccaacctaaccggacccttaaacgagttagggtaagttacggaacggaacgtcccgtaagactacggttccgtaacggaccgaaccgacccggggtcccgttaattaccgttacgtacggtacggtaccgaacggtacccggttaaccccgaacggttacggttccgggacgtaacggccccggttacgggccgaccgggttccgttccccggtttgtacccggtttcgggttcgggggcccgttaagggggtccccgg

SEQ ID NO: 394856 - DNA, 560 bp, Homo sapiens
  misc_feature: GZ8MTXP01AQMPM.17.25.C03.1.454.CMB.2.raw
  modified_base (222)..(222): a, c, t, g, unknown or other
  modified_base (275)..(275): a, c, t, g, unknown or other
  modified_base (300)..(300): a, c, t, g, unknown or other
  modified_base (369)..(369): a, c, t, g, unknown or other
  modified_base (375)..(375): a, c, t, g, unknown or other
  modified_base (390)..(390): a, c, t, g, unknown or other
  modified_base (405)..(405): a, c, t, g, unknown or other
  modified_base (423)..(423): a, c, t, g, unknown or other
  modified_base (507)..(507): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctcgtggtgggggtcagagtcacatcacttgccgganagtcacggtacgttaaaactatttaaatggtatcagcagaaacctaggaaacnccccagaccctctgactctctggtnccatcccacttcgtggacgaaggtcgccgtcccatcggaggtttcccaggttgggcaggtcgaattcgngggacngtatttccgaattcncaccatacaccactntcacaactgacgtagtgngacaattctaacgtactagtacaacgacgtacgttacctcgttaccctcgtctacgtttcggaccgaagggtaccaaaggttanagtaaactacaaaccggacttgtaacggctaacgaccacttacgtcttgttcc

SEQ ID NO: 394857 - DNA, 708 bp, Homo sapiens
  misc_feature: GZ8MTXP01A5NR6.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgtccactcccaggtgcagctggtgcagtcgtggggctggaggtagaagagccgtgggcctgagtgaggtctcctgcaggtcttgtggtattcgtaccgtttacctctatagtatcaagtgggtgcgccgaggcccgcgtcggacaacgccgtggagtggagtggggagtcgggggaaccgaaccctaacgtacggtggttacgtacacgtacgttccggttacccttaccgacccctacgttccccggtaacccggggaactaacggtaccctttaccacgttaccgaaccccgtaactaaaccctacccttacccaaactaaaccacctacggacctaacgaggttaggtaagttcggagacgccgttagaccaggttcgaggaaccgaacgccggtaccgtacttacgttacgtcgtacgcggtaacgacggtaaccgaacggacgttaccggggacgaccggtcccggttaaccgggcgttaaccggtccggttcccgttaacggtacccgttcggggttaccgggggcccggttaacggggtcccccggg

SEQ ID NO: 394858 - DNA, 694 bp, Homo sapiens
  misc_feature: GZ8MTXP01CHILI.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctgagtgaaggtctcctgcaaggcttcgtggtattctaccgttttacctcctatagtatcaacgtgggtgcgccaggccgctcggacaacgacctgagtggagtgggatcgggaccgaaaccctaacacgtggtcgtacactaggtccgtcttccgaccctactccccgtaacccggggactaacggtaacctttaacccaacgttacggaaacccctaacccggtaaaccttcccctaaccctaaacgtaaaaccaaccgtaacgtaccctaacgtaaacgttaggggtaacgtttagggaacgggacgtacccgttagaacctacgttcgtacggaacccgaaccgaccggtcccgtacttaagttaaccgtggtacggaccgtacgaccgtccccgtaacggacgtcccgggttagacgtaccgttacgggcacggtccggtacgtttcgtacgtcggttcggggccgttaaggggtcccg

SEQ ID NO: 394859 - DNA, 679 bp, Homo sapiens
  misc_feature: GZ8MTXP01BR72N.17.25.C03.1.454.CMB.2.raw
  modified_base (270)..(270): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacatgtgcccactcccaggtgcagctggtgcagtcgtggggctggaggtgaagaagccgtggggcctcagtgaaggtctcctgcaaggtcttcgtggtattctacgtttacatcctatagtancaacgtgggtcgcgccgaggccgcgtggacaacgacctgaggtggagtgggagtcgggaccgaaacctacgacgtggtgtaccaacgtaggtcgtccttacccaccctaacttccccgtccgggactaacgtaccttaccatcgaaccaaccgaacctccctaacctaacgaaaccaacgacaacctaactaagtgggtacggtagtaacggacgtaccgtacggaacgtaacgtacgtacgaaccggaaccgtaccgggtccgtttactaacgtttaaccgtgtcggtccggaagtaccgttaccccgaacggttacgtacccgggtcggaaccggttccggttaccggccgggtacgcccggtttccggtttcgttacccggtttcgggttccgggggtaaccgggg

SEQ ID NO: 394860 - DNA, 746 bp, Homo sapiens
  misc_feature: GZ8MTXP01ENP2V.17.25.C03.1.454.CMB.2.raw
  modified_base (324)..(324): a, c, t, g, unknown or other
tcagcgtagactagcacgaccggtgctcgatttagtagtgtagatttggggtttggggggagtcagtctcagtcaggacacagcatggacatgagggtccccgctcagctcctggggctcctgctactctggctccgagctgccagatgtgacatccagatcgacccagtcctccactccctccctgtctcgccttcgtgggtgggggtcaggacgtaccaacctatctacgttcggaccggaacaaacgtcgaacggtaacgtttaaaaaccttattttaaagtggtactacgaagtacaaacggaaaccgtaaggaaaaccncccaagtaccctactgtactctacgtggtacactactccacgttcgtacgaacgggtaaggtcggtacccttacccgaggttaccggtacggtttaccgacggtgggacgtaggtggtaaacgttccgggtaaggggtaacctaagttacttaccaaacttccctaccaaccctactaccctaacctacgtctacgaacctaaccgtagtaggtattagcgtataacgttaaccttacttaacgtacgtaacgtaacgtaacgttaaccgttaccgtccgtttaccccgtcgtaaccctttacgggtttaccggaaccgggtaaagggtaaccgttaaaggtaccgttaaagtaaccgtaaacgaaaccgttaggttagtcgggtactaacggtacctaacttacgttcttaacggtttccc

SEQ ID NO: 394861 - DNA, 515 bp, Homo sapiens
  misc_feature: GZ8MTXP02JLPJI.17.25.C03.1.454.CMB.2.raw
  modified_base (301)..(301): a, c, t, g, unknown or other
tcagcgtagactagcacgaccggtgctcgatttagtagtgtagatttgggtttgggcgagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggacgttaaaacctatttaaattggtatcagcaagaaacctggaaaacgccccagacctctgatctctggtncatccactctgcgaagtggcgtccatcgagttcagtgcagtgatcgtgggacagtattcaatctcaccatcaccactctgacaacctgaggtattgtgacaatctactactgtacaaacagtacgttacacgttcccctcgactacgtttcggaccgacggggacctaaaaggttgagtactacgaaacgaactgtggactgacaccatcttcg

SEQ ID NO: 394862 - DNA, 511 bp, Homo sapiens
  misc_feature: GZ8MTXP02JDNEA.17.25.C03.1.454.CMB.2.raw
  modified_base (322)..(322): a, c, t, g, unknown or other
  modified_base (359)..(359): a, c, t, g, unknown or other
tcagcgtagactagcacgaccggtgctcgatttagtagtgtagatttgggtttgggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctanactggtgtcacagtgtcttcacccatcctccgggacngacttacatgaccacgaactcctccataaacacagcctacatggagttgaggagcctgaccatctgacgacacggccgtctattactgtgcgagagtcccagatccggtgacgcctacggcagcggcctttgacttctcggggccagggccg

SEQ ID NO: 394863 - DNA, 533 bp, Homo sapiens
  misc_feature: GZ8MTXP02HI2HJ.17.25.C03.1.454.CMB.2.raw
  modified_base (399)..(399): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggctcccatcgagttccagtgcagtgatcgtggggacagtatttcaatctacaccatcaccactctgcaacctgaggtattgngacaatctactactgtacaacagagttacacgttcccctgctacgtttcggaccgtaacgggggacctaaaaggttcgaaggtaactaccgaaaacgtaacgtgtaaggctacgaccaaccatcttacgtttcc

SEQ ID NO: 394864 - DNA, 533 bp, Homo sapiens
  misc_feature: GZ8MTXP02I4ZW9.17.25.C03.1.454.CMB.2.raw
  modified_base (361)..(361): a, c, t, g, unknown or other
  modified_base (441)..(441): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatgggcgaaccctaacactggtgtcacagtcgtcttcacccatcctccgggacngacttacatgaccacgaactcctaccataaacacagcctacatggagttgaggagcctgacatctgacgacacggccgtntattactgtgcgagacgtcccacgactccgggtagacggccctacggcacggccggtcctttcggacctttcgtcgggggcctaggggaccg

SEQ ID NO: 394865 - DNA, 507 bp, Homo sapiens
  misc_feature: GZ8MTXP02H30WM.17.25.C03.1.454.CMB.2.raw
  modified_base (298)..(298): a, c, t, g, unknown or other
  modified_base (505)..(505): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtncatccactctgcgaagtgcgtcccatcgagttccagtgcagtggatctgggacagatttcaatctcaccatcaccactctgcaacctgaggattgtgacaatctactactgtacaacagtagttacacgttcccctcgctacgttttcggacctaggggaacctaaagttacgagactacaaacgactagtggctagcacactcttntc

SEQ ID NO: 394866 - DNA, 505 bp, Homo sapiens
  misc_feature: GZ8MTXP02I6EEQ.17.25.C03.1.454.CMB.2.raw
tcagcgtagactagcacgaccggtgctcgatttagtagtgtagatttgggtttgggagtcagtctcagtcaggacacagcatggacatgagggtcccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtccatcgagttccagtgcagtggatctggggacagatttcaatctcaccatcaccactctgcaacctgaggattgtgcaaatctactactgtacaacagacgttacacgttcccctcgctactttcggaccagggggaccaaaggttgagaactacgaaaacgactgtggctacgcaccactctgtcc

SEQ ID NO: 394867 - DNA, 521 bp, Homo sapiens
  misc_feature: GZ8MTXP02G0GL2.17.25.C03.1.454.CMB.2.raw
  modified_base (502)..(502): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccaagacctcctgactctctggtgcatccatctgcgaagtgctccatcgagttcagtgcagtgatctgggacagatttcaatctacaccatcaccactctgcaaactgaggtattgtgcaaatctaactactagtacaactagacttacacgttccctacgtcctaacgttttcggaccgtacggggaacctaaaggttcgaagactacgaaaacgaactaggngctacgacactactctatc

SEQ ID NO: 394868 - DNA, 522 bp, Homo sapiens
  misc_feature: GZ8MTXP02JA7CD.17.25.C03.1.454.CMB.2.raw
  modified_base (273)..(273): a, c, t, g, unknown or other
  modified_base (362)..(362): a, c, t, g, unknown or other
  modified_base (406)..(406): a, c, t, g, unknown or other
  modified_base (419)..(419): a, c, t, g, unknown or other
  modified_base (452)..(452): a, c, t, g, unknown or other
  modified_base (475)..(475): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggattctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggtgtcacagtcgtcttcacccatcctccgggacngacttaccatcgaccacgaactcctaccaataaacacagcctanatggattgaggancctagacatctgacgacgacggcctctattacngtgcgagactcccagatccggtnacgccctacggcaggccggtcctttgacttcgcggggccagggtccg

SEQ ID NO: 394869 - DNA, 554 bp, Homo sapiens
  misc_feature: GZ8MTXP02IUFYG.17.25.C03.1.454.CMB.2.raw
  modified_base (301)..(301): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctcctgtctgcctctgtgggggtcagagtcaccatcacttgccggacaagtcacggcgttaaaacctatttaaattggtatcagcagaaaacctggaaaacgccccaagaccctcctgatctctggtncatccactctgcgaagtggcgtcccatcggaggttccagtggcagtggatctgggacagatttcaatctcaccatcaccactctgcaacctgagattgtgcaatctactactgtacaacagagttacacgttccccctcgtacctacgttttcggaccgtaacgggggtaccctaaaaggttcgaaaggtaacttaccgaaaaccgtaaacgtcggtaaggcctaggacctaacctaacttcgtcgtttaccc

SEQ ID NO: 394870 - DNA, 495 bp, Homo sapiens
  misc_feature: GZ8MTXP02F401G.17.25.C03.1.454.CMB.2.raw
  modified_base (387)..(387): a, c, t, g, unknown or other
  modified_base (416)..(416): a, c, t, g, unknown or other
  modified_base (481)..(481): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaacgccccagacctcctgatctctggtgcatccactctgcgaagtggcgtccatcgaggttccagtgcagtggatcgtgggacagtatttcaatctcacatcacactctgcaaccngagatgtgcaatctactactgtacaacanacgtacacgttcccctcgctacgtttcggcgtacgggacaaaggttcagactacaaacgactagngctgcacatctgtc

SEQ ID NO: 394871 - DNA, 570 bp, Homo sapiens
  misc_feature: GZ8MTXP02ISMZD.17.25.C03.1.454.CMB.2.raw
  modified_base (276)..(276): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaanccccagacctcctgatctctggtgcatccactctgcgaagtggcgtccatcgagttccagtgcagtgatctggggacagtatttcaatctcaccatcaccactctgccaaccgttgaaggtatttgagctaaattccttacctaacttgtaccaaacgtagtaacgtttaccacggtttccccctagtccttaacgttttcgggacccgtaacgggggaaccctaaaaggttcgaaacggtacttaccgaaaacgtaactggtaacgcgtacgaccacctacttctacgtttcc

SEQ ID NO: 394872 - DNA, 520 bp, Homo sapiens
  misc_feature: GZ8MTXP02H41Y5.17.25.C03.1.454.CMB.2.raw
  modified_base (323)..(323): a, c, t, g, unknown or other
  modified_base (359)..(359): a, c, t, g, unknown or other
  modified_base (414)..(414): a, c, t, g, unknown or other
  modified_base (440)..(440): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggatgggcgaaccctaanactggtgtcacagtcgtctcacccatcctccggacngacttaccatcgacccacgactcctacataaaccacagcctacatggattgagancctagacatctgacgacacggccgtntattactgtgcgagacgtcccagactccggtgacgccgtacggcaggccggtctttcgacttcgtcggggccaggggccg

SEQ ID NO: 394873 - DNA, 496 bp, Homo sapiens
  misc_feature: GZ8MTXP02FH6KI.17.25.C03.1.454.CMB.2.raw
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaagccccagacctcctgatctctggtgcatccactctgcgaagtggcgtcccatcgaggttccagtggcagtggatctggggacagatttcaatctcacatcaccactccgcaacctgaggattgtgcaatctactactgtcaacagagttacagttcccctcgcactttggcctaggggaccaaaagttgagatacaaacgaactgtggctgcaccatctctctc

SEQ ID NO: 394874 - DNA, 419 bp, Homo sapiens
  misc_feature: GZ8MTXP02GIE49.17.25.C03.1.454.CMB.2.raw
  modified_base (414)..(419): a, c, t, g, unknown or other
tcagcgtagactagcacgaccggtgctcgatttagtagtgtagatttgggtttgggagggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaaagttgagatcaaacgaactgtggctgccacatctgtctcatcttcccgcatctgactagtctacgctgagcgggctggcaaggcgcgatagnnnnnn

SEQ ID NO: 394875 - DNA, 502 bp, Homo sapiens
  misc_feature: GZ8MTXP02JGK72.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaacgccccagacctcctgatctctggtgcatccactctgcgaagtggctccatcgagttccagtgcagtggatctgggacagtatttcaatctacaccatcaccactctgcaacctgaggtattgtgacaatctactactgtacaacagtagttacacgttcccctcgctactttggccaggggaccaagttcgagactacaaacgatgtaagctagcacactctcgttac

SEQ ID NO: 394876 - DNA, 530 bp, Homo sapiens
  misc_feature: GZ8MTXP02HAL7K.17.25.C03.1.454.CMB.2.raw
  modified_base (446)..(446): a, c, t, g, unknown or other
  modified_base (453)..(453): a, c, t, g, unknown or other
  modified_base (456)..(456): a, c, t, g, unknown or other
  modified_base (476)..(476): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcaacctaacactggtgtcacagtgtcttccacccatcccgtccgggacacgaccttaccgatcgacccacgaactccctaccaataaacacacgcctacatggattgaggacnctagacntcngacgacacgctactattacngtgcgagacgtcccgaagtacgtccggtagacgccctacggcacgggcgttccg

SEQ ID NO: 394877 - DNA, 525 bp, Homo sapiens
  misc_feature: GZ8MTXP02IWNHK.17.25.C03.1.454.CMB.2.raw
  modified_base (272)..(272): a, c, t, g, unknown or other
  modified_base (364)..(364): a, c, t, g, unknown or other
  modified_base (396)..(396): a, c, t, g, unknown or other
  modified_base (403)..(403): a, c, t, g, unknown or other
  modified_base (443)..(443): a, c, t, g, unknown or other
  modified_base (450)..(450): a, c, t, g, unknown or other
  modified_base (476)..(476): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtncgccaggccgctggacaacgacctgagtggatggggatgggcgaaaccctaacactggtgtcacgagtcgtcttcacccatcctccgggacngacttaccatgaccacgaactccacataaacncagccanatggattgaggagcctgacatctagacgacacggcccgtntattacngtgcgagacgtccccagactccgganacgccctacggcaggcggtcctttggaccttcgtcggggccaggggacc

SEQ ID NO: 394878 - DNA, 527 bp, Homo sapiens
  misc_feature: GZ8MTXP02JFY5G.17.25.C03.1.454.CMB.2.raw
  modified_base (273)..(273): a, c, t, g, unknown or other
  modified_base (360)..(360): a, c, t, g, unknown or other
  modified_base (393)..(393): a, c, t, g, unknown or other
  modified_base (475)..(475): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcaaccctaacactggtgtcacagtcgtctcacccatcctccggacngacttacatcgaccacgaactcctacataaacncagcctacatggagtgagagcctagacatctgacgacgaccggccgtatattactgtgcgtagcgtcccagactcccgggtnacgccctacgggcaggccggtctttgaccgtttcgcggggcccaggggtccg

SEQ ID NO: 394879 - DNA, 516 bp, Homo sapiens
  misc_feature: GZ8MTXP02JFTBT.17.25.C03.1.454.CMB.2.raw
  modified_base (357)..(357): a, c, t, g, unknown or other
  modified_base (412)..(412): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatgggcgaaccctacactggtgtcacagtgtcttcacccatcctcgggacngacttacatgaccacgaactcctccataaacacagccctacatggagttgaggancctgacatctgacgacacggccgtctattacctgtgcgagactcccagatccggtgacgcctaacgggcaggccgactttgacttcgtcggggccaggggaccg

SEQ ID NO: 394880 - DNA, 511 bp, Homo sapiens
  misc_feature: GZ8MTXP02IQDWD.17.25.C03.1.454.CMB.2.raw
  modified_base (273)..(273): a, c, t, g, unknown or other
  modified_base (324)..(324): a, c, t, g, unknown or other
  modified_base (361)..(361): a, c, t, g, unknown or other
  modified_base (437)..(437): a, c, t, g, unknown or other
  modified_base (444)..(444): a, c, t, g, unknown or other
  modified_base (468)..(468): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaacccctanactggtgtcacagtgtcttcacccatcctccgggacngacttaccatgaccacgaactcctcataaacacagcctacatggattgagagctgacatctgacgacacggccgtntattacngtgcgagacgtcccagatccggtnacgcctacggcagcggcctttgacttcgtcggggccaggggcg

SEQ ID NO: 394881 - DNA, 533 bp, Homo sapiens
  misc_feature: GZ8MTXP02IGLZA.17.25.C03.1.454.CMB.2.raw
  modified_base (364)..(364): a, c, t, g, unknown or other
  modified_base (407)..(407): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggcgaaccctacactggtgtcacagtcgtcttccaccccatcccgtccgggacngaccttaccatcgaccacgactccctacataaacacagcctanatggattgagagcctgacatctgacgacacgccgtatattacgtgtgcgagacgtcccagtacgtccggtgaacgtccgtacggcacggccggtcctttagaccttcgtcggggccaaggggcccg

SEQ ID NO: 394882 - DNA, 593 bp, Homo sapiens
  misc_feature: GZ8MTXP02ICAXA.17.25.C03.1.454.CMB.2.raw
  modified_base (102)..(102): a, c, t, g, unknown or other
  modified_base (305)..(305): a, c, t, g, unknown or other
  modified_base (348)..(348): a, c, t, g, unknown or other
  modified_base (369)..(369): a, c, t, g, unknown or other
tcagcgtagactagcacgaccggtgctcgatttagtagtgtagatttgggtttgggggagtcagtctcagtcaggacacagcatggacatgagggtccccgntcagctcctggggctcctgctactctggctccgagctgccagatgtgacatccagatgacccagtctccatcctccctgtctgcctctggtgggggtcagagtcaccatcacttgccggacaagtcacggacgttaaaacctaatttaaattaggatcagcaaggaaaacctggaaaagccccagacctcctgatctctggtncatccactctgcgaagtgcgtccatcgagtccagtgcagtganctggggacagatttcaatctnaccaactcaaccctacgtctacggcaaaccgtaggaggtaattggtacgactaactacttactacttacgtactaacaagtacgttacgtacgttacccgttccgtaccgttaccgtttacggttaccggtaacgggtaaacggtaaacggttaacgtaacgtaaacgtaacgtaaaacgtaaacgtacgtaacggtacgtacgacgtactactacttacgttc

SEQ ID NO: 394883 - DNA, 528 bp, Homo sapiens
  misc_feature: GZ8MTXP02IAKNA.17.25.C03.1.454.CMB.2.raw
  modified_base (298)..(298): a, c, t, g, unknown or other
  modified_base (396)..(396): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggtacttaaaacctatttaaattggtatcagcagaaacctggaaaagccccagacctctgatctctggtncatccactctgcgaagtgctccatcgagttccagtgcagtgatcgtgggacagtatttcaatctacaccatccaccactctgacaacctgagtattgngcaaatctactactgtacaacagtacgttacacgttcccctcgtctacgtttgaccgtaacggggaccctaaaggttcgaagaacttaccgaaaacgtaacgtgtaacggctagaccacactctacgtttcc

SEQ ID NO: 394884 - DNA, 541 bp, Homo sapiens
  misc_feature: GZ8MTXP02JJBMT.17.25.C03.1.454.CMB.2.raw
  modified_base (298)..(298): a, c, t, g, unknown or other
  modified_base (402)..(402): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggcgttaaaacctatttaaatggtatcagcagaaacctggaaaacgccccagacctcctgatctctggtncatccactctgcgaagtggcgtcccatcgaggttccagtgcagtggatcgtgggacagtatttcaatctacaccatcaccactctgccaacctgaggtattgtnctaatctactactgtacaacagtacgttacacgttcccctcgtacctacgtttcggaccgtaacgggggaccctaaaggttcgaagtaactaccgaaaacgtacgtagtcggactacggacaccacttcctacgtttcc

SEQ ID NO: 394885 - DNA, 514 bp, Homo sapiens
  misc_feature: GZ8MTXP02IMJVQ.17.25.C03.1.454.CMB.2.raw
  modified_base (271)..(271): a, c, t, g, unknown or other
  modified_base (320)..(320): a, c, t, g, unknown or other
  modified_base (358)..(358): a, c, t, g, unknown or other
  modified_base (416)..(416): a, c, t, g, unknown or other
  modified_base (449)..(449): a, c, t, g, unknown or other
  modified_base (474)..(474): a, c, t, g, unknown or other
tcagcgtagactagcacgaccggtgctcgatttagtagtgtagatttgggtttgggaaccacatctgtcctctagagaaaaccctgtgagcacagctcctcaccatggactggacctggaggatcctgttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtncgccaggccgctggacaacgcctgagtggatgggatgggcaaccctaanactggtgtcacagtcgtcttcacccatcctccgggacngacttaccatcgaccacgaaactccctacataaacacagcctacatggagttgaaggngcctgacatctgacgacacggcctactattacngtgcgagacgtccatgacttccggngacgcctaggcaagcgcctttgacttcgtggggccagggg

SEQ ID NO: 394886 - DNA, 511 bp, Homo sapiens
  misc_feature: GZ8MTXP02IP2EP.17.25.C03.1.454.CMB.2.raw
  modified_base (298)..(298): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtncatccatctgcgaagtgcgtccatcgagttccagtgcagtgatctggggacagatttcaatctcaccatcaccactctgcaacctgagtatgtgactaatctactacttgtacaacagtagttacacgtttcccctcgtacctacttttcggccgtacggggacccaaagttcgaagtactacaaacgaactgtggctacgcacactctgtcc

SEQ ID NO: 394887 - DNA, 536 bp, Homo sapiens
  misc_feature: GZ8MTXP02HB0KP.17.25.C03.1.454.CMB.2.raw
  modified_base (324)..(324): a, c, t, g, unknown or other
  modified_base (358)..(358): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatggggacaaccctaanactggtgtcacagtgtcttcaccatcctcggacngacttaccatcgaccacgaactcctacataaacacagcctacatgagttgaggagcctagacatctgacacgacgccgtactattacgtgtgacgagacgtcccacgactcccggtgaacgcctaacgggcaacggccggtccttttacgacttcgtcgggggaccctaaggggcccg

SEQ ID NO: 394888 - DNA, 538 bp, Homo sapiens
  misc_feature: GZ8MTXP02H5GW5.17.25.C03.1.454.CMB.2.raw
  modified_base (223)..(223): a, c, t, g, unknown or other
  modified_base (279)..(279): a, c, t, g, unknown or other
  modified_base (303)..(303): a, c, t, g, unknown or other
  modified_base (371)..(371): a, c, t, g, unknown or other
  modified_base (441)..(441): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganaagtcacggtacgttaaaacctatttaaattggtatcagcagaaacctggaaaacnccccagacctcctgatctctggtncatccactctgcgaagtgcgtcccatcgagttccagtgcagtggatcgtggggacagtatttcaatcncaccatcaccactctgccaaactgagtattgtgcaatctaactactgtacaacagagttacacgttcccncgtacctacgttttcggacccgtaacgggggaacctaaaaggtttgaagtaactacgaaaacgtaactggtcggctagccaaccacttcgtacttcc

SEQ ID NO: 394889 - DNA, 500 bp, Homo sapiens
  misc_feature: GZ8MTXP02FJUF6.17.25.C03.1.454.CMB.2.raw
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaagccccagacctcctgatctctggtgcatccactctgcgaagtggcgtcccatcgagttccagtgcagtgatctgggacagatttcaatctcacatcaccactctgcaacctgaggattgtgcaatctaactactgtacaaacagaagttacagtttcccctcgccacttttggccaaggggaccaaagttcgagatacaaaacgactagtggctcgcaccatctgtacc

SEQ ID NO: 394890 - DNA, 549 bp, Homo sapiens
  misc_feature: GZ8MTXP02I40JR.17.25.C03.1.454.CMB.2.raw
  modified_base (273)..(273): a, c, t, g, unknown or other
  modified_base (324)..(324): a, c, t, g, unknown or other
  modified_base (360)..(360): a, c, t, g, unknown or other
  modified_base (403)..(403): a, c, t, g, unknown or other
  modified_base (416)..(416): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcaaaccctanactggtgtcacagtcgtctcacccatcctccggacngacttaccatcgaccagaacctcctacataaacacagacctanatggagttgaganctagacatctagacgacgaccggccgtacttagttactggtcgacgtaacgacgttccccaaggtaccgtccgggtagacgccgtacgggcaggccggtcctttgaccgttcgtacggggcccagggggtccg

SEQ ID NO: 394891 - DNA, 530 bp, Homo sapiens
  misc_feature: GZ8MTXP02H240W.17.25.C03.1.454.CMB.2.raw
  modified_base (237)..(237): a, c, t, g, unknown or other
  modified_base (273)..(273): a, c, t, g, unknown or other
  modified_base (324)..(324): a, c, t, g, unknown or other
  modified_base (360)..(360): a, c, t, g, unknown or other
  modified_base (413)..(413): a, c, t, g, unknown or other
  modified_base (446)..(446): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtncgccaggccgctggaccaagacctgagtggatgggatgggcgaaccctaanactggtgtcacagtcgtcttcaccatcctcgggacngacttacatgaccacgactcctcaataaacacacgcctacatgagttgaggancctagacatctgacgacacgcgtacctattacngtcgcgagacgtcccacgtacgtccggagacgccctacgggcacggccggtccttttggacctttcgcggggccaaggggcccg

SEQ ID NO: 394892 - DNA, 532 bp, Homo sapiens
  misc_feature: GZ8MTXP02IW0NQ.17.25.C03.1.454.CMB.2.raw
  modified_base (275)..(275): a, c, t, g, unknown or other
  modified_base (297)..(297): a, c, t, g, unknown or other
  modified_base (382)..(382): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacgttaaaacctatttaaatggtatcagcaagaaacctggaaacncccagacctctgatctctggtncatccactctgcgaagtggccgtccatcgagttcagtgcaggtgatcgtgggacagtatttcaatctacaccatcaccactcgtnactaacctgagtattgtacgactaaattcttaactacttagactaaacagtacttactacgttcccctcgtactacgtttacggaccgtaggggaacctaaagtacgaagaactacgaaaacgtactgtcggctacgacactatctcttc

SEQ ID NO: 394893 - DNA, 539 bp, Homo sapiens
  misc_feature: GZ8MTXP02HQSTJ.17.25.C03.1.454.CMB.2.raw
  modified_base (403)..(403): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcaagaaacctggaaaacgccccagacctcctgatctctggtgcatccatctgcgaagtggcgtcccatcgagttccagtgcagtggatcgtggggacagtatttcaatctcaccatcaccactctgaccaactgagacttgtancaatctactactgtacaactagaacgttacacggttccccctacggccttacgttttggacccgtaacggggtaaccctaaaggttgagtaactacgaaaacgtactgtaacggctagcctacacttcgtcttacc

SEQ ID NO: 394894 - DNA, 548 bp, Homo sapiens
  misc_feature: GZ8MTXP02JEPBW.17.25.C03.1.454.CMB.2.raw
  modified_base (364)..(364): a, c, t, g, unknown or other
  modified_base (406)..(406): a, c, t, g, unknown or other
  modified_base (450)..(450): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacgaaaccctaacactggtgtcacagtgtcttcacccatcctccgggacngacttaccaatcgaccaacgaactcctaccaataaaccacancctaacatggattgaggagctgacatctgacgacacggccgttntattactgtgcgagacgtcccagactcccggggagacgtaccgaccggcgacgccggggtccttttcggactttcggtcgggggcccgaaggggcccg

SEQ ID NO: 394895 - DNA, 514 bp, Homo sapiens
  misc_feature: GZ8MTXP02FMFFH.17.25.C03.1.454.CMB.2.raw
  modified_base (299)..(299): a, c, t, g, unknown or other
  modified_base (394)..(394): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaacgccccagacctcctgatctctggtncatccactctgcgaagtggctccatcgagttccagtgcagtggatctgggacagtatttcaatctcaccatccaccactctgcactgaggattgngcaatctactactgtacaacagtacgttactacgttcccctcgtctacgtttcggaccgtaacggggacctaaagttcgaagtactacgaaaacgaactgtggctcgacaccatctgttc

SEQ ID NO: 394896 - DNA, 524 bp, Homo sapiens
  misc_feature: GZ8MTXP02HOTQ1.17.25.C03.1.454.CMB.2.raw
  modified_base (301)..(301): a, c, t, g, unknown or other
  modified_base (368)..(368): a, c, t, g, unknown or other
  modified_base (382)..(382): a, c, t, g, unknown or other
  modified_base (397)..(397): a, c, t, g, unknown or other
  modified_base (438)..(438): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctggaaaacgccccagacctcctgatctctggtncatccactctgacgaagtggcgtccatcgaggttcagtgcagtgatcgtgggacagtatttcaatcncacatcaacactcngcaactgagtattgngacaatctaactactgtacaacagtagttacacgttccccngctatttcggacctacggggacctaaaagttcgaagaactacgaaaacgtaactggtaacggctacgacaaccacttcgtacttcc

SEQ ID NO: 394897 - DNA, 514 bp, Homo sapiens
  misc_feature: GZ8MTXP02FRZIV.17.25.C03.1.454.CMB.2.raw
  modified_base (359)..(359): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatgggcaaccctacactggtgtcacagtgtcttcacccatcctccgggacngacttaccatgaccacgaaactcctccataaacacagcctacatggagttgaggagcctgacatctgacgacacggccgtctattactgtgcgagacgtcccacgatccggtgacgcctacggcagcggctttgacttcgtcggggccagggacg

SEQ ID NO: 394898 - DNA, 552 bp, Homo sapiens
  misc_feature: GZ8MTXP02HBSMF.17.25.C03.1.454.CMB.2.raw
  modified_base (272)..(272): a, c, t, g, unknown or other
  modified_base (324)..(324): a, c, t, g, unknown or other
  modified_base (362)..(362): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggatggggatgggcgaaaccctanactggtgtcacagtcgtcttcacccatcctccgggacngacttacatgaccacgaactcctaccataaacacagcctacatggagttgaggacgcctagacatctgacgacacggccgtctattacgtgtcgacgagacgtcccgagtacgtccggtgaacgtcctaccggctaacggccgggtcccttttacggaccgtttcggcgggggacccgaagggggtcccg

SEQ ID NO: 394899 - DNA, 518 bp, Homo sapiens
  misc_feature: GZ8MTXP02HVD8B.17.25.C03.1.454.CMB.2.raw
  modified_base (362)..(362): a, c, t, g, unknown or other
  modified_base (371)..(371): a, c, t, g, unknown or other
  modified_base (452)..(452): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacacgacctgagtggatgggatggggcgaaccctaacacgtggtgtcacagtcgtcttcacccatcctccgggacngacttaccntgaccacgaaactccctccaataaacacagcctacatggagttgagagcctagacatctgacacgaccggcgtctattacngtgcgagactccacgatccggtgacgcctacggcacgcggtccttgacttcgtcggggccagggcg

SEQ ID NO: 394900 - DNA, 556 bp, Homo sapiens
  misc_feature: GZ8MTXP02FJBOI.17.25.C03.1.454.CMB.2.raw
  modified_base (299)..(299): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggcgttaaaactatttaaatggtatcagcagaaacctggaaaacgccccagacctcctgatctctggtncatccatctgcgaagtggctccatcgagttccagtgcagtggatcgtgggacagtatttcaatctcaccatcaccactccgcaacctgaggattgtgacaattctactactgtacaacagtacgttaacacgtttccccctgtcctacgtttcgggacccgtaacgggggtaaccctaaaaggttgaaacgtaataccaaaaacggtaactggttacggaaccttacggacctaaccatttcctcggttcctttacc

SEQ ID NO: 394901 - DNA, 540 bp, Homo sapiens
  misc_feature: GZ8MTXP02J0XUW.17.25.C03.1.454.CMB.2.raw
  modified_base (277)..(277): a, c, t, g, unknown or other
  modified_base (301)..(301): a, c, t, g, unknown or other
  modified_base (411)..(411): a, c, t, g, unknown or other
tcagcgtagactagcacgaccggtgctcgatttagtagtgtagatttgggtttgggggagtcagtcgtcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaacctatttaaatggtatcagcagaaacctggaaaacnccccagacctcctgatctctggtncatccactctgcgaagtcggctcccatcgagttccagtgcagtggatcgtggggacagtattcaatctacaccactaccacccacctccgactaacccgtgagtattgtnactaatctaactactcgtacaacagtacgttacacgttccctcgtctacgtttcgacgtaacggggtaacctaagtgaacgtactaacgaaacgacgtgtacgctacgaccactactctcgtacttccg

SEQ ID NO: 394902 - DNA, 518 bp, Homo sapiens
  misc_feature: GZ8MTXP02FLY2X.17.25.C03.1.454.CMB.2.raw
  modified_base (299)..(299): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtncatccactctgcgaagtggcgtccatcgagttccagtgcagtggatcgtggggacagtatttcaatctcaccatcaccactctgacaacctgaggattgtgcaaatctactactgtacaacagtacgttacacgttcccctcgctacgtttggaccgtacggggaaccaaagttcgagactacgaaaacgaactgtaaggctacgacaccatctcgttc

SEQ ID NO: 394903 - DNA, 530 bp, Homo sapiens
  misc_feature: GZ8MTXP02HRNC2.17.25.C03.1.454.CMB.2.raw
  modified_base (358)..(358): a, c, t, g, unknown or other
  modified_base (420)..(420): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatggatgggcaaccctacactggtgtcacagtcgtcttcacccatcctccgggacncgacttaccatcgacccacgaactccctacaataaacacacgcctaacatggagttgaggancctagacatctagacacacggctctattactgtgcgagacgtccacgtactccggtgaacgccgtacgggcaggccggtccttggaccttcgtcggggacctaggggccg

SEQ ID NO: 394904 - DNA, 469 bp, Homo sapiens
  misc_feature: GZ8MTXP02G6F5M.17.25.C03.1.454.CMB.2.raw
  modified_base (414)..(414): a, c, t, g, unknown or other
  modified_base (433)..(469): a, c, t, g, unknown or other
tcagcgtagactagcacgaccggtgctcgatttagtagtgtagatttgggtttggggagggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggagtctgggacagatttcaatctcaccatcaccatctgcaacctgaggattgtgcaatctactactgtcaacagacgttacagttccccctgctacttttggccaggggaccaaaaggttgaggactacgaaacgtactagtggctggacccacatctagtcttcatccttcccgctactctgactagtctacgctgagcgggntaggcaagggcatatacgnnnnnnnnnnnnnnnnnnnnnnnnnnnnnnnnnnnnn

SEQ ID NO: 394905 - DNA, 545 bp, Homo sapiens
  misc_feature: GZ8MTXP02I99S8.17.25.C03.1.454.CMB.2.raw
  modified_base (272)..(272): a, c, t, g, unknown or other
  modified_base (320)..(320): a, c, t, g, unknown or other
  modified_base (361)..(361): a, c, t, g, unknown or other
  modified_base (483)..(483): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgcctgagtggatgggatgggcaaccctanactggtgtcactagtcgtcttcacccatcccgtccgggacncgacttaccatcgaccacgaacctccctacaataaaccacagccctaacatggagttgagagcctagacatcgtgacgtacacggcctctattactgtgacgagcgtcccaagctccggtanacgcctaacgggcacggccggtaccctttggaccctttcggacgggggcccaagggggcccg

SEQ ID NO: 394906 - DNA, 516 bp, Homo sapiens
  misc_feature: GZ8MTXP02JUJTN.17.25.C03.1.454.CMB.2.raw
  modified_base (273)..(273): a, c, t, g, unknown or other
  modified_base (323)..(323): a, c, t, g, unknown or other
  modified_base (430)..(430): a, c, t, g, unknown or other
  modified_base (451)..(451): a, c, t, g, unknown or other
  modified_base (454)..(454): a, c, t, g, unknown or other
  modified_base (474)..(474): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcaaaccctaanacgtggtgtcacagtcgtcttccacccatccctcgggacagacttacatcgaccacgaactccctaccataaacacagcctacatggagttgagagcctagacatcngacacgacgccgtctattacngtncgagcgtcccagctccggtnacgcctacggcagccggctttcgacttcgcgggccagggccg

SEQ ID NO: 394907 - DNA, 586 bp, Homo sapiens
  misc_feature: GZ8MTXP02HWA10.17.25.C03.1.454.CMB.2.raw
  modified_base (278)..(278): a, c, t, g, unknown or other
  modified_base (307)..(307): a, c, t, g, unknown or other
  modified_base (487)..(487): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctaggaaaacnccccagacctcctagactctcgtgggtcncactcccactctggacgaaggtcggccgtcccagtcggagttccagtggcaggtggatcgtggggactagtatttacaatcctacaccatccacctactctgacctaaaccgtggaagtattgacgactaaattcctaacttacgtgtaaccaaacgaggtattacctacgtttcccccnggtaccttacgtttcggaccgtaacggggaacctaaggttacgaagtaactacgaaaaccgtaactggtaacggtctacgaccaactctcttacgttcc

SEQ ID NO: 394908 - DNA, 571 bp, Homo sapiens
  misc_feature: GZ8MTXP02JTRPV.17.25.C03.1.454.CMB.2.raw
  modified_base (406)..(406): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaacctattaaatggtatcagcagaaacctggaaaacgccccagacctcctgatctctggtcgcatccactctgcgaagtggcgtcccatcgagttccagtgcagtgatctggggactagatttcgaatctacacactcaccactccgacaaccctgacggtattggtnactaatactactactacgtacaacctagtacgttaacctacggtttcccctacggtcctacgttttcggaccgtaacgggggtaccctaaaggttacgaaggtaacttaccgaaaacgtaacttggtacggtctcggacctacgtactctacggtctttaacccg

SEQ ID NO: 394909 - DNA, 534 bp, Homo sapiens
  misc_feature: GZ8MTXP02FSZZQ.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaatggtatcagcagaaacctggaaaagccccaagacctcctgatctctggtgcatccactctgcgaagtggcgtcccatcgagttccagtgcagtggatcgtgggacagtatttcaatctcacatcaccactctgacaacctgaggtattgtgctaatctactactgtacaaacagtacgttacacgttcccctcgctacgttttcggaccgtaacggggtaacctaaagttacgaacgtactacgaaaacgtacgtacgtggtcctagaccacctatctgtttcc

SEQ ID NO: 394910 - DNA, 577 bp, Homo sapiens
  misc_feature: GZ8MTXP02IE9BS.17.25.C03.1.454.CMB.2.raw
  modified_base (304)..(304): a, c, t, g, unknown or other
  modified_base (391)..(391): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacgttaaaacctatttaaattggtatcagcaagaaacctggaaaacgccccagacctcctgatctctggtncatccactctgacgaagtcggcgtccatcgagttccagtgcagtgatcgtgggacagtatttacaattctacaccatcacctactcngaccacgtgagtattgtagactaaattcctaacttacgttagtacaaacgtagtacgttacctacggttcccctcgtaccttacgtttcggaaccgtacggggtaaacctaaaggttcgaaagtaactaaccgaaaacgtaacgtcggtaacggtctacgacctaaaccgtacttacgttattccc

SEQ ID NO: 394911 - DNA, 576 bp, Homo sapiens
  misc_feature: GZ8MTXP02HDWIT.17.25.C03.1.454.CMB.2.raw
  modified_base (278)..(278): a, c, t, g, unknown or other
  modified_base (302)..(302): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcagaaacctggaaaacnccccagacctcctgatctctggtncatccactctgcgaagtggccgtccatcgaggttccagtggcagtggatcgtggggactagtatttcaattctcacctactacacccactctcgacaaccgtgaggtattgtagactaaatcttaactactgtacaaacagtacgttactacgttcccctcgtccttacgtttacggaccgtaacgggggtaacctaaaggttacgaaggtaactaaccgaaaacggtaacgtggtaacggtcctacgactaacccacttaccgttacgtttcc

SEQ ID NO: 394912 - DNA, 531 bp, Homo sapiens
  misc_feature: GZ8MTXP02H8KT1.17.25.C03.1.454.CMB.2.raw
  modified_base (221)..(221): a, c, t, g, unknown or other
  modified_base (302)..(302): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctgtgggggtcagagtcaccatcacttgccgganaagtcacggtacgttaaaacctatttaaattggtatcagcaagaaacctggaaaacgccccagacctcctgatctctggtncatccactctgcgaaagtggcgtccatcgagttccagtgcagtggatctgggacagtatttcaaatctacacatcacactctgcaactgaggattgtgacaatctactactagtacaaacagaagttacacgtcccctacgctactttggaccgtaacggggaaccctaaaggttacgaagaactaacaaaaccgtaaataggtggacacgacaaccacttctacttcc

SEQ ID NO: 394913 - DNA, 619 bp, Homo sapiens
  misc_feature: GZ8MTXP02JDGR3.17.25.C03.1.454.CMB.2.raw
  modified_base (284)..(284): a, c, t, g, unknown or other
  modified_base (311)..(311): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccactccctccctgtctcgcctcgtggtggggtcagagtccaccatctacgtcgaccgaacagtcacggtacttaaactatttaatggtatcagacaagaaacctaggaaacnccccagaccctctgactcgtctggtcncactccactgcggacgtaggtcgccctaccagtcggtagttccgagtcgactaggtgacttcgtgggactagtacttacatcctacactacacctaccacgtctacgactacgtggagtattcgactactaactacttactactacgtaacaacgtacgtaccgttactcccgttaccctgtaccgttacggttacgggaaccggtaacgggtaacctaaaggttacggtaaactaaacgtaccgaaaaacgtcgtacggtaacggtaccgtacgaccctaacgttacgttccgttacgtttaacccg

SEQ ID NO: 394914 - DNA, 563 bp, Homo sapiens
  misc_feature: GZ8MTXP02IAZFA.17.25.C03.1.454.CMB.2.raw
  modified_base (365)..(365): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggccaaaccctaacacgtggtgtcacagtcgtcttcacccatcctccgggacncgacttacatcgaccacgaactcctacccaataaacacagaccctacatggattggagacgctagactatcgtagacgacgaaccggccgttatacttacgtgtagccgaagtacgtaccccaagtcgtcccggtagaacggtccctaacgggctaaggcccggtactttcgacttcgtcgggggaccacggggaccg

SEQ ID NO: 394915 - DNA, 559 bp, Homo sapiens
  misc_feature: GZ8MTXP02HUPNZ.17.25.C03.1.454.CMB.2.raw
  modified_base (271)..(271): a, c, t, g, unknown or other
  modified_base (323)..(323): a, c, t, g, unknown or other
  modified_base (330)..(330): a, c, t, g, unknown or other
  modified_base (362)..(362): a, c, t, g, unknown or other
  modified_base (399)..(399): a, c, t, g, unknown or other
  modified_base (468)..(468): a, c, t, g, unknown or other
tcagcgtagactagcacgaccggtgctcgatttagtagtgtagatttgggtttgggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctagattcacgtttacctcctatagtatcaactgggtncgccaggccgctggaccaacgacctgagtggatggatgggacaaaccctaanactggtntcacagtcgtccttcacccatcctccgggacngacttaccatcgaccacgaacctcctaccaataaacncaacgccctaacataggaagttggaacggtagccctagacaatctgaacgacgaccggctactattacngtcgcgtaagacgtcccacgactcccggtgaacgtcccgaacggcacggccgggtccttttggacctttcggccggggaccgacggggccg

SEQ ID NO: 394916 - DNA, 675 bp, Homo sapiens
  misc_feature: GZ8MTXP02GK6S7.17.25.C03.1.454.CMB.2.raw
  modified_base (273)..(273): a, c, t, g, unknown or other
  modified_base (321)..(321): a, c, t, g, unknown or other
  modified_base (328)..(328): a, c, t, g, unknown or other
  modified_base (360)..(360): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcaaccctanactggtntcacagtcgtcttcacccatccctccgggacncgacttacatcgacccacgaacctccctaccaataaaaccacacgccctaacagtacgggtagtttaggaaggacgcccttaggaaccctaagttcccgttagggaacccgaaccgtaccgggtaccccgtttacttaacgttttaaccgtggttacggaccggtaaggtacccgtttaccccgaaaccgggttaacgttccccgggggtaacgaccggtacccccggttaacggggccctaaacggggtcccggtacccgtttttgggaaccccgtttttcgggcccggggggacccaaaggggggttccccgg

SEQ ID NO: 394917 - DNA, 576 bp, Homo sapiens
  misc_feature: GZ8MTXP02F1UNS.17.25.C03.1.454.CMB.2.raw
  modified_base (308)..(308): a, c, t, g, unknown or other
  modified_base (319)..(319): a, c, t, g, unknown or other
  modified_base (412)..(412): a, c, t, g, unknown or other
  modified_base (418)..(418): a, c, t, g, unknown or other
tcagcgtagactagcacgaccggtgctcgatttagtagtgtagatttgggtttgggggagtcagtctcagtcaggacacagcatggacatgagggtcccgctcagctcctggggctcatgctactctggctccgagctgccagatgtgacatccagatgacccagtctccatccctccctgtctgcctcgtggtgggggtcagagtcaccatcacttgccgacaagtcacggtacgttaaaacctatttaaatggtatcagcaagaaacctaggaaaacgccccagaccctcctagatctcgtggtcncactccatcgngacgagtcgctccagtcggtacgtcagtggctagtgatcgtagggactagtacttcaactctacacatccacctatctcgactacgtgaagtnttacgntaactaactaccttaactagttactaacaaagtacgtacgtttacccacgtttccccacgtaccttaacggtttcggaaccggtaacgggaaacctaaggttacgaaacgtaactaaacgaaacgtacgtggtcgacctacgacctactcttacgttc

SEQ ID NO: 394918 - DNA, 546 bp, Homo sapiens
  misc_feature: GZ8MTXP02G6UHL.17.25.C03.1.454.CMB.2.raw
  modified_base (322)..(322): a, c, t, g, unknown or other
  modified_base (329)..(329): a, c, t, g, unknown or other
  modified_base (363)..(363): a, c, t, g, unknown or other
  modified_base (406)..(406): a, c, t, g, unknown or other
  modified_base (493)..(493): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacttttacctctatagtatcaactggtgcgccaggccgctggacaacggcctgagtggatgggatgggcgaaccctaanactggtntcacagtcgtcttcacccatcccgtaccgggacnggacttaccagtcgacccacgaaacctcctaccaataaaaccncaacgcctaacatcggagttggagagcctagaccatctgacgacaccggcgtatattactgtgcgagacgtcccaggactccgggtnacgtccgtacggcaggccggtcctttcggacttcgcggggtccaggggtaccg

SEQ ID NO: 394919 - DNA, 542 bp, Homo sapiens
  misc_feature: GZ8MTXP02IWRIF.17.25.C03.1.454.CMB.2.raw
  modified_base (271)..(271): a, c, t, g, unknown or other
  modified_base (320)..(320): a, c, t, g, unknown or other
  modified_base (328)..(328): a, c, t, g, unknown or other
  modified_base (332)..(332): a, c, t, g, unknown or other
  modified_base (358)..(358): a, c, t, g, unknown or other
  modified_base (394)..(394): a, c, t, g, unknown or other
  modified_base (418)..(418): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactggtncgccaggccgctggaccaacgcctgagtggatgggatgggcaaccctanacgtggtntcanagtcgtcttcaccatcctccgggacngacttaccatcgacccacgaactcctaccataaacncacgcctaacatcggagttgagancctgacatctgaaccacgaccgccgtactattactggtgcgagacgtcccacggacgttccggagacgtaccgtacggacgacggtccgtccgttacggtcgttcggcgggaccgagggtcccg

SEQ ID NO: 394920 - DNA, 616 bp, Homo sapiens
  misc_feature: GZ8MTXP02F0XU7.17.25.C03.1.454.CMB.2.raw
  modified_base (284)..(284): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacaacgacctgagtggatggggatggggaccgaaacccctaaacgacgttgggtgtaccacgtaggtcgtcctttaccaacccattcccgtaccggggaactacggacctttaacccattcgaacccacggaaaaccttcccttaccaaataaaacccacaacgaccctaacatggggaatttggaagggacgcccttaggactatctagacgaccgacgggccctacttagttactggtgacgagacgtacccagactccgggtagacgccctaacggcacggcggtaccttttcggacgtttcggtcgggggacccgaggggtcccg

SEQ ID NO: 394921 - DNA, 517 bp, Homo sapiens
  misc_feature: GZ8MTXP02JP7ES.17.25.C03.1.454.CMB.2.raw
  modified_base (298)..(298): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacttaaaacctattaaatggtatcagcagaaacctggaaaacgccccagacctcctgatctctggtncatccactctgcgaagtgcgtccatcgagttccagtgcagtggatcgtgggacagtatttcaattctacaccatcaccactctgcaacctgaggattgtgcaaatctactactgtacaacagtacgttactacgttcccctcgcctacgttttcggccgtaacggggtaccaaagttcgaagactacaaaacgaactggtcgctcgcaccatctcgttc

SEQ ID NO: 394922 - DNA, 535 bp, Homo sapiens
  misc_feature: GZ8MTXP02GMK47.17.25.C03.1.454.CMB.2.raw
  modified_base (277)..(277): a, c, t, g, unknown or other
  modified_base (301)..(301): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaatggtatcagcagaaacctggaaaacnccccagaccctctgatctctggtncatccactctgcgaagtcggcgtcccatcgaggttccaggtggcaggtggatcgtggggacagtatttcaatctcaccatcaccactctgcactgagattgtgactaatctactactgtacaacagtacgttacacgttcccctcgtctacgtttcggaccgtacggggaacctaaaggttacgaagactaacgaaacgtaacgtgtcggctacgacacctactcgttcgttcc

SEQ ID NO: 394923 - DNA, 564 bp, Homo sapiens
  misc_feature: GZ8MTXP02IX5HD.17.25.C03.1.454.CMB.2.raw
  modified_base (458)..(458): a, c, t, g, unknown or other
  modified_base (466)..(466): a, c, t, g, unknown or other
tcagcgtagactagcacgaccggtgctcgatttagtagtgtagatttgggtttgggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatggggcaaccctaacactggtgtcactagtcgtccttcgaccccagtccctccgggacacgtacttacccatcgaccacgaaactccctacactaaacacagtaccctacagtggaagtgagacgcctgacatctgaccacgacgcccgtntacttacngtcggacgaggtacctcccgacgtacgtcccggtgacggtcccacggtcgaccggtcggtacctttcggacttccggcgggggtaccgacgggaccgg

SEQ ID NO: 394924 - DNA, 597 bp, Homo sapiens
  misc_feature: GZ8MTXP02H9TKN.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtggtgcgccaggccgctcggacaacgacctgagtggatggggatggggaccgaaccctaacacgtggtgtacacagtcgtcttcacccatccgtccgggacacgaccttacatacgaccacgaactccctaccaataaacacagcctacatcggagttgaggacgcctgacatctagacgacacggtccgtactattccgtgttcgcgaacgaacgttccccgaacggtacgtccggtacggacgacccgtaaccgggccgtacggtcccgggttccgttttacggtacccgtttccggaccgggggtacccgtacgggggtaccccgg

SEQ ID NO: 394925 - DNA, 524 bp, Homo sapiens
  misc_feature: GZ8MTXP02JY1G6.17.25.C03.1.454.CMB.2.raw
  modified_base (324)..(324): a, c, t, g, unknown or other
  modified_base (331)..(331): a, c, t, g, unknown or other
  modified_base (363)..(363): a, c, t, g, unknown or other
  modified_base (400)..(400): a, c, t, g, unknown or other
  modified_base (419)..(419): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcaaccctaanactggtntcacagtcgtcttcacccatccctccgggacngaccttaccatcgaccacgaactcctaccaataaacncagcctacatggattgagngcctagacatctgacgacacggcctctattactgtgcgagacgtcccagatccggtgacgcccgtacggcagccggtcctttagcttcgcggggccaggggtccg

SEQ ID NO: 394926 - DNA, 577 bp, Homo sapiens
  misc_feature: GZ8MTXP02HSMDE.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccctctatagtatcaactggtgcgccaggccgctggacaacgacctgagtggatgggatgggacaaccctaacactggtgtcacagtcgtcttcacccatccgtaccgggacacgaccttaacccatccgaacccacgaaacctccctaccaaataaaaccacaacgaccctaacagtgggaagttggaaggagcctagaccatccgtagaaccgacgaaccggccgttacttattactgtgcgagacgtcccgacgtacgtccggtgaacgccctaacgggccaggccgggtctttcgacctttcggtcggggaccgaggggcccg

SEQ ID NO: 394927 - DNA, 570 bp, Homo sapiens
  misc_feature: GZ8MTXP02HMQ67.17.25.C03.1.454.CMB.2.raw
  modified_base (272)..(272): a, c, t, g, unknown or other
  modified_base (319)..(319): a, c, t, g, unknown or other
  modified_base (359)..(359): a, c, t, g, unknown or other
  modified_base (404)..(404): a, c, t, g, unknown or other
  modified_base (419)..(419): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgctgagtggatgggatgggcaaccctanactggtgtcacagtgtccttcaccccatccctccgggacngacttacatcgaccacgaactcctaccataaacacacgccctaanagtggagtagagacnccgtagactactcgtacgaacgaccgacggtccctacttaattacgtgtacgacgtacgaccgtacccgacggtacgtccggtagaccgtaccgtaccggacgacggtccggttccgtttcgtaccgttcggtcggggaccgtacgggccg

SEQ ID NO: 394928 - DNA, 512 bp, Homo sapiens
  misc_feature: GZ8MTXP02GQRZ0.17.25.C03.1.454.CMB.2.raw
  modified_base (272)..(272): a, c, t, g, unknown or other
  modified_base (321)..(321): a, c, t, g, unknown or other
  modified_base (359)..(359): a, c, t, g, unknown or other
  modified_base (392)..(392): a, c, t, g, unknown or other
  modified_base (410)..(410): a, c, t, g, unknown or other
  modified_base (445)..(445): a, c, t, g, unknown or other
  modified_base (498)..(498): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaccctanactggtgtcacagtcgtcttcacccatcctccgggacngacttaccatcgaccacgactcctacataaacncagctacatggatgagancctagacatctagacacacggcctactattactgngccgagcgtcccagatcccggtgacgcctacggcagccggtacttgacttcgnggggccagggtccg

SEQ ID NO: 394929 - DNA, 542 bp, Homo sapiens
  misc_feature: GZ8MTXP02HDRQ8.17.25.C03.1.454.CMB.2.raw
  modified_base (302)..(302): a, c, t, g, unknown or other
  modified_base (383)..(383): a, c, t, g, unknown or other
  modified_base (398)..(398): a, c, t, g, unknown or other
  modified_base (419)..(419): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctattaaattggtatcagcaagaaacctggaaaacgccccagacctcctgatctctggtncaatccactctgcgaagtgcgtccatcgaggttccagtgcagtggatcgtgggacagatttcaatctacacatcaacaccncacactgagtatganacaatactactatagtacaanagtactacctacgttccctcgtcgttacgtttacggacgtaaacgggtaaactaaaggttagaacaactaaacgtaaaacgtaacgtagtacgtaacgtacgacactactactacgttacttc

SEQ ID NO: 394930 - DNA, 541 bp, Homo sapiens
  misc_feature: GZ8MTXP02FOUDT.17.25.C03.1.454.CMB.2.raw
  modified_base (366)..(366): a, c, t, g, unknown or other
  modified_base (460)..(460): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgttggtgtcacagtcgtcttccacccatccgtccgggacngacttacatcgaccacgaactcctacaataaacacagcctacatggagttcgaggagcctagacatctagaccacgaccggccgtatacttacngtgcgagacgtcccacgactcccggtagacgtccgtaacggcgagccggtcctttgaccttcgtacggggccaggggaccg

SEQ ID NO: 394931 - DNA, 555 bp, Homo sapiens
  misc_feature: GZ8MTXP02J2F1B.17.25.C03.1.454.CMB.2.raw
  modified_base (253)..(253): a, c, t, g, unknown or other
  modified_base (272)..(272): a, c, t, g, unknown or other
  modified_base (321)..(321): a, c, t, g, unknown or other
  modified_base (329)..(329): a, c, t, g, unknown or other
  modified_base (361)..(361): a, c, t, g, unknown or other
  modified_base (401)..(401): a, c, t, g, unknown or other
  modified_base (413)..(413): a, c, t, g, unknown or other
  modified_base (440)..(440): a, c, t, g, unknown or other
  modified_base (498)..(498): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccnctatagtatcaactgggtncgccaggccgctggacaacgcctgagtggatggatgggaccaaccctanacgtggtntcacagtcgtcttcacccatccctccgggacncgacttaccatcgaccacgaaactccctacaagtaaaccncaacgccctaanagtggagttgaggagcctagacatcgngacgacgacggtcctacttaattcgtgtcgcgaagtcgtacccaggacgtcccgggtnaccgtccgacgggcacggtccggtcctttagccgtttcggcggggaccaggggtccc

SEQ ID NO: 394932 - DNA, 577 bp, Homo sapiens
  misc_feature: GZ8MTXP02JU3MD.17.25.C03.1.454.CMB.2.raw
  modified_base (272)..(272): a, c, t, g, unknown or other
  modified_base (361)..(361): a, c, t, g, unknown or other
  modified_base (398)..(398): a, c, t, g, unknown or other
  modified_base (469)..(469): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacacgacctgagtggatgggatggggcaaccctaacactggtgtcacagtcgtcttcacccatccgtccgggacncgtaccttacatcgaccacgactcctaccaataaacncacgcctacagtcggagttgaggacgccttagacctatcctagaccgaccacggccttactagtttaccgngtacgacgacgtaccgtacccgacggtacgtccgggagaccgtacccgtacggccgacggtccggttccgtttacggaccgtttcgggcggggtaccgaggggtcccg

SEQ ID NO: 394933 - DNA, 556 bp, Homo sapiens
  misc_feature: GZ8MTXP02H3TKD.17.25.C03.1.454.CMB.2.raw
  modified_base (222)..(222): a, c, t, g, unknown or other
  modified_base (303)..(303): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccgganaagtcacggtacgttaaaacctatttaaattggtatcagcaagaaacctggaaaacgccccagacctcctgatctctggtncatccactctgcgaagtggctccatcgagttccagtgcagtgatcgtgggacagtatttcaatctacaccatcaccactctagcctaacctgaggtattgtgacaaatctaactactgtacaaacagtaacgttacacgtttcccctgtcctacgtttcgggacccgtaaggggtaacctaaaaggttcgaaagtaactacgaaaacgtaacgttggtcggaccttacgacctaccactttcgttacgtttcc

SEQ ID NO: 394934 - DNA, 635 bp, Homo sapiens
  misc_feature: GZ8MTXP02GGCIK.17.25.C03.1.454.CMB.2.raw
  modified_base (229)..(229): a, c, t, g, unknown or other
  modified_base (247)..(247): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagagcgtgggctnagtgagtctctgcagctngatctacgttacctctatagtatcaacgtggtcgcgaccgaggccgctggaaccaacgtccgtgaggtggagtgggatcggggacctaaccgtaacgacgtggtctacacgtagtcgttcctccacctactcccgtaccgggaactacgaccttacagtaccgaaccgaacgtaaccctccctaaccaaacttaaaaccaccgacgaccctaagtacgttagggaaggtttacggaacgggaccgacccggaactaacgtccgtacggaccgaaccgtaccgggtcctacgttacgttacgtaggtcgacggtacgtaaccgtcccgaaacgtccgtaccgggtaacgaccgttacccgacggccgacggtccggttccgtttacggg

SEQ ID NO: 394935 - DNA, 540 bp, Homo sapiens
  misc_feature: GZ8MTXP02IC3WH.17.25.C03.1.454.CMB.2.raw
  modified_base (210)..(210): a, c, t, g, unknown or other
  modified_base (267)..(267): a, c, t, g, unknown or other
  modified_base (360)..(360): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgagtctctgcaggcttctggattcacgtttacctcctatagtatcaactgggtncgccaggccgctggacaacgacctgagtggatgggatggggacaaccctaacactggtgtcacagtcgtccttcacccatcccgtccgggacngacctttacatcgacccacgaactccctaccataaaccacagaccctaacatgggaagttgaggagcctgacctatctagaccgacaccgggcctactattactgtgcgagcgtcccagactccggtagacgccctacggcaggccggtcctttgacctttcgcgggggaccaggggccg

SEQ ID NO: 394936 - DNA, 563 bp, Homo sapiens
  misc_feature: GZ8MTXP02F1NG1.17.25.C03.1.454.CMB.2.raw
  modified_base (253)..(253): a, c, t, g, unknown or other
  modified_base (273)..(273): a, c, t, g, unknown or other
  modified_base (426)..(426): a, c, t, g, unknown or other
  modified_base (463)..(463): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtncgccaggccgctggacaacgcctgagtggatgggatgggcaaaccctaacactggtgtcacagtcgtcttccacccatccctccgggacacgacttaccatcgaccaacgaactccctaccaactaaacacaagcctaacatcggattgagancctagacatctgacgacaccggaccgtctaatttacnggtgacgtagacgtccccacggactcccgggtgaacggcccgtaacggggcacggccggtaccttttcggacctttcggtcgggggacccgaggggaccg

SEQ ID NO: 394937 - DNA, 507 bp, Homo sapiens
  misc_feature: GZ8MTXP02FPEJB.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaagccccagacctcctgatctctggtgcatccactctgcgaagtggcgtccatcgaggttccagtgcagtggatctggggacagtatttcaatctcaccatcaccactctgcaacctgagattgtgcaaatctactactgtacaacagacgttacacgttccctcgctacgtttgccgtaacggggaccaaagttcgaagactacgaaaacgactagtgctacgcaccatctgttc

SEQ ID NO: 394938 - DNA, 605 bp, Homo sapiens
  misc_feature: GZ8MTXP02HPAIE.17.25.C03.1.454.CMB.2.raw
  modified_base (329)..(329): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgcctggagtggagtgggatggggaccaaccctaacncgtggtgtcacgagtcgtccttccaccctacttcccgtcccgggacacgtaccttaccattccgaacccaccgaacttccctacaaactaaaaccacaacgaccctaacagtaggtaagttaggacggacgccctagaccattcctaggacgaccgaccggccttactattacgtgtcgcgtacgacgttcccgacggtacgtccggtagaccgcccgtaccggacgtacggccgttcctttacgaccgtttcggccggggaccgaagggtcccgg

SEQ ID NO: 394939 - DNA, 568 bp, Homo sapiens
  misc_feature: GZ8MTXP02HPKAU.17.25.C03.1.454.CMB.2.raw
  modified_base (280)..(280): a, c, t, g, unknown or other
  modified_base (310)..(310): a, c, t, g, unknown or other
  modified_base (372)..(372): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggaacaagtcacggtacttaaaactatttaaatggtatcagcaagaaacctagggaaaacccncccaacgtacctctagtactctcgtggtcnctactccactcgtgacgtaggtcggcctccagtcggtagttcaggtcgacaggtagactcgngggactatacttacaactcacacactaccaacctactcgacacacgtagagtagtgtagactaatactactactactacaacaagtaacgtactactcctcgtctacgttacgtacggaacggaacgtaaagtaacgtaagtaacgtaacgaaaacgtaacgtacgtaacggtcgtacgacacctactacttcttc

SEQ ID NO: 394940 - DNA, 526 bp, Homo sapiens
  misc_feature: GZ8MTXP02JR84G.17.25.C03.1.454.CMB.2.raw
  modified_base (272)..(272): a, c, t, g, unknown or other
  modified_base (323)..(323): a, c, t, g, unknown or other
  modified_base (361)..(361): a, c, t, g, unknown or other
  modified_base (415)..(415): a, c, t, g, unknown or other
  modified_base (425)..(425): a, c, t, g, unknown or other
  modified_base (447)..(447): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatgggatggggcaaccctaanactggtgtcacagtcgtcttcacccatcctccgggacngaccttacatgaccacgaactcctccataaacacagcctacatggagtgaggancctgacatcngacgacgacgccgtctattacngtgacgtagacgttcccagacgtccggtgacgccctacggccagccggtccctttgaccttcgcggggtccaggggccg

SEQ ID NO: 394941 - DNA, 542 bp, Homo sapiens
  misc_feature: GZ8MTXP02IZ7IV.17.25.C03.1.454.CMB.2.raw
  modified_base (280)..(280): a, c, t, g, unknown or other
  modified_base (303)..(303): a, c, t, g, unknown or other
  modified_base (354)..(354): a, c, t, g, unknown or other
  modified_base (401)..(401): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacgttaaaacctatttaaattggtatcagcaagaaacctggaaaacnccccagacctctgatctctggtncactccactctgcgaagtggccgtccatcgaggttccagtgcagtgatcgnggggacagtattcaatctcacatcaccactctgacaacgtgaaggtnttgtcgcaaattcctaactactgtacctaacagtacgttacacgttcccctcgccttacgtttcggaccgtaacggggactaaaggttcgaaagtactacgaaaacgtcgtaggtaacgctcgaccactactctacgtttc

SEQ ID NO: 394942 - DNA, 531 bp, Homo sapiens
  misc_feature: GZ8MTXP02JZ73A.17.25.C03.1.454.CMB.2.raw
  modified_base (337)..(337): a, c, t, g, unknown or other
  modified_base (364)..(364): a, c, t, g, unknown or other
  modified_base (442)..(442): a, c, t, g, unknown or other
  modified_base (456)..(456): a, c, t, g, unknown or other
  modified_base (464)..(464): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctctttcttggtggcagcagctacaagtgcccactcccaggtgcagctggtgcagtctggggctgaggtgagaagcctggggcctcagtgaaggtctcctgcaaggcttctggatttcacgtttacctcctatgtatcaactgggtgcgcccaggccgctggacaacgacctgagtggatgggatgggcgaaccctaacactggtgtcacngtcgtcttcacccatccctccgggacngaccttaccattgaccacgaactcctccataaaaccacagcctaacatgggattggaggagcctgacatctgacgacncggcctctattacngtgacganaacgtcccagatccggtgacgcctacggcagcggcttttcgactttcgtcggggccagggggtaccg

SEQ ID NO: 394943 - DNA, 521 bp, Homo sapiens
  misc_feature: GZ8MTXP02G4QNI.17.25.C03.1.454.CMB.2.raw
  modified_base (362)..(362): a, c, t, g, unknown or other
  modified_base (396)..(396): a, c, t, g, unknown or other
  modified_base (445)..(445): a, c, t, g, unknown or other
  modified_base (452)..(452): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatgggcgaaaccctaacactggtgtcacagtcgtcttcacccatccgtccggacngacttaccatcgaccacgactcctacactaaacncacgcctacatggagttgagagcctagacatctagacgacacggccgtntattacngtgcgagacgtcccacgatccggtgacgcctacggcacggccgtcttgacttcgcggggccgagggccg

SEQ ID NO: 394944 - DNA, 523 bp, Homo sapiens
  misc_feature: GZ8MTXP02GL0CJ.17.25.C03.1.454.CMB.2.raw
  modified_base (290)..(290): a, c, t, g, unknown or other
  modified_base (472)..(472): a, c, t, g, unknown or other
  modified_base (498)..(498): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattcacgtttacctcctatagtatcaactgggtncgccaggccgctggacaacgcctgagtggatgggatggggacaacctacacgtggtgtcacagtgtcttcacccatcccgtcgggacagacttaccatcgaccacgactcctaccaataaacacacgcctacagtggagttgaggagccgtgaccatctgaacacgacggcgtactattacngtcgcgacgacgtcccagactccggngacgcctacggcacggcggttaccg

SEQ ID NO: 394945 - DNA, 521 bp, Homo sapiens
  misc_feature: GZ8MTXP02IQYPF.17.25.C03.1.454.CMB.2.raw
  modified_base (298)..(298): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctctgatctctggtncatccactctgcgaagtgcgtccatcgagttccagtgcagtggatcgtggggacagtatttcaatctcaccatcaccactctgcaacctgaggtattgtagctaatcttactactgtacaacagagttacacgttcccctcgtcttacgtttggacccgtaacgggggaacctaaaggttcgaagactacgaaaacgtactgtaaggctcgcacactctgttc

SEQ ID NO: 394946 - DNA, 548 bp, Homo sapiens
  misc_feature: GZ8MTXP02G5ZNW.17.25.C03.1.454.CMB.2.raw
  modified_base (271)..(271): a, c, t, g, unknown or other
  modified_base (323)..(323): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgccaggccgctggacaacgacctgagtggatgggatggggacaaccctaanacgtggtgtcactagtcgtcttcaccctatcccgtccggggacacgtacttaccatcgaccacgaactccaccataaaccacacgcctacatcggattgaggagcctagacatctagacgacacggccgtctattactgtcgacgagcgtacccacgatcccgggtgacgtccgtacgggcacggccggtcctttggacctttcggcggggtaccacggggtccg

SEQ ID NO: 394947 - DNA, 547 bp, Homo sapiens
  misc_feature: GZ8MTXP02GD4O5.17.25.C03.1.454.CMB.2.raw
  modified_base (273)..(273): a, c, t, g, unknown or other
  modified_base (362)..(362): a, c, t, g, unknown or other
  modified_base (447)..(447): a, c, t, g, unknown or other
  modified_base (455)..(455): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaaccctaacactggtgtcacagtcgtcttcacccatcccgccggacngacttaccatcgaccacgaactcctaccaataaacacagcctaacatggagttgaggagcctagacatctgacgacacggccctntattacgngtgcgagacgtcccacgtacgtccggtagacgccctaacgggcacggtccggtcccttttaggacctttcggcgggggcccaaggggacccg

SEQ ID NO: 394948 - DNA, 607 bp, Homo sapiens
  misc_feature: GZ8MTXP02GJ5UH.17.25.C03.1.454.CMB.2.raw
  modified_base (223)..(223): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganagtcacggacttaaaacctatttaaatggtatcagcagaaacctggaaaacgccccagacctcctgatctctggtgcactccactctgcgaagtcggcgtcccagtcgaggttccaggtgcaggtgatcgtggggacagtatttacaatctacaccatccaacccatctgaccaaccgtggaagtatttgacactaaattccttaaactccgtagtaaccaaacgtaacgtacgttaacctaccgtttcccccgtcgtaccttacggttttcgggacccgtaaacgggggtaacctaaaagggttcgaaacgtaacttaaccgaaaaacgtacgttagggaacggtacctacggtacccaccgtaactttccgtacgttttccc

SEQ ID NO: 394949 - DNA, 547 bp, Homo sapiens
  misc_feature: GZ8MTXP02HXGCU.17.25.C03.1.454.CMB.2.raw
  modified_base (274)..(274): a, c, t, g, unknown or other
  modified_base (462)..(462): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccctcctatagtatcaactgggtncgccaggccgctggacaacgcctggagtggatgggatggggacaaccctaacacgtggtgtcacagtcgtcttccaccctatcccgtccggacagtacttaccatcgaccacgaactccctacaataaacacacgcctaacatggtagtgaggagcctagacatctagacgacacgccgtctattacngtgcgacgacgtccccaagctccgggtgacggcccgtacggcacggccggtctttacggacctttcggcggggccgaaggggccg

SEQ ID NO: 394950 - DNA, 533 bp, Homo sapiens
  misc_feature: GZ8MTXP02GCW3O.17.25.C03.1.454.CMB.2.raw
  modified_base (273)..(273): a, c, t, g, unknown or other
  modified_base (284)..(284): a, c, t, g, unknown or other
  modified_base (321)..(321): a, c, t, g, unknown or other
  modified_base (326)..(326): a, c, t, g, unknown or other
  modified_base (329)..(329): a, c, t, g, unknown or other
  modified_base (353)..(353): a, c, t, g, unknown or other
  modified_base (422)..(422): a, c, t, g, unknown or other
  modified_base (425)..(425): a, c, t, g, unknown or other
  modified_base (475)..(475): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacaacgacctgagtggatggatgggcaaccctanctggncanagtcgtcttcaccatcctccggangacttacatcgaccacgacctccacaataaacacacgcctaacatcgggaattcggagacgcctagacntcngacgacacggccctgtattactgtcgcgagacgtcccgagactccgggtnacgcccgtacggctacgcggtccctttagaccgttcggcggggaccgaggggtacccg

SEQ ID NO: 394951 - DNA, 528 bp, Homo sapiens
  misc_feature: GZ8MTXP02I7QCI.17.25.C03.1.454.CMB.2.raw
  modified_base (399)..(399): a, c, t, g, unknown or other
  modified_base (419)..(419): a, c, t, g, unknown or other
  modified_base (482)..(482): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaactggtgcgccaggccgctggacaacgacctgagtggatgggatggggacaaccctaacacgtggtgtcacagtcgtcttcaccccatccctccgggacagacttaccatcgaccacgaactccctccaataaacncagcctacatggattgagancctagacatctgacgacacggcctcgtattacgtgtcgacgagacgtcccagactccgggtanacgcctacggctacggccgtctttagccttcgcggggccaggggcc

SEQ ID NO: 394952 - DNA, 562 bp, Homo sapiens
  misc_feature: GZ8MTXP02H0H6X.17.25.C03.1.454.CMB.2.raw
  modified_base (302)..(302): a, c, t, g, unknown or other
  modified_base (406)..(406): a, c, t, g, unknown or other
  modified_base (450)..(450): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacgttaaaactattaaattggtatcagcaagaaacctggaaaacgccccagacctcctgatctctggtncatccactctgcgaagtcggctccatcgagttccagtgcagtgatcgtgggacagtatttacaatctacaaccactccaccactctgaccaacctgagtatgtnactaatctactactgtacaaacagtaagttaccacgtttccccngtaccttacgtttcggacccgtaaggggaaaccctaaaggttgaaacgtaactaaccgaaaacgtaaccgtggtaacggtactacggacccaactacgtactttacgttacc

SEQ ID NO: 394953 - DNA, 569 bp, Homo sapiens
  misc_feature: GZ8MTXP02J2NA1.17.25.C03.1.454.CMB.2.raw
  modified_base (272)..(272): a, c, t, g, unknown or other
  modified_base (365)..(365): a, c, t, g, unknown or other
  modified_base (434)..(434): a, c, t, g, unknown or other
  modified_base (508)..(508): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatgggatgggacgaaccctaacacgtggtgtcactagtcgtcttccaccctatcctccggacngacttaccatcgaccacgaactccctacaataaaccacacgccctaacagtcggaagttgaagggtacncctagacatctagacgacgacggccttatacttacgtgtcgacgtacgacgttccccaaggtctcccggggtanacggtcccgacggcaacggccggtaccctttggacctttcggcggggacccaggggtcccg

SEQ ID NO: 394954 - DNA, 532 bp, Homo sapiens
  misc_feature: GZ8MTXP02IX9IF.17.25.C03.1.454.CMB.2.raw
  modified_base (271)..(271): a, c, t, g, unknown or other
  modified_base (357)..(357): a, c, t, g, unknown or other
  modified_base (412)..(412): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctggggcctcagtgaaggtctcctgcaaggcttctggattcacgtttacctcctatagtatcaactggtncgccaggccgctggacaacgacctgagtggatggggatgggcaaccctacactggtgtcacagtgtctcaccatcctaccgggacngacttaccatcgaccacgaactccacataaacacagcctaacatggattgaggancctgacatctagaccgacgacgccgtactattactgtgacgagacgtcccacggtatcccgggtgaacgccgtacggcacggccggtacctttcggacgttcgtcggggccgagggaccg

SEQ ID NO: 394955 - DNA, 619 bp, Homo sapiens
  misc_feature: GZ8MTXP02F6I1N.17.25.C03.1.454.CMB.2.raw
  modified_base (278)..(278): a, c, t, g, unknown or other
  modified_base (303)..(303): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaatggtatcagcaagaaacctaggaaacnccccagaccctcctgatctctggtncatcccactctgacgagtcggccgtcccagtcggaggttccaggtggcaggtggatcgtggggacagtatttcaattcacaacactccacctactctcgaccaacctgacgtattgtacgacaattaccttaactacgtgtacaaacgtacgtaacgttacctaccgttcccctcgtaccgttacgttttacgggacccggtaaacggggaacccgtaaaaggtttacgaaacgtaacgtaaaccgtaaaaaccggtaacgttacgggtaacggtccgttacggaccctaacccgtacgttccttacggtttaccc

SEQ ID NO: 394956 - DNA, 580 bp, Homo sapiens
  misc_feature: GZ8MTXP02H68BG.17.25.C03.1.454.CMB.2.raw
  modified_base (225)..(225): a, c, t, g, unknown or other
  modified_base (278)..(278): a, c, t, g, unknown or other
  modified_base (302)..(302): a, c, t, g, unknown or other
  modified_base (357)..(357): a, c, t, g, unknown or other
  modified_base (371)..(371): a, c, t, g, unknown or other
  modified_base (419)..(419): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatccctccctgtctgcctctggtgggggtcagagtcaccatcacttgccgganagtcacggtacgttaaacctattaaatggtatcagcacgaaacctaggaaacnccccagacctctgatctcgtggtncactccactcgtgacgagtggcctccagtcggagttccgagtcgacagtgatcgnggggacagtacttnaatctacaccactccacctactctacgactaaccgtggacgtatcgtnacctaattctaactactgtaaccaagtacgtaagttaccctaccgttcccctcgtacttacgttttacgggacccgtaagggggtaaccctaaaaggttgaaacgtaactacgaaaaccgtagttagcggtcctacgacccactacttccgttactttccc

SEQ ID NO: 394957 - DNA, 528 bp, Homo sapiens
  misc_feature: GZ8MTXP02I9SRE.17.25.C03.1.454.CMB.2.raw
  modified_base (222)..(222): a, c, t, g, unknown or other
  modified_base (274)..(274): a, c, t, g, unknown or other
  modified_base (298)..(298): a, c, t, g, unknown or other
  modified_base (380)..(380): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccgganaagtcacggacttaaaacctatttaaatggtatcagcagaaacctggaaaanccccagacctcctgatctctggtncatccactctgcgaagtggccgtcccatcgagttccagtggcagtggatcgtgggacagatttcaatctcacatcacactcngcaactgagtattgtagcaatctactaactgtacaacagtacgttacacgttcccctgcctacgtttcggaccgaggggaccctaaaggttcgaaagaactaccaaaacgtactaggtcggactcgacctaccacttcgtacgttacc

SEQ ID NO: 394958 - DNA, 530 bp, Homo sapiens
  misc_feature: GZ8MTXP02GF2LI.17.25.C03.1.454.CMB.2.raw
  modified_base (273)..(273): a, c, t, g, unknown or other
  modified_base (364)..(364): a, c, t, g, unknown or other
  modified_base (403)..(403): a, c, t, g, unknown or other
  modified_base (423)..(423): a, c, t, g, unknown or other
  modified_base (448)..(448): a, c, t, g, unknown or other
  modified_base (455)..(455): a, c, t, g, unknown or other
  modified_base (481)..(481): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcaaaccctaacactggtgtcacagtcgtccttcacccatcccgtccgggacngaccttaccatcgaccacgaactccctaccaataaaccncagcctacatggattgagancctagacatctgacacgacggcctntattacngtgcgtagacgtcccacgatccggtnacgccctacggcagcggcctttagaccgttctcggggacctagggaccg

SEQ ID NO: 394959 - DNA, 509 bp, Homo sapiens
  misc_feature: GZ8MTXP02ITZW6.17.25.C03.1.454.CMB.2.raw
  modified_base (242)..(242): a, c, t, g, unknown or other
  modified_base (299)..(299): a, c, t, g, unknown or other
  modified_base (507)..(507): a, c, t, g, unknown or other
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctntttaaattggtatcagcagaaacctggaaaacgccccagacctcctgatctctggtncatccatctgcgaagtggcgtccatcgagttccagtgcagtgatctgggacagatttcaatctacacatcacactctgcaactgagatgtgactaatctactacgtgtacaacagtacgttacacgttccctcgctactttcggccgtagggacctaaaggttcgaagtactacgaaacgtaactgtaacgctacgacaccattcctntc

SEQ ID NO: 394960 - DNA, 563 bp, Homo sapiens
  misc_feature: GZ8MTXP02HGYEM.17.25.C03.1.454.CMB.2.raw
  modified_base (303)..(303): a, c, t, g, unknown or other
  modified_base (432)..(432): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctggaaaacgccccagacctcctgatctctggtncatccactctgcgaagtggcgtcccagtcgaggttccagtggcaggtgatcgtggggacagtatttcaatctacaccatccaccactctgacaacctgagtattgtagactaatctactactagtacanagtacgttactacgttcccctcgtacttacgtttcggaccgtaacggggaacctaaaggttacgaacgtacgtaaccgaaaacgtaacgttggtaacggtctacggacctaacctacgttcttacgtttcc

SEQ ID NO: 394961 - DNA, 551 bp, Homo sapiens
  misc_feature: GZ8MTXP02F9J1P.17.25.C03.1.454.CMB.2.raw
  modified_base (367)..(367): a, c, t, g, unknown or other
  modified_base (428)..(428): a, c, t, g, unknown or other
  modified_base (453)..(453): a, c, t, g, unknown or other
  modified_base (460)..(460): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacaaaccctaacacgtggtgtcacagtcgtcttcacccatcccgtaccgggacngacttaccatcgaccaacgaacctccctacaataaacacagcctaacatggagttgaggancctagacatctgacgacacggcctntattacngtgacgagacgtcccagtactcccggtgaacgcccgtaacggccaagggccggtcctttggacctttcggcgggggacccagggggtcccg

SEQ ID NO: 394962 - DNA, 549 bp, Homo sapiens
  misc_feature: GZ8MTXP02J3LXF.17.25.C03.1.454.CMB.2.raw
  modified_base (301)..(301): a, c, t, g, unknown or other
  modified_base (386)..(386): a, c, t, g, unknown or other
  modified_base (400)..(400): a, c, t, g, unknown or other
  modified_base (421)..(421): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctggtgggggtcagagtcaccatcacttgccggacaagtcacggtacgttaaaactattaaatggtatcagcaagaaacctggaaaacgccccagacctcctgactctctggtncatccactctgcgaagtcgcgtccagtcgagttccagtgcagtgatcgtgggacagtattacaatctacaccataccaccactcncgacacgtgaagtnttagcactaatctactacgtntacaacgtagtactactaccgttccctcgtaccttacgttacggacggtaacgggtaaactaaaggtacgaaagtaacgtaacgaaaacgtacgtacggtcgacgtacgactacctactcgttacgtc

SEQ ID NO: 394963 - DNA, 547 bp, Homo sapiens
  misc_feature: GZ8MTXP02GXECA.17.25.C03.1.454.CMB.2.raw
  modified_base (330)..(330): a, c, t, g, unknown or other
  modified_base (361)..(361): a, c, t, g, unknown or other
  modified_base (418)..(418): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctacactggtntcacagtcgtcttcacccatcctccgggacngacttacatcgaccacgactccctacataaaccacagaccacatcggagttgagganccgtagacatctgacgacgacggccgtactattaccgtgtcgcgagacgtcccagactcccgggtagacgcccgtacggcaacggccggtccgtttacggactttcggacgggggccgacggggacccg

SEQ ID NO: 394964 - DNA, 538 bp, Homo sapiens
  misc_feature: GZ8MTXP02JWQ0R.17.25.C03.1.454.CMB.2.raw
  modified_base (301)..(301): a, c, t, g, unknown or other
  modified_base (394)..(394): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggtacgttaaaacctatttaaattggtatcagcagaaacctggaaaacgccccagacctctgatctctggtncatccatctgcgagtgctccatcgagttccagtgcagtgatcgtgggacagtatttcaatctcacatcacactctgactacctgagtattggnactaatctactactgtacaacgtagtacgttactacgttccctcgtacttacgtttcggaccgtaacgggtaacctaaaggttacgaaacgtacgtaacgaaacgtaacgtggtaacgtctacgacctactacttcgtacgtcc

SEQ ID NO: 394965 - DNA, 563 bp, Homo sapiens
  misc_feature: GZ8MTXP02GM44N.17.25.C03.1.454.CMB.2.raw
  modified_base (223)..(223): a, c, t, g, unknown or other
  modified_base (276)..(276): a, c, t, g, unknown or other
  modified_base (300)..(300): a, c, t, g, unknown or other
  modified_base (386)..(386): a, c, t, g, unknown or other
  modified_base (412)..(412): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganaagtcacggacttaaaacctatttaaatggtatcagcagaaacctggaaaacnccccagacctctgactctctggtncatccactctgacgagtcggctcccatcggtagttccaggtggcagtggatcgtgggacagtatttacaatctacaccatccaccnctctagacaacgtggaggtattgtanactaattctaactacgtgtacaacgagtaacgttaccacgttcccccgtagtccttacgtttacgggaccgtaacggggtaaccctaaaggttcgaagtactaaccgaaaacgtacgtggtaacggctacggactacctactctacgtttc

SEQ ID NO: 394966 - DNA, 542 bp, Homo sapiens
  misc_feature: GZ8MTXP02I17J9.17.25.C03.1.454.CMB.2.raw
  modified_base (275)..(275): a, c, t, g, unknown or other
  modified_base (300)..(300): a, c, t, g, unknown or other
  modified_base (347)..(347): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggcttaaaacctatttaaatggtatcagcagaaacctggaaaacnccccagaccctcctgatctctggtncatccatctgcgaagtgcgtccatcgagttccagtggcagtgatcgnggggacagtatttcaatctacaccatcaccactctgcaacctgaggtacttgtgactaaatcttaactacttgtacaaactagaacgttacacgttcccctcgccttacgtttcggaccgtaacggggacctaaaggttcgaagactacgaaaacgtaactggtaacgctacgaccaactacttcgtcgtttacc

SEQ ID NO: 394967 - DNA, 592 bp, Homo sapiens
  misc_feature: GZ8MTXP02GUB9V.17.25.C03.1.454.CMB.2.raw
  modified_base (273)..(273): a, c, t, g, unknown or other
  modified_base (323)..(323): a, c, t, g, unknown or other
  modified_base (362)..(362): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatggggcaaccctaanactggtgtcacagtcgtcttcacccatcccgtcgggacngaccttacatcgaccacgactccctaccataaacacagcctaacatggacgttgaggtacgcctagacctatacgtgaaccgtacgaccgggtcccgtacttacttaccgtggttcggacgtaaggaccgttacccccgacgtaacgttcccggggtagaacgtcccgtaaccggcgaacggccggttcccgtttaggaccgtttcggcgggggtcccaagggggtcccg

SEQ ID NO: 394968 - DNA, 575 bp, Homo sapiens
  misc_feature: GZ8MTXP02GGHSD.17.25.C03.1.454.CMB.2.raw
  modified_base (434)..(434): a, c, t, g, unknown or other
  modified_base (490)..(490): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactggtgcgccaggccgctggacaacgacctgagtggagtgggagtcggggacgaaaccctaacacgtggtgtcacgtagtcgtccttccaaccctactcccgtaccgggaacacgtaaccttaaccatacgaacccaacgaacctccctaccaaataaaaccacacncctaacagtggagttgagagcctagacatcgtagacgacacggccctatacttacngtgacgagacgtcccaagacgtccggtagacgccgtacgggcacggtcggtcctttcgacctttcggacgggggcccagggaccg

SEQ ID NO: 394969 - DNA, 531 bp, Homo sapiens
  misc_feature: GZ8MTXP02GOXTC.17.25.C03.1.454.CMB.2.raw
  modified_base (301)..(301): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcagaaacctggaaaagccccagacctcctgatctctggtncatccactctgcgaagtggctccatcgaggtccagtgcagtggatctggggacagtatttcaatctacaccatcaccactctgcaacctgaggattgtagacaaatctactactgtacaacagacgttactacgttcccctcgctacgtttcggccgtaacgggggaaccctaaaggttcgaagtaactacgaaaacgtaacgtgtaaggctcgacaccatctactttcc

SEQ ID NO: 394970 - DNA, 585 bp, Homo sapiens
  misc_feature: GZ8MTXP02G556X.17.25.C03.1.454.CMB.2.raw
  modified_base (324)..(324): a, c, t, g, unknown or other
  modified_base (365)..(365): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggatgggatggggcgaaccctaanacgtggtgtcacagtcgtcttcacccatcccgtccgggacncgacttaccatcgaccacgaactccctacccaataaaccacacgaccctaacagtcggagttacgaaggacgcgtagacatccgtagaccgacgaccgggtcccgttactaacgtttaccgtgttcgacgagaccgttaccccgacggtacgtcccggtaggaccgcccgtaacggcacggccgtcccgttggacttcggtacggggccaggggtacccg

SEQ ID NO: 394971 - DNA, 586 bp, Homo sapiens
  misc_feature: GZ8MTXP02IXNMN.17.25.C03.1.454.CMB.2.raw
  modified_base (270)..(270): a, c, t, g, unknown or other
  modified_base (357)..(357): a, c, t, g, unknown or other
  modified_base (414)..(414): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctctgcaaggcttctggattcacgtttacctcctatagtatcaactgggtncgccaggccgctggacaacgacctgagtggatgggatgggcaaccctacactggtgtcacagtcgtcttcacccatccctccggacngacttaccatcgaccacgaactcctacataaacacagcctacatggagttgaggacncctagacatcgtgaccgacgaaccggccgtacttactttacgtcggttgaccggagtaccgtacccccgacggtacgttcccggggtagacggtcccgtaaccgggccaacgggtccggtcccgttttacggaacccgtttcggtacgggggtcccgaacgggggtacccgg

SEQ ID NO: 394972 - DNA, 546 bp, Homo sapiens
  misc_feature: GZ8MTXP02G0GGL.17.25.C03.1.454.CMB.2.raw
  modified_base (223)..(223): a, c, t, g, unknown or other
  modified_base (253)..(253): a, c, t, g, unknown or other
  modified_base (256)..(256): a, c, t, g, unknown or other
  modified_base (272)..(272): a, c, t, g, unknown or other
  modified_base (295)..(295): a, c, t, g, unknown or other
  modified_base (425)..(425): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtggggtcagagtcaccatcacttgccgganaagtcacggtacttaaactattaatgtatnagnaagaacctaggaaacncccagacctctgatctctggtcncatccatctgacgaaggtcggccgtacccagtcggtaggttccaggtcggacaggtggacttcggtggggactagtactttacaatctacacctactccaacctactctagacctaaactgagtattganactaatctactactatacaatagtacgttactaccgttccctctcttacgttcggacgtaacgggaactaaagtcgaagtaactaacgaaaacgtagtgtcgtctacgacactactctctc

SEQ ID NO: 394973 - DNA, 554 bp, Homo sapiens
  misc_feature: GZ8MTXP02F2F3W.17.25.C03.1.454.CMB.2.raw
  modified_base (292)..(292): a, c, t, g, unknown or other
  modified_base (440)..(440): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctctatagtatcaactgggtncgccaggccgctggacaacgacctgagtggatgggatggggacaacctacactggtgtcacagtgtctcaccatcccgtccgggacagaccttacatcgaccacgaactcctacaactaaacacacgaccacatggagttaggagganccgtagaaccatctggaaccgacgacggccgtactaacttacgtggtcgacgaacgtacgtacccgaacgtacgtcccggtagacgacccgtaccgggacaccggcggttaccg

SEQ ID NO: 394974 - DNA, 529 bp, Homo sapiens
  misc_feature: GZ8MTXP02F4Y2Z.17.25.C03.1.454.CMB.2.raw
  modified_base (322)..(322): a, c, t, g, unknown or other
  modified_base (361)..(361): a, c, t, g, unknown or other
  modified_base (480)..(480): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaaccctanactggtgtcacagtcgtcttcacccatccctccgggacngacttaccatcgaccacgaactcctacaataaacacagcctaacatggagtgacggagcctagacatcagacgacacgcccgtatacttatgtgacgagacgtccccagactccgggtnacgcccgtacggcacgcggtcttcgacgtttcgcgggggccaggggccg

SEQ ID NO: 394975 - DNA, 544 bp, Homo sapiens
  misc_feature: GZ8MTXP02FV4R7.17.25.C03.1.454.CMB.2.raw
  modified_base (222)..(222): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccgganaagtcacggacgttaaaacctatttaaatggtatcagcagaaacctggaaagccccagacctcctgatctctggtgcatccactctgcgagtggctcccatcgaggttccagtgcagtggatcgtggggacagtatttacaatctacaccatcaccactctcgacaacctgaggtattgtagactaatcctaactactgtacaaacgagtacgttacacgttccctcgctacgtttcggaccgtaacggggaacctaaaggttcgaaacgtactaccgaaaacgtacgtagtaaggctacggactaccattacctcgtttcc

SEQ ID NO: 394976 - DNA, 547 bp, Homo sapiens
  misc_feature: GZ8MTXP02FRKLH.17.25.C03.1.454.CMB.2.raw
  modified_base (300)..(300): a, c, t, g, unknown or other
  modified_base (403)..(403): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaatggtatcagcagaaacctggaaaacgccccagacctctgatctctggtncatccatctgcgaagtggctccatcgagttccagtgcagtggatcgtgggacagtatttcaattctacacatcaccactctgactaacctggaggtattgtanacaaattcctaacttacgtgtacaaactagtaacgttactaccgttcccctcgtccttaacgtttcggacccgtaacggggacctaaaaggttcgaaagtactaccgaaaacgtactaggtgctacgaccacctatcctgttcc

SEQ ID NO: 394977 - DNA, 537 bp, Homo sapiens
  misc_feature: GZ8MTXP02IWNPD.17.25.C03.1.454.CMB.2.raw
  modified_base (273)..(273): a, c, t, g, unknown or other
  modified_base (362)..(362): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaaccctaacactggtgtcacagtcgtcttcacccatcctccgggacngacttacatcgaccacgaactcctaccataaacacacgcctacatggattgagagcctagacatctagacgacaccggcctactatactgtagcgagacgtcccagacgtcccggagacgtccgtacggcacggccggtccctttagaccgttcggcggggacccgaggggcccg

SEQ ID NO: 394978 - DNA, 655 bp, Homo sapiens
  misc_feature: GZ8MTXP02F232Z.17.25.C03.1.454.CMB.2.raw
  modified_base (276)..(276): a, c, t, g, unknown or other
  modified_base (377)..(377): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcagtgaaggtctcctgcaaggtcttcgtggattctacgtttacctcctatagtatcaactgggtncgccaggccgctggacaacgacctgagtggatgggatggggacctaaccctaacacgtggtgtcacgagtcgtaccttccaccctatcccgtaccgggganacgtaccttaccatccgaaccaacgtaaacctccctaccaataaaccacacgcctaacatcgggtaagttggaggtacgcctaggacctagtcgtaggaccgacgaccgggtcccttattacgttacgtggtacgaccggtaagtaccgttaccccgaacggtacgttcccggggtagaaccgggtccccgttaaaccggggccgtaacgggttccccgggtacccgttttagggtaccccgttttcgggacggggggtaccccagggggtaaccccg

SEQ ID NO: 394979 - DNA, 546 bp, Homo sapiens
  misc_feature: GZ8MTXP02FLABD.17.25.C03.1.454.CMB.2.raw
  modified_base (253)..(253): a, c, t, g, unknown or other
  modified_base (365)..(365): a, c, t, g, unknown or other
  modified_base (405)..(405): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtgcgccaggccgctggacaacgacctgagtggatgggatgggcaaccctaacacgtggtgtcacagtcgtcttccacccatcccgtccgggacngaccttaccatcgaccacgaacctccctaccaataaaccncagccctaacatggagttgaggagcctagacatctgacgacacggccgtatattacgtgtgacgagacgtcccagagtcccggtgacgcccgtacggcaggccggtctttacggactttcggcggggcccaggggtacccg

SEQ ID NO: 394980 - DNA, 547 bp, Homo sapiens
  misc_feature: GZ8MTXP02H6CCU.17.25.C03.1.454.CMB.2.raw
  modified_base (324)..(324): a, c, t, g, unknown or other
  modified_base (364)..(364): a, c, t, g, unknown or other
  modified_base (407)..(407): a, c, t, g, unknown or other
  modified_base (419)..(419): a, c, t, g, unknown or other
  modified_base (446)..(446): a, c, t, g, unknown or other
  modified_base (454)..(454): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatggggacaaccctaanactggtgtcacagtcgtcttccacccatcccgtcgggacngtacttacatcgaccacgactccaccaataaacacacgcctanatggagttgagngctagacatctagacgacgacggcctntacttacngtagcgagacgtcccagtacgtccggtagacgtcccgtacggcacggtccggtcctttcggtaccgttcggtcgggggcctaacgggggcccg

SEQ ID NO: 394981 - DNA, 649 bp, Homo sapiens
  misc_feature: GZ8MTXP02JFIQ5.17.25.C03.1.454.CMB.2.raw
  modified_base (414)..(414): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctacactggtgtcacagtcgtcttcacccatcccaccgggacacgaccttaccatcgaaccacgtaacctccctaccaataaaccacacgcctanactggagttgaggtacgcctagaccataccgtagaccgaaccgaccggtcccgttacttaacgtttaccgtggttcggacgtaacggaccgttacccgaacggtaccgttacccgggggttacgaaccggtcccggttaaccggggaccgtaaccgggggtcccgggttaaccccgtttttcgggtaacccgtttccggttaccggggggacccgtaacggggggtaacccccgg

SEQ ID NO: 394982 - DNA, 562 bp, Homo sapiens
  misc_feature: GZ8MTXP02JA8O4.17.25.C03.1.454.CMB.2.raw
  modified_base (210)..(210): a, c, t, g, unknown or other
  modified_base (316)..(316): a, c, t, g, unknown or other
  modified_base (323)..(323): a, c, t, g, unknown or other
  modified_base (399)..(399): a, c, t, g, unknown or other
  modified_base (404)..(404): a, c, t, g, unknown or other
  modified_base (496)..(496): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaggtctctgcaaggctctggattcacgtttacctctatagtatcaactgggtgcgccaggccgctggacaacgcctgagtggatgggatgggacaaccctanactggtntcacagtcgtctaccaccctactccgtccgggacacgtaccttacatcgaccacgacctcctacataaaccacacncctanatggacgttgaggacgcctagacctatcgtagacgacgaccggcctattacttacgtgtcgacgacgtccgtcccaacgtcgtcccgggtanacggcccgtacgggctacggtccggtcctttcggaccgtttcggcgggggtaccgacggggtcccg

SEQ ID NO: 394983 - DNA, 529 bp, Homo sapiens
  misc_feature: GZ8MTXP02H1MTN.17.25.C03.1.454.CMB.2.raw
  modified_base (366)..(366): a, c, t, g, unknown or other
  modified_base (406)..(406): a, c, t, g, unknown or other
  modified_base (442)..(442): a, c, t, g, unknown or other
  modified_base (450)..(450): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggcccgctggacaacgacctgagtggatgggatggggccgaaaccctaacactggtgtcacagtcgtcttcacccatcctccgggacngacttaccatgaccacgactccctacataaacacagccanatggattgagagcctgacatctgacgacacgccgtntacttacngtcgcgtagacgtcccagtacgtccggtgacgccgtaacggcagccggtcctttgaccgttcgtggggccaggggtccg

SEQ ID NO: 394984 - DNA, 688 bp, Homo sapiens
  misc_feature: GZ8MTXP02IE6W9.17.25.C03.1.454.CMB.2.raw
  modified_base (208)..(208): a, c, t, g, unknown or other
  modified_base (228)..(228): a, c, t, g, unknown or other
  modified_base (263)..(263): a, c, t, g, unknown or other
  modified_base (316)..(316): a, c, t, g, unknown or other
  modified_base (323)..(323): a, c, t, g, unknown or other
  modified_base (427)..(427): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagctgggcctnagtgagtctctgcagcttcnggattcacgtttacctcctatagtatcaactggtncgccaggccgctggacaacgacctggagtggatgggatggggcaaaccctaanactggtntcacagtcgtccttccacccatcctccgggacacgtacctttaaccgattcgaaccccaacgaaaccttccctaccaactaaaaccaccaacgtacccctaaanacgttacggggtaagtttagggaacgggaaacgtcccttaggaaaccctagttaccgttacgaacccgaaccgaacccggggtcccgttacctttaaatttaccgtggttacgacggaacgtaacgttcccccgtaacggacgtttccccggtaagggacggttacccccgtaacggggtcccaacgggtcccggggttaccctttttcggacccggttttccggttaccggggggaccccttaaaggggggtacccccgg

SEQ ID NO: 394985 - DNA, 647 bp, Homo sapiens
  misc_feature: GZ8MTXP02JB8UD.17.25.C03.1.454.CMB.2.raw
  modified_base (316)..(316): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttcgccgacagtcgacggtaacgttaaaacttatttaaatggtatcagacaagtaaaccgtaggaaaaccgccccaagtacccctcctgacttctctgggtcncatcccactcgtaggacggaagtcggtccctaccgtagtccggtagtccgaggtcggactaggtgactcgtggggacaggttacttacaattccacaacctactaccaccctactctacgaaccgaaccgtggaacgttattcggtacgacttaaacttcctaacgtacctagtaaccaaacgtaacgttacgttacctaccgttaccccgtcgtacgttaacgtttacgggaaccggtaaacgggtaaacgtaaaggtttacgaagtaaacgttaacgaaaaccgtacgtaggtcggacttacgaccctacctatttccgtattttaccc

SEQ ID NO: 394986 - DNA, 542 bp, Homo sapiens
  misc_feature: GZ8MTXP02H1U5M.17.25.C03.1.454.CMB.2.raw
  modified_base (273)..(273): a, c, t, g, unknown or other
  modified_base (325)..(325): a, c, t, g, unknown or other
  modified_base (364)..(364): a, c, t, g, unknown or other
  modified_base (408)..(408): a, c, t, g, unknown or other
  modified_base (421)..(421): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacgaaccctaanactggtgtcacgagtcgtcttcacccatccgccgggacngacttaccatgaccacgaactccctaccataaacacacgcctanatggagttgaggncctgacatctgacacgacgccgtctattactgtgcgagacgtacccacgtagtccggtgaacgccgtacggcacggtccggtcctttacggaccgtttcgtcgggggcctaaggggtcccg

SEQ ID NO: 394987 - DNA, 495 bp, Homo sapiens
  misc_feature: GZ8MTXP02FFSJC.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaacgccccagacctcctgatctctggtgcatccactctgcgaagtggctccatcgaggttccagtggcagtggatcgtgggacagatttcaatctcacatcaccactctgcaacctgaggatgtgcaatctactactgtcaacagagttacacgttcccctcgctactttggccgacggggaccaaagttgagatacaaacgactagtgctcgcacactctgtc

SEQ ID NO: 394988 - DNA, 595 bp, Homo sapiens
  misc_feature: GZ8MTXP02HOLM7.17.25.C03.1.454.CMB.2.raw
  modified_base (362)..(362): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacgttaaaacctatttaaattggtatcagcaagaaacctaggaaaacgccccagacctcctgatctctggtgcatccactctggcgaagtggccgtcccagtcgaggttcccagtggcaggtggatcgnggggacagtatttcaatctacaccatcacctactctcgaccaacctgacggtattgagtactaaattcttaactacttgtacaaacgtagtaacgttaccgtacgttcccctcgtaccttacgtttcgggacccggtaacggggaacccgtaaaggtttacgaacgtaactaccgaaaacgtaccgttaggtaacggtacgtacggaccaaccgtacttccgttacgtttccc

SEQ ID NO: 394989 - DNA, 597 bp, Homo sapiens
  misc_feature: GZ8MTXP02JP7DC.17.25.C03.1.454.CMB.2.raw
  modified_base (276)..(276): a, c, t, g, unknown or other
  modified_base (350)..(350): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaacnccccagacctcctgatctcgtggtgcatccactctgcgaagtgcgtccatcgaggttccagtggcagtggatcnggggacagtattcaatctacacccatccaaccactctcgacaaccgtggaacggtattgtcgactaaatcctaactactagtacaacgtagtacgttaaccgtacgttcccctcgtactaccgttttacggacccggtaacgggggaaccccttaaagggttcgaaacggtacttaaaccgaaaaccggtaacgttacggtaacgggacttaccggacctaaccctaacgtttccttcggtttaccc

SEQ ID NO: 394990 - DNA, 506 bp, Homo sapiens
  misc_feature: GZ8MTXP02FGO9D.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaagccccagacctcctgatctctggtgcatccactctgcgaagtggcgtcccatcgaggttccagtggcagtggatcgtggggacagatttcaatctcacatcaccactccgcaacctgaggtattgtgacaatctactactgtacaacagagttacagttcccctgctactttggccaggggaaccaaagttgagatacgaaacgactgtaggctcgacaccatctcgtcttac

SEQ ID NO: 394991 - DNA, 570 bp, Homo sapiens
  misc_feature: GZ8MTXP02HW5V4.17.25.C03.1.454.CMB.2.raw
  modified_base (279)..(279): a, c, t, g, unknown or other
  modified_base (305)..(305): a, c, t, g, unknown or other
  modified_base (359)..(359): a, c, t, g, unknown or other
  modified_base (414)..(414): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctcctgtctgcctcgtggtgggggtcagagtcaccatcacttgccggacaagtcacggtacttaaaactattaaattggtatcagcaagaaacctaggaaaacnccccagacctcctgatctcgtggtcncactccactctgacgaagtcggctacccatcggagttccagtgcagtggatcgngggacagtactttcaatctacaccatccaccactctgaccaacgtgaggtattgnactaatctaactactagtacaactagtaacgttacctaccgttcccctacgtacttacgtttacggaccgtaacggggtaaacctaaaggttacgaagtaactaaaccgaaaacgtaacgtggtcggactacgaccaactcgttacgttctttacc

SEQ ID NO: 394992 - DNA, 530 bp, Homo sapiens
  misc_feature: GZ8MTXP02GJBTM.17.25.C03.1.454.CMB.2.raw
  modified_base (253)..(253): a, c, t, g, unknown or other
  modified_base (273)..(273): a, c, t, g, unknown or other
  modified_base (320)..(320): a, c, t, g, unknown or other
  modified_base (357)..(357): a, c, t, g, unknown or other
  modified_base (392)..(392): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtncgccaggccgctggacacgacctgagtggatggatgggcaaccctanactggtgtcacagtcgtcttcacccatccgtcggacnggacttaccatcgaccacgaactcctacataaacncacgctacatggagttcgaggacgctagacatcgtagacgacgacggccttactacttacgtgtcgacgtagacgtcccaggactccggtagacgccgtacgctacgcggtcctttgacttgcggggccagggggacc

SEQ ID NO: 394993 - DNA, 538 bp, Homo sapiens
  misc_feature: GZ8MTXP02I3EDL.17.25.C03.1.454.CMB.2.raw
  modified_base (273)..(273): a, c, t, g, unknown or other
  modified_base (330)..(330): a, c, t, g, unknown or other
  modified_base (363)..(363): a, c, t, g, unknown or other
  modified_base (398)..(398): a, c, t, g, unknown or other
  modified_base (406)..(406): a, c, t, g, unknown or other
  modified_base (419)..(419): a, c, t, g, unknown or other
  modified_base (460)..(460): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacaaccctacactggtntcacagtcgtcttcacccatcccgtccgggacncgacttaccatcgaccacgaactccacataaaccncagcctanatcggattgagancctagacatctagaccgacgaccggtccgtactatttacgngtcgacgagacgtacccacggatccggtgacgccgtacggcacggcgtccttgacttcgtcggggacacggggtaccg

SEQ ID NO: 394994 - DNA, 577 bp, Homo sapiens
  misc_feature: GZ8MTXP02GY3OM.17.25.C03.1.454.CMB.2.raw
  modified_base (223)..(223): a, c, t, g, unknown or other
  modified_base (301)..(301): a, c, t, g, unknown or other
  modified_base (409)..(409): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganagtcacggacttaaaacctatttaaatggtatcagcaagaaacctggaaaacgccccaagacctcctgatctctggtncatccactctgacgtaagtcggcctccagtcgtaggttccaggtgctagtggactcgtgggacagtatttacaatctacacatacacactctgacaactgagattgtnactaatctaactacgtatacaaacagtaacgttacaccgtttcccctcgtacctacgttttcggaccgtaacgggggtaaacctaaaaggttacgaacggtaactaaccgaaaacgtaacgttaggtaacggacgtacggaccctaacctacttaccgtcgtttaccc

SEQ ID NO: 394995 - DNA, 538 bp, Homo sapiens
  misc_feature: GZ8MTXP02G33K2.17.25.C03.1.454.CMB.2.raw
  modified_base (335)..(335): a, c, t, g, unknown or other
  modified_base (367)..(367): a, c, t, g, unknown or other
  modified_base (425)..(425): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtggggtgcgccaggcccgctggacaacgacctggagtggatgggatgggacgaaccctacacgtggtntcacgagtcgtcctcacccatccgccgggacngacttacatcgaccacgactcctacaataaacacacgcctacatggagttagaggacncctagaccatcagacgacgaccggccgtactattactgtgcgagacgtcccacgactccggtagcgaccgtacggcacggccgtcgttcgcgttcggcgggccgagggtcccg

SEQ ID NO: 394996 - DNA, 543 bp, Homo sapiens
  misc_feature: GZ8MTXP02H69RI.17.25.C03.1.454.CMB.2.raw
  modified_base (272)..(272): a, c, t, g, unknown or other
  modified_base (363)..(363): a, c, t, g, unknown or other
  modified_base (426)..(426): a, c, t, g, unknown or other
  modified_base (475)..(475): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggagtgggatgggacgaaccctaacactggtgtcacagtcgtcttcacccatcctccgggacncgacttacatcgaaccacgaacctccctaccaataaacacacgacctaacatggagttgaggngctgacatctgacgacacgcgtactatacgtgtgcgagacgtcccaagngtaccggtgacgcccgtacggcacggccggtccttttaggaccttcggtcgggggaccaaggggcccg

SEQ ID NO: 394997 - DNA, 560 bp, Homo sapiens
  misc_feature: GZ8MTXP02IV2DT.17.25.C03.1.454.CMB.2.raw
  modified_base (268)..(268): a, c, t, g, unknown or other
  modified_base (315)..(315): a, c, t, g, unknown or other
  modified_base (322)..(322): a, c, t, g, unknown or other
  modified_base (358)..(358): a, c, t, g, unknown or other
  modified_base (395)..(395): a, c, t, g, unknown or other
  modified_base (403)..(403): a, c, t, g, unknown or other
  modified_base (414)..(414): a, c, t, g, unknown or other
  modified_base (440)..(440): a, c, t, g, unknown or other
  modified_base (448)..(448): a, c, t, g, unknown or other
  modified_base (481)..(481): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaggtctctgcaaggcttctggattcacgtttacctcctatagtatcaactggtncgccaggccgctggacacgcctgagtggatggatgggacaaccctanactggtntcacgagtcgtcttccacccatcccgtaccgggacngtaccttaccatacgaccacgactcctacaataaacncagcctanatggatgaganctagacatcagaccacgaccggcctntattacgnggtgacgagaccgtcccagtacgtcccgggtanacggtcccgtagggacccagggtcccgggttaccctttggaacccgtttcggtacgggggacccctaagggggtccccg

SEQ ID NO: 394998 - DNA, 720 bp, Homo sapiens
  misc_feature: GZ8MTXP02HWN9Y.17.25.C03.1.454.CMB.2.raw
  modified_base (210)..(210): a, c, t, g, unknown or other
  modified_base (219)..(219): a, c, t, g, unknown or other
  modified_base (231)..(231): a, c, t, g, unknown or other
  modified_base (264)..(264): a, c, t, g, unknown or other
  modified_base (314)..(314): a, c, t, g, unknown or other
  modified_base (321)..(321): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaggtntctgcaggctcnggattcacgttacctctatagtatcaactggtncgccaggccgctggacaacgactgagtggatgggatgggacaaccctaanactggtntcacgagttcgtctttaccaccctaacttcctacccggggaacacgggtaacctttaacccaagttaccgaaacccgtaaccggaaaaccttcccctaacctaaacttaaaaccacctaacgacccttaaacctaagttacggggtaagtttacggaaagggtacggacccttaggacctaaagttaccgttaggaacccgtaaccgacccgggtacccgttacgttaaactttaaccgtggttacgacggaacggtacgttaccccgaaaccggtacgttaccccggggtaggtaaccggaccccggttaaccgggccgaaaccgggtcccgggttaccgttttacggtaacccggttttccggtaccggggggtacccgtaaacgggggacccccgg

SEQ ID NO: 394999 - DNA, 516 bp, Homo sapiens
  misc_feature: GZ8MTXP02IBYXU.17.25.C03.1.454.CMB.2.raw
  modified_base (435)..(435): a, c, t, g, unknown or other
tcagcgtagactagcacgaccggtgctcgatttagtagtgtagatttgggtttggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatggggcgaacctacactggtgtcacagtgtcttcacccatccctccgggacagacttaccatcgaccacgaactcctaccataaacacacgcctacatgagttgaggancctgacatctgacgacacggccgtctattactgtgcgacgacgtcccacgactccggtgacgcctacggcacggcggttcc

SEQ ID NO: 395000 - DNA, 545 bp, Homo sapiens
  misc_feature: GZ8MTXP02HLYHP.17.25.C03.1.454.CMB.2.raw
  modified_base (367)..(367): a, c, t, g, unknown or other
  modified_base (499)..(499): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgcctgagtggatgggatggggcaaaccctaacacgtggtgtcactagtcgtccttcacccatccctccgggacngtacttaccatcgaccacgaacctcccaccaataaaaccacacgaccctacaacgtggaagttgaggacgcctagacatctagacgacgacggccgttactattacgtgtgcgagacgtcccacgctccggngtacgcgtacggcaggcgtcttcgacttcgacggggccagggtccg

SEQ ID NO: 395001 - DNA, 601 bp, Homo sapiens
  misc_feature: GZ8MTXP02IUSYP.17.25.C03.1.454.CMB.2.raw
  modified_base (273)..(273): a, c, t, g, unknown or other
  modified_base (284)..(284): a, c, t, g, unknown or other
  modified_base (537)..(537): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacacgacctgagtggatgggatgggacgaaaccctacacgtggtcgtcactagtcgtccttcaccctatcccgtaccgggacacgtaccttaaccagttaccgaaccctaacgaaaccttccctaccaaataaaaccacaacgacctaacatgggagttacgaaggacgcctagacatcctagaccgacgaccgggtccctattaacttacgtgtagacgtagaccgtcccgaacgtacgtcccgggtanacgcccgtacggccaggtccggtcctttacggacgtttccggcgggggacctacgggggacccg

SEQ ID NO: 395002 - DNA, 540 bp, Homo sapiens
  misc_feature: GZ8MTXP02JEEMX.17.25.C03.1.454.CMB.2.raw
  modified_base (274)..(274): a, c, t, g, unknown or other
  modified_base (349)..(349): a, c, t, g, unknown or other
  modified_base (398)..(398): a, c, t, g, unknown or other
  modified_base (441)..(441): a, c, t, g, unknown or other
tcagcgtagactagcacgaccggtgctcgatttagtagtgtagatttgggtttgggcgagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggacgttaaactattaaattggtatcagcagaaacctggaaaacnccccagacctcctgatctctggtgcactccactctgcgaagtggccgtcccatcgaggttcagtgcagtgatcgngggacagattcaatctcaccatccaccactctgacaacctgagtattgngacaatctactactgtacaacagtacgttacaccgtttccccncgtacttacgtttcggaccgtacgggggaacctaaaggttgaacgacttaaccgaaaacgtaacgtggtcggacttcggacctaccgtacttcgttacg

SEQ ID NO: 395003 - DNA, 622 bp, Homo sapiens
  misc_feature: GZ8MTXP02IIM7U.17.25.C03.1.454.CMB.2.raw
  modified_base (305)..(305): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggtacgttaaaacctaatttaaattggtatcagacagaaaacctggaaaacgccccaagacctctgatctctggtncatccatctgacgagtgctccatcgagttcagtgcagtgatcgtgggacagtacttcaatctacaccatcaccctactctcacaacctgagtattgacgctaaattcctaaacttaccgtagtacccaaacgtacggtaacgttaaccgtaccgtttccccctacggttaccttaaccggtttttcggggaccccggtaaacggggtaaaacccgtaaaaggttcgtaaaacggaacctttaccgaaaaacccggttattacgggtaacgtaccgtaccggtacctaaaccccgttattaccgtttcggtttacccc

SEQ ID NO: 395004 - DNA, 575 bp, Homo sapiens
  misc_feature: GZ8MTXP02GVO69.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgccggacaagtcacggtacgttaaaacctatttaaattggtatcagcaagaaacctggaaaacgccccagaccctctgatctctggtgcatcccatctgacgaagtcggctcccatcggtagttccagtggacaggtgatcgtggggacagtatttcaatctacaccatccaccactctagcaacctgagtattgcactaatctatactgtacaaagtacgagttacaccggttcccctcgtaccttaacgttttcggacccggtaacggggaaacctaaaggttacggaaagtaaactaacgaaaaccgtacttagggtaacggactacggacctacgtacttaccgttagtttccc

SEQ ID NO: 395005 - DNA, 565 bp, Homo sapiens
  misc_feature: GZ8MTXP02HDRNF.17.25.C03.1.454.CMB.2.raw
  modified_base (231)..(231): a, c, t, g, unknown or other
  modified_base (256)..(256): a, c, t, g, unknown or other
  modified_base (272)..(272): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttcnggattcacgtttaccncctatagtatcaactgggtgcgccaggccgctggacaacgacctgagtggagtgggatggggacgaaccctaacgacgtggtcgtcacgagttgtccttccgaccctactcccgtccggggacacgtaccttaccatcgaaccacgaactccctacaactaaacacacgcctaacatcggagttggaggactcctagactatcgtacgaccgacgaccgggcctacttacttacctggtcgacgtacgacgtcccagtacgtcccggtgaacgcctacggcacggtcgttccg

SEQ ID NO: 395006 - DNA, 546 bp, Homo sapiens
  misc_feature: GZ8MTXP02F2GA6.17.25.C03.1.454.CMB.2.raw
  modified_base (277)..(277): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacttaaaacctatttaaatggtatcagcaagaaacctggaaaacnccccagaccctcctgactctctggtgcatcccactctgacgaagtggcctccagtcgaggttccaggtgcaggtgatcgtgggacagtatttcaatctacacatcaccactctgacaacctgagtattgagactaatctaactactgtacaaatagtaacgttactacgttcccctcgtcctacgtttcggaccgtaacggggaacctaaaggttgaaagtacgtaacgaaaacgacgtagtaagtctcgacacctactctcgtttacc

SEQ ID NO: 395007 - DNA, 641 bp, Homo sapiens
  misc_feature: GZ8MTXP02GSZLV.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatggggatggggaccgaaacccctaacgacgtggtgtcactaggtcgtccttccaccctatcccgtaccgggacacgtaccttacatcgacccacgaacctccctaccaataaaccacacgccctaacagtcggagttggaaggacgcctagacctaagtcgtaggaaccgaccgaccggtcccgttacttaacgtttaccgtggtacggaccggaaggtaaccgttcccccgaacggtacgttacccggggtagaaccggtaccccgtaacgggccaacgggtcccggtttccgtttacggacccgtttcgggacgggggcccgtaagggggtccccg

SEQ ID NO: 395008 - DNA, 636 bp, Homo sapiens
  misc_feature: GZ8MTXP02JWQOV.17.25.C03.1.454.CMB.2.raw
  modified_base (211)..(211): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctnagtgaggtctcctgcaaggtcttcgtggtattctacgtttacctctatagtatcaacgttgggtgcgccgacggccgcgtggaaccaacgctgagtggatgggagtgggacctaaaccctaacacgtggtcgtacacgtagtccgtaccttccaccctactcccgaccgggactacgtaccttaacacgtcgaacccaacgtaacctccctaccaaactaaaccacacgtaccctaacagtcgggagttggaacggacgtcctaggactaattcgacgacgacgaaccggtcctacttattacgtgtcgacgtacgaccgtcccgaacgtcggttcccggtagacccggtacccgtacgggccgtacgggtcccggttaccgtttacggaccgtttcggccgggggtacccgacggggtaccccg

SEQ ID NO: 395009 - DNA, 606 bp, Homo sapiens
  misc_feature: GZ8MTXP02IMXVN.17.25.C03.1.454.CMB.2.raw
  modified_base (270)..(270): a, c, t, g, unknown or other
  modified_base (281)..(281): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactggtncgccaggccgntggaccaacgacctggagtggatgggatggggaccaaaccctaacacgtggtgtcacgagtgtccttccacccctatcccgtaccggggacacggtaccttaccagttccgacccacgaacctccctaccaataaaccacacgacctaacagtggagttgaggtacgccgtagactatctagaccgaccgaccggcccgttacttacttacgtggtacgacgtagacgtaccccgacggtacgtcccgggtagaccgtcccgtaacggcacggccggttcccgtttaggaccctttcggtaccgggggtccgaacggggtacccg

SEQ ID NO: 395010 - DNA, 537 bp, Homo sapiens
  misc_feature: GZ8MTXP02GXA0B.17.25.C03.1.454.CMB.2.raw
  modified_base (273)..(273): a, c, t, g, unknown or other
  modified_base (334)..(334): a, c, t, g, unknown or other
  modified_base (339)..(339): a, c, t, g, unknown or other
  modified_base (365)..(365): a, c, t, g, unknown or other
  modified_base (411)..(411): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggaccaacgacctgagtggatgggatggggcgaaaccctaacactggtntcacngtcgtcttcacccatccctcgggacncgacttacatcgaccacgactccctacaataaaccacagaccctanactggagttggaaggagcctagacatctgacacacggcctctattactgtgcgagcgtacccagtactcggtgacgcccgtacggcacggcgtccttttgaccgttcggtcggggccagggtcccg

SEQ ID NO: 395011 - DNA, 658 bp, Homo sapiens
  misc_feature: GZ8MTXP02II4LX.17.25.C03.1.454.CMB.2.raw
  modified_base (272)..(272): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtncgccaggccgctggacaacgacctgagtggagtgggatggggaccgaaaccctaacgacgtggtcgtcacagttcgtccttaccaccctatcccgtaccggggacacgtaccttaaccgatacgaacccacgaaacctccctaccaataaaaccacacgaccctaacagttagggaagtttggaacgggacgcccttaggaacctattaccgtaggaacccgacgaacccggggtcccttacttaagtttaccgtggtacgacgaacggaacgttcccccgaacggtaccgtcccggtagaaaccggtccccgtaaaccgggctacgggcccggttacccttttacggaccgtttccggtccgggggacccgtaacgggggtcccg

SEQ ID NO: 395012 - DNA, 620 bp, Homo sapiens
  misc_feature: GZ8MTXP02J37KI.17.25.C03.1.454.CMB.2.raw
  modified_base (286)..(286): a, c, t, g, unknown or other
  modified_base (453)..(453): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccatccctcctgtctgcctcgtggtgggggtcagagtcaccatcacttgccgacagtcaacggtacttaaaacctatttaaatggtatcagcaaacgaaacctagggaaaacccncccacgtcctctgtactcgtcgtggtcactactcctactcgtcgacggtacgtcggcctaccgtagtcggtacggttccgaggtcgacgtaggtcgacgttcggtggactaacgttacttacactcctaccaccactacccacctactcgacgactacgtgtagttntacgacactacttacctactacgtcgtaacaacgtacgtaccgttacctacccgttcccgtacgtacgttacggtacgggaccgtaaacggtaactaagtacgaaactaacgtaacgtaaaccgtcgtcggaacgtacctacgtaccctacgtcttccgttacttcc

SEQ ID NO: 395013 - DNA, 426 bp, Homo sapiens
  misc_feature: GZ8MTXP02GNI5Y.17.25.C03.1.454.CMB.2.raw
  modified_base (413)..(413): a, c, t, g, unknown or other
  modified_base (419)..(426): a, c, t, g, unknown or other
tcagcgtagactagcacgaccggtgctcgatttagtagtgtagatttgggtttgggagggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgagattgtgcaatctactactgtcaacagagttacacgttccccctcgcctacgttttggccaggggacccaaagttgagatacaaacgactgtgctgccaccatctgtcttcactcctcccgcatctgactagtctacgctgagcgggctggcaaggcncatagnnnnnnnn

SEQ ID NO: 395014 - DNA, 589 bp, Homo sapiens
  misc_feature: GZ8MTXP02GLIAN.17.25.C03.1.454.CMB.2.raw
  modified_base (392)..(392): a, c, t, g, unknown or other
  modified_base (438)..(438): a, c, t, g, unknown or other
  modified_base (498)..(498): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctgagtgaggtctcctgcgaaggtcttcgtggtattctacgtttacctctaatacgtatcaacgtggtcgcgccacggccgcgtacggaacaacggcctggaggtggagtggagtcgggacctaaaccctagacgttggtactacgacgtagttccgtaccttccacctcgtccgaccgganacgtactacatacacacactccacaactaaacacacgctaactagnggtagttagagtacgcctagacactcgtacgaccgacgtaccggcccttatacgttacgngtcgacgtagccgtacccgaggtacctcgggtacacggtccgacggcacggtcggtcccttaggtaccttcgggcggaccgtacggcccgg

SEQ ID NO: 395015 - DNA, 603 bp, Homo sapiens
  misc_feature: GZ8MTXP02FMQE9.17.25.C03.1.454.CMB.2.raw
  modified_base (377)..(377): a, c, t, g, unknown or other
  modified_base (416)..(416): a, c, t, g, unknown or other
  modified_base (422)..(422): a, c, t, g, unknown or other
  modified_base (476)..(476): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggcccgctggacaacgcctgagtggatggggatggggaccaaacccctaacacgttggtgtacacgtagtcgtccttccacccatccctaccgggacngaccttacatcgacccacgactccctacaataaacacanacctanatggagtgagacgcctagacatctagaccgtacgacgcccgttactaattacgnggtgacgaagaccgtacccgacgtacgttcccgggtagaaccggtccccgtaacggggcctaacgggtcccgggtcccttttacggggacctttaccggggcgggggaccccgtagggggtacccgg

SEQ ID NO: 395016 - DNA, 536 bp, Homo sapiens
  misc_feature: GZ8MTXP02FHK9E.17.25.C03.1.454.CMB.2.raw
  modified_base (301)..(301): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaatggtatcagcagaaacctggaaaacgccccagacctcctgatctctggtncatccactctgcgagtggcgtcccatcgaggttccagtggcagtggatcgtgggacagtatttcaattctacaccatcacccactctgacaacctgaggtattgtgcaatctactactgtacaacagtacgttactacgttcccctcgcctacgtttcggaccgtaacggggtaaccaaaggttacgaagtaactacaaaacgaactaggtggctacgaccaccactctcgttcc

SEQ ID NO: 395017 - DNA, 536 bp, Homo sapiens
  misc_feature: GZ8MTXP02HUKFN.17.25.C03.1.454.CMB.2.raw
  modified_base (230)..(230): a, c, t, g, unknown or other
  modified_base (287)..(287): a, c, t, g, unknown or other
  modified_base (297)..(297): a, c, t, g, unknown or other
  modified_base (431)..(431): a, c, t, g, unknown or other
  modified_base (456)..(456): a, c, t, g, unknown or other
  modified_base (507)..(507): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctggggcctnagtgaaggtctcctgcaggctctggatcacgtttacctctatagtatcaacgtggtncgccaggccnctggacaacgacctgagtggatgggatgggacaaaccctacacgtggtcgtacagtacgtgttccgttcacccctatccccgtccggggacagtacctaccatcgacacgactcctacaataaacacacgccanatggagttgagacgctagacattcngacacgacggccctatactacgtgtcgcgagcgtacccaacgtgtcccggngtaaccgccgacgcgtacgccggtttccg

SEQ ID NO: 395018 - DNA, 555 bp, Homo sapiens
  misc_feature: GZ8MTXP02I7OMC.17.25.C03.1.454.CMB.2.raw
  modified_base (301)..(301): a, c, t, g, unknown or other
  modified_base (462)..(462): a, c, t, g, unknown or other
  modified_base (549)..(549): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccgacaagtcacggacgttaaaacctattaaattggtatcagcaagaaacctggaaaacgccccagacctcctgatctcgtggtncatccactctgcgaagtggccgtcccatcggtaggttccaggtggctaggtggactcgtggggacagtatttcaattctaccaccataccacctactctgacaacctgaggtatgtagactatctaatctagtacaacgagtacgttactaccgttccccncgtccttacgtttcggaccgtaacggggaactaaagttgaacgaactacgaaaacgtactaggtcggactacgacctactactactnttaccc

SEQ ID NO: 395019 - DNA, 608 bp, Homo sapiens
  misc_feature: GZ8MTXP02I61CS.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttcgtggtattctacgtttacctctatagtatcaacgtggtgcgccgaggcccgcgtggaccaacgacctggaggtggagtggggagtggggaccgtaaacccctacgacgttggtgtccacgtaggtcgtcttaccaccctactcccgtacccgggacacgtaccttaccatacgaccaacgacctccctacaaataaaccacacgacctaacagtcggagttgagacgcctagacctatcgtagaccgacgaccggtcctagttataccgtgtcggacgaagaccgtacccaggacgttcccgggagaccgtcccgtacggccaggtccgttacctttcggaccgtttcggcgggggtacccaggggtcccg

SEQ ID NO: 395020 - DNA, 548 bp, Homo sapiens
  misc_feature: GZ8MTXP02JHIIE.17.25.C03.1.454.CMB.2.raw
  modified_base (244)..(244): a, c, t, g, unknown or other
  modified_base (275)..(275): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacttaaaacctnttaaatggtatcagcagaaacctggaaaacnccccagaccctctgatctctggtgcactccactctgacgaagtggccgtcccatcgagttccagtgcagtggatcgtgggacagtatttcaatctacacatccaccactctcgacaaaccgtgaggtattgtcgactaatctaactactgacaacagtacgttaccacgttcccctcgaccttacgtttcggaccgtaacgggggtaaacctaaaggttcgaaggtactaacgaaacgtaactggtaacggctacgccaactctctcgtttcc

SEQ ID NO: 395021 - DNA, 616 bp, Homo sapiens
  misc_feature: GZ8MTXP02HBLS3.17.25.C03.1.454.CMB.2.raw
  modified_base (356)..(356): a, c, t, g, unknown or other
  modified_base (447)..(447): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtgggtgcgccaggccgcgtggacaacgacctgagtggatgggatgggccgaacctacacgtggtcgtcanagttgtccttcaccctatcccgtcgggacacgaccttaccagtccgaacccacgtaactccctacgaaactaaaccacgacgtaccctaanagtacgggtagttaggagggactccgtagaacctagttccgacggaacgaccgtaccgggtcctactttaacgtacccgtgggtacgaaccggtacggtacccgtacccgtacgtaccggttcggaacgtacccggtaccgaccgggtcgaccggggttcccgtttcgg

SEQ ID NO: 395022 - DNA, 533 bp, Homo sapiens
  misc_feature: GZ8MTXP02JAEIE.17.25.C03.1.454.CMB.2.raw
  modified_base (274)..(274): a, c, t, g, unknown or other
  modified_base (329)..(329): a, c, t, g, unknown or other
  modified_base (337)..(337): a, c, t, g, unknown or other
  modified_base (452)..(452): a, c, t, g, unknown or other
  modified_base (459)..(459): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttcgtggattcacgtttacctctatagtatcaactgggtncgaccaggtccgctggaacaacgacctggagtggatgggatgggacaaaccctanactgggtntcactagtcgtctcacccatccgtccgggacagaccttacgatcgaaccacgaactccctacaataaacacagcctacatggattgagagcctagacatcagacgacacggcctntattacngtgacgtgacgtcccgagacttccgggagacgccgacgcgagccggtctttagcgttgcgggccgaggggtccg

SEQ ID NO: 395023 - DNA, 537 bp, Homo sapiens
  misc_feature: GZ8MTXP02IYCW1.17.25.C03.1.454.CMB.2.raw
  modified_base (318)..(318): a, c, t, g, unknown or other
  modified_base (355)..(355): a, c, t, g, unknown or other
  modified_base (407)..(407): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctctgcaaggcttctggattcacgtttacctcctatagtatcaactgggtgcgcctggccgctggacacgacctgagtggatgggatgggcaaccctanactggtgtcacagtgtcttcacccatcctccgggacngacttacatgaccagaactctaccataaacacagctacatcggagttgagancctgacatctgaccgacgaccggcccgtactagttactggtcgacgagacgtcccagtactccgggtagacgcctaacggcgaacggccggtaccctttggaccttcgtacgggggcccaaggggtcccg

SEQ ID NO: 395024 - DNA, 578 bp, Homo sapiens
  misc_feature: GZ8MTXP02GTKWZ.17.25.C03.1.454.CMB.2.raw
  modified_base (298)..(298): a, c, t, g, unknown or other
  modified_base (407)..(407): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgaccagtctccatcctccctgtctgcctctggtgggggtcagagtcaccatcacttgccggacagtcacggacttaaacctatttaaatggtatcagcaagaaactggaaaacgccccagacctcctgactctctggtncatccactctgcgaagtcggctccatcgagttccagtgcaggtgatcgtggggacagtatttacaactctacacactaccacctactctcacctaactgaagtattganactaaactcttaaactactgtacaaagtaagtacgttactaccgttcccctacgtaccgtttacgtttacggaccgtaaacgggggtaacctaaaaggtttacgaaagtaacttaaccgaaaaccgtaacgttggaacggtactacggaccaactacttacgttactttcc

SEQ ID NO: 395025 - DNA, 585 bp, Homo sapiens
  misc_feature: GZ8MTXP02JJE14.17.25.C03.1.454.CMB.2.raw
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaggtctcctgcaaggcttctggattcacgtttacctcctatagtatcaactgggtgcgccaggccgctggacacgcctgagtggagtgggagtgggaccgtaaccctaacgacgtggtgtcacgagttcgtccttccaccctattcccgaccggggacacgaccttacccatacgacccacgaacctccctaccaactaaacacacgaccctaacagtacggagttggacgggacgccgttagactatccgtagaccgacgaccggcgttacttacttacgtggtacgcggtagaccgtacccgacgtacgtcccggtgacgacccgtacggctacggtcggtttacccg

SEQ ID NO: 395026 - DNA, 526 bp, Homo sapiens
  misc_feature: GZ8MTXP02IZ785.17.25.C03.1.454.CMB.2.raw
  modified_base (273)..(273): a, c, t, g, unknown or other
  modified_base (329)..(329): a, c, t, g, unknown or other
  modified_base (360)..(360): a, c, t, g, unknown or other
  modified_base (419)..(419): a, c, t, g, unknown or other
  modified_base (430)..(430): a, c, t, g, unknown or other
  modified_base (482)..(482): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaacgtgggtncgccaggccgctggacaacgcctgagtggatgggatgggcaaaccctagactggtntcacagtcgtcttcaccatcctaccgggacncgacttaccatcgaccacgaaactccaccaataaacacagcctacatggacgttgagancctagacatcngacgacacggccgtctaattactgtcgcgagacgtccccaagacgtcccggnacgcctacggcagccggtcttgacctgtcggggccaggggtacc

SEQ ID NO: 395027 - DNA, 514 bp, Homo sapiens
  misc_feature: GZ8MTXP02JNAQ8.17.25.C03.1.454.CMB.2.raw
  modified_base (257)..(257): a, c, t, g, unknown or other
  modified_base (350)..(350): a, c, t, g, unknown or other
  modified_base (387)..(387): a, c, t, g, unknown or other
  modified_base (431)..(431): a, c, t, g, unknown or other
  modified_base (462)..(462): a, c, t, g, unknown or other
  modified_base (466)..(466): a, c, t, g, unknown or other
  modified_base (489)..(489): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaaggaagcctggggcctcagtgaaggtctcctgcaaggcttcnggattcacgtttacctcctatagtatcaactgggtgcgccaggccgctggacacgacctgagtggatgggatggggcgaacctaacactggtntcacagtgtcttcaccatcctcgggacagacttaccntcgaccacgactcctcataaacacagcctacatggagttgaggnctagacatctgacgacacgggctctattacngtcncgagtcgtacccagacttccggngaacgcctacggcacggcggttccg

SEQ ID NO: 395028 - DNA, 812 bp, Homo sapiens
  misc_feature: GZ8MTXP02GYPX7.17.25.C03.1.454.CMB.2.raw
  modified_base (273)..(273): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattccacgtttacctctatagtatcaacgtgggtncgccaggccgctggaccaacgcctgacgtggagtggatgggaccaaccctagacgtggtcgtcacgagtcgtacctcaccctattcccgtaccgggactacggtaccttaaccgattccgaaccctaacggtaaaccttccctaaccgaaactaaaacccgacgaacggttaccctaaacgtacgttacggggaacgtttacggaacgggtaccgtcccgtttaaagggacccttaaacgtccggttacggaaaccccggtaaccggtaacccggggttccccgtttaacgttaaccgtttaaccgggtacgggttaccgggtaaccggtaaaacgggtaccccgggtttaaccccccgaaaggggttaaacccggtttccccgggggtttaaacggaaacccgggttcccccgggttaaaaccggggtccgtaaaacccgggggtttcccggtttaaacccccggtttttacggggtaaccccggtttttaccgggacccgggggggtaaccccttaacggggggtttaaccccccgg

SEQ ID NO: 395029 - DNA, 544 bp, Homo sapiens
  misc_feature: GZ8MTXP02JZKNH.17.25.C03.1.454.CMB.2.raw
  modified_base (273)..(273): a, c, t, g, unknown or other
  modified_base (282)..(282): a, c, t, g, unknown or other
  modified_base (320)..(320): a, c, t, g, unknown or other
  modified_base (327)..(327): a, c, t, g, unknown or other
  modified_base (399)..(399): a, c, t, g, unknown or other
  modified_base (410)..(410): a, c, t, g, unknown or other
  modified_base (421)..(421): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccntggacaacgcctgagtggatgggatcgggcaaccctanactggtntcacagtcgtcttcacccatcccgtccgggacacgaccttaccatcgaccacgaaacctccaccataaaccncacgcctacanggagttgagancctagacatctagacgacacggccgtactatactgtcgacgagcgtacccacgtactccggtagacgaccgtacggcacggccgtccgtttcggacgttcggtcggggcccgtaaggggcccg

SEQ ID NO: 395030 - DNA, 563 bp, Homo sapiens
  misc_feature: GZ8MTXP02JZD6L.17.25.C03.1.454.CMB.2.raw
  modified_base (275)..(275): a, c, t, g, unknown or other
  modified_base (299)..(299): a, c, t, g, unknown or other
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatgacccagtctccatcctcctgtctgcctctggtgggggtcagagtcaccatcacttgccggacagtcacggacttaaaactatttaaatggtatcagcaagaaacctggaaaacnccccagacctctgactctctggtncatccatctggacgtaagtcggactccagtcggtaggttccaggtcggactaggtggatcgtgggacagtactttcaatctacacactacacctactctgactaccgtgaggtattgtacgactaatctaactacgtagtacaaacgagtacgttactaccgttcccgtacgtcttaccgtttcggaccgtaacggggtaaacctaaggttacgaagtactaacgaaacgtactaggtcgactcgacactacttcgtacgttcc

SEQ ID NO: 395031 - DNA, 568 bp, Homo sapiens
  misc_feature: GZ8MTXP02HJ4MO.17.25.C03.1.454.CMB.2.raw
  modified_base (368)..(368): a, c, t, g, unknown or other
  modified_base (373)..(373): a, c, t, g, unknown or other
  modified_base (445)..(445): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaacctacacgtggtgtcacgagttgtctcaccntcccnccgggacagtacttaccatcgaccacgaactcctaccaataaaccacacgacctacatcggtagttgagganccgtagactatctaggacgaccgacggtccgtacttacttacgtggtacgacggacgtacgtcccgaacggtacgttccggggtcgacggtacccgtaacgggcctacgggtcccggtttccg

SEQ ID NO: 395032 - DNA, 755 bp, Homo sapiens
  misc_feature: GZ8MTXP02JM0VM.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcacatcacttgccgacagtcacggtacttaaacctattaaattggtatcagcaagaaacctaggaaaacgccccagaccctcctgactccgtctgggtcgctactacccactcgtacggacggtaacggtcgggtcccttaccccaagttccggtaaggtttccccgaggggttacggccgtaagggttcggggtaacttcgggtacgggggaacctaaagggttaacctttttaccaaattcccgttacccaaaccctaaccttacccgaaacccctaacccgtaccccggaaccctaaacccgttaggaacggtaagtttcgtacgaacctaaccttacttaaccttaacttacggttaaccaaccgtaagggttaacttaacccgtaccgtttacccccgtcgtaccgttaccggttttacggggacccggtaaaacgggggtaaccctaaaaggttacggaaacgtacgttaaacgaaaaccggtaacgtcgggttacgaaccgtacggtacctacccgtaacttccgttacgtttcctttaacccg

SEQ ID NO: 395033 - DNA, 756 bp, Homo sapiens
  misc_feature: GZ8MTXP02IOPPN.17.25.C03.1.454.CMB.2.raw
  modified_base (270)..(270): a, c, t, g, unknown or other
  modified_base (280)..(280): a, c, t, g, unknown or other
  modified_base (323)..(323): a, c, t, g, unknown or other
  modified_base (327)..(327): a, c, t, g, unknown or other
tcagcgtagactagcacgaccggtgctcgatttagtagtgtagatttgggtttgggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcagtgaaggtctctgcaaggcttctggattcacgtttacctctatagtatcaacgtggtncgccaggccncgtggacacgctgagtggatggatggccaaccctagcgtggtncagngtcgtcctcacctagtccgtaccgggacacggtaccttacccgagtaccgaaccccgtaacggtaaaccttcccgtaacccgtaaattaaaacccgacgtaaccggtacccttaaacgtacggttacggggaacgttttacgggaaacgggttaccgtcccgttagggtaaaccctacggttaccgtaacggaacccggtaaccggtaccccggggttacccgttacttaaccggtttaccggtacggtaccggtaccggtaaacggtacccgttacccccggaaaggtttaccggtaccccggggttagaacccggttaccccggtttaaaccggggcccgttaaacggggttccccggttacccgttttacggggaccccgttttacggggaccgggggtaacccgtaacgggggtttaacccccgg

SEQ ID NO: 395034 - DNA, 555 bp, Homo sapiens
  misc_feature: GZ8MTXP02IWL1P.17.25.C03.1.454.CMB.2.raw
  modified_base (220)..(220): a, c, t, g, unknown or other
  modified_base (279)..(279): a, c, t, g, unknown or other
  modified_base (291)..(291): a, c, t, g, unknown or other
  modified_base (400)..(400): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcacatcacttgccganagtcacgcttaaaactattaatggtatcagcagaaacctgaaaacgccccagacttccngatctctgggtncatcccactctgacgaagtggccgttcccatcggagttccgagtggacaggtggatcgtggggacagtatttcaatctcacatcaccactctgcaacctgaggtattgngactaaatcctaacttactagttaccaacgtagtaacgttactaccggtttcccctacgtccttacgttttcggacccgtaacggggaaccctaaaaggttacgtaagtaactacgaaaacgtacgtgtaagcgtcacacctactctacgtttcc

SEQ ID NO: 395035 - DNA, 543 bp, Homo sapiens
  misc_feature: GZ8MTXP02GEGIX.17.25.C03.1.454.CMB.2.raw
  modified_base (368)..(368): a, c, t, g, unknown or other
  modified_base (405)..(405): a, c, t, g, unknown or other
  modified_base (414)..(414): a, c, t, g, unknown or other
  modified_base (438)..(438): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggacgaaccctaacacgtggtgtcacagtcgtcttccacccatccctccgggacngacttacatcgaccacgaacctcctaccaataaaccncagccctanatggagttgaggagcctgacatcngacgacacggcctatattactgtgcgagacgtcccagtacgtccggtagacgcctacgggcacggtccgtcctttacggaccgtttcggcggggcctaggggccg

SEQ ID NO: 395036 - DNA, 553 bp, Homo sapiens
  misc_feature: GZ8MTXP02GK1H8.17.25.C03.1.454.CMB.2.raw
  modified_base (328)..(328): a, c, t, g, unknown or other
  modified_base (408)..(408): a, c, t, g, unknown or other
  modified_base (429)..(429): a, c, t, g, unknown or other
  modified_base (440)..(440): a, c, t, g, unknown or other
  modified_base (482)..(482): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaacgtgggtgcgccaggccgctggacaacgacctgagtggatgggatggggaccaaccctaanacgtggtgtcacgagtcgtccttccaccccatcccgtccgggacacgacttaccatcgaccacgaactcctacataaacncagctacatggagtgaggacncctagacatcngacgacacggccgtctattactgtgcgagacgtcccaacgtntcccgggtgaccgtccgtaacggcacggcggtcccgtttaggacctttcggcgggggcctaggggacccgg

SEQ ID NO: 395037 - DNA, 606 bp, Homo sapiens
  misc_feature: GZ8MTXP02IQUT7.17.25.C03.1.454.CMB.2.raw
  modified_base (280)..(280): a, c, t, g, unknown or other
  modified_base (304)..(304): a, c, t, g, unknown or other
  modified_base (313)..(313): a, c, t, g, unknown or other
  modified_base (355)..(355): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacgttaaaacctatttaaattggtatcagcagaaacctaggaaaacnccccagaccctctgatctctggtncatccatcngcgaagtgccgtccagtcgaggttccagtgcaggtggatcgngggacagtactttcaatctacaccatccaccactctgacctaaccgtggaagtacttgcgactaaacttccttaactacgttagtaaccaaacgtacggttaacgttaccgtaaccgtttcccccgtcgtacctttaacgtttcggggaacccggtaacggggtaaacccttaaaaggttcgaaacgtaactaccgtaaaaacgtacgttaggtcggtacttacggacctaacctacttcgttacgtttcc

SEQ ID NO: 395038 - DNA, 634 bp, Homo sapiens
  misc_feature: GZ8MTXP02IYD8C.17.25.C03.1.454.CMB.2.raw
  modified_base (273)..(273): a, c, t, g, unknown or other
  modified_base (363)..(363): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgctgagtggatgggatggggcaaccctacacgtggtgtcatagtgtccttcaccctactccgtccgggacngacttacatcgaccacgaactcctaccaataaacacagccctaacagtcggagttggaacggtacgccgttagacctagttccgtagaaccgacgacccggtcccgttacttaagtttaccgtaggttcgaccggtaacgaccggttacccccgaaaggtaccgtttcccgggtaggaaaccggtccccggttaaacgggccgaacgggtcccgggttacccttttacggtacccgttcgggtaccgggggcccgtaacgggggtacccgg

SEQ ID NO: 395039 - DNA, 574 bp, Homo sapiens
  misc_feature: GZ8MTXP02FQ9H2.17.25.C03.1.454.CMB.2.raw
  modified_base (252)..(252): a, c, t, g, unknown or other
  modified_base (326)..(326): a, c, t, g, unknown or other
  modified_base (369)..(369): a, c, t, g, unknown or other
  modified_base (409)..(409): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttaccncctatagtatcaactgggtgcgccaggccgctggacaacgcctgagtggagtgggatcggggaccaaaccctanacgtggtctcacgtagtcgtcctcaccctactccgtccggacncgtaccttacatacgaccacgacctccctacaataaaccncacgccctaacagtgggacttggaacggactccgtagacacgttccgagaccgacgaccggtcccttatacgttacgttgcggacgtacgacgttcccaggacgtccggtagcgcccgtaaggcctacggccgtaccttgaccgtttggacgggcgtaaggcccg

SEQ ID NO: 395040 - DNA, 605 bp, Homo sapiens
  misc_feature: GZ8MTXP02GCSZ7.17.25.C03.1.454.CMB.2.raw
  modified_base (475)..(475): a, c, t, g, unknown or other
  modified_base (491)..(491): a, c, t, g, unknown or other
  modified_base (519)..(519): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagaagccgtggggcctcagtgaaggtctcctgcaaggtcttctggattctacgtttacctcctatagtatcaacgtgggtgccgccgaggcccgcgtcggaaccaacgacctggaggtggagtggggaagtcggggaccgaaaaccccgtaacgacgttgggtacgaccaacgtaggttccgtacctttcccaaccctacgttcccgtaccgggacacggtaccttaaccagtacgaaccctacgaacctcctaccaaactaaaccacacacctanactggacgtgaggacnctagacatcgtagaccgacgacgccgtnttatacgtgtgacgagacgtcccgaagtcgtcggacgacgccgtacggcgacgcggtaccttgtacgtcgacgggtccgagggccg

SEQ ID NO: 395041 - DNA, 795 bp, Homo sapiens
  misc_feature: GZ8MTXP02JAE7L.17.25.C03.1.454.CMB.2.raw
  modified_base (270)..(270): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaatggtncgccaggccgctggacaacgacctgagtggatggagtgggacgaaaccctacgcgtggtgtccacgtagtcgtcttacccgacccctacgtccccgtaccggggaaccacggtacctttaaccagttaccgaaccccgtaaccgtaaaacccttcccttaacccaaaacttaaaaacccaacgaacccgtacccttaaaccgtaagttacggggtaaagtttacgggaaagggtaccgtcccgttaaacggaacctaaacgttacccgttaacggaaccccggaacccggtaaacccggggtcccccggtttaaaccttaacgtttaaacccggttgggttaccggtaaccgggaacggtaaccccgggttaccccccgaaagggttacccggttaccccgggggttaacggaaacggttcccccggttaaaaccggggtccgaaacggggttccccgggttcccctttttacgggaaccgtttccgggggtaccgggggccccgtaaacggggggtacccccgg

SEQ ID NO: 395042 - DNA, 547 bp, Homo sapiens
  misc_feature: GZ8MTXP02F9PH7.17.25.C03.1.454.CMB.2.raw
  modified_base (221)..(221): a, c, t, g, unknown or other
  modified_base (296)..(296): a, c, t, g, unknown or other
  modified_base (341)..(341): a, c, t, g, unknown or other
  modified_base (374)..(375): a, c, t, g, unknown or other
  modified_base (390)..(390): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccganaagtcacggcgttaaaactattaaatggtatcagcagaaacctggaaaacgccccagaccctctgatctctggtncatccactctgacgagtggctccatcgagtccagtgcagtgatcngggacagtatttcaatctacacatccaccatcnnccaactgagtattgncaaatctaacgtactagtacaaacagacgttacacgtttcccctacgctacgtttacggaccgtaacgggggtaaacctaaaaggtttacgaaaggaaacttaccgaaaaacccggattacgggtggacctggaccaaccctattcccgtatttccc

SEQ ID NO: 395043 - DNA, 542 bp, Homo sapiens
  misc_feature: GZ8MTXP02JJKJ5.17.25.C03.1.454.CMB.2.raw
  modified_base (273)..(273): a, c, t, g, unknown or other
  modified_base (327)..(327): a, c, t, g, unknown or other
  modified_base (427)..(427): a, c, t, g, unknown or other
  modified_base (463)..(463): a, c, t, g, unknown or other
tcagcgtagactagcacgaccggtgctcgatttagtagtgtagatttgggtttggggaaccacatctgtcctctagagaaaaccctgtgaccacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggcgaacccctaanactggtgtcacagtgtcccttcaccccatccctccgggacagcttaccatcgaccacgaactccctaccaataaaccacacgcctacatggagttgagancctgacatctagaccgacaccgggcctactattacnggtcgcgaagactcccagtactcccgggtgacgcctacggcaggccgcgtttgaccttcggcggggccaggggctcccg

SEQ ID NO: 395044 - DNA, 556 bp, Homo sapiens
  misc_feature: GZ8MTXP02FOC0H.17.25.C03.1.454.CMB.2.raw
  modified_base (277)..(277): a, c, t, g, unknown or other
  modified_base (301)..(301): a, c, t, g, unknown or other
  modified_base (390)..(390): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacttaaaacctatttaaatggtatcagcaagaaacctggaaaacnccccagacctcctgatctctggtncatcccatctgcgaagtcggctccatcgagttccagtgcagtgatcgtgggacagtatttcaatctacacatcaccactctgcaaccgngaggtattgtagactaaatctaactactgtacaaacagtagttactacgttccctcgtctacgtttcggaccgtaacgggggtaacctaaaggttcgaaagtaactaaccgtaaaaacgtaacgttaggtaacggactacgacctaaccctactccttacgtttcc

SEQ ID NO: 395045 - DNA, 584 bp, Homo sapiens
  misc_feature: GZ8MTXP02FWOQ1.17.25.C03.1.454.CMB.2.raw
  modified_base (435)..(435): a, c, t, g, unknown or other
  modified_base (486)..(486): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggagtgggagtcggggaccgaaaccctaacgacgtggtcgtcacgagtcgtccttccacccactcccgtaccgggacacgaccttaccatcgacccaacgaacctccctaccaataaaacccacacgaccctaanagtcggagttgaagggacgcctagaccatcgtagaccgacgaccggccgtnttacttacgtgtcgacgagacgtaccccagtacgtccggtgacgccgtacggcacggccggtcctttcggacctttcggcggggacccgagggtcccg

SEQ ID NO: 395046 - DNA, 609 bp, Homo sapiens
  misc_feature: GZ8MTXP02I787B.17.25.C03.1.454.CMB.2.raw
  modified_base (273)..(273): a, c, t, g, unknown or other
  modified_base (321)..(321): a, c, t, g, unknown or other
  modified_base (327)..(327): a, c, t, g, unknown or other
  modified_base (361)..(361): a, c, t, g, unknown or other
  modified_base (428)..(428): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcaaccctanctggtntcacagtcgtcttccacccatcccgtccgggacncgtaccttacatcgaccacgaaactccctacaataaaccacacgccctacagtgggagttgaaggcnccgtagaaccatcgtagacgaccgaccggccgttactattaccgtgtcggaccgagtacgtcccccaggtacgtcccgggtagaaccggtccccgtaacgggggccaacgggtccccgggttacccgtttttacggaacccgttttccgggtacggggggaccccgaacgggggtcccccg

SEQ ID NO: 395047 - DNA, 671 bp, Homo sapiens
  misc_feature: GZ8MTXP02IU8HK.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaacgtggtgcgcaggccgcgtggacacgacctgagtggagtgggatggggaccgaaaccctaacacgtggtgtacacgtagtcgtccttaccaccctactcccgtaccggggacacgtaccttaaccacgtcgaacccctaacgaaacctccctaaccaactaaaaccaccacgaccctaacagtcgggtaagttggaacggtacgcctagaactagtaccgtagaccgaccgaccggacccgttctaacgtttaccgtaggttcggaccgtacggaaccgttaccccgaacggttaccgtacccggggttagaaacccggtccccgttaaaccggggctaaccgggtcccggttacccgttttaggacccgtttccggacgggggacccgaacgggggtaccccg

SEQ ID NO: 395048 - DNA, 708 bp, Homo sapiens
  misc_feature: GZ8MTXP02IIBWX.17.25.C03.1.454.CMB.2.raw
  modified_base (274)..(274): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtncgccaggccgctggacaacgcctggagtggatgggatggggaccgaaaccctaacacgtgggtcgtacacgtagtccgtcttccacccatcccgtccgggacagtaccttacatcgaacccacgaacctcccaccaataaaaccacacgaccctaacacgtaggtaaggtttaggaacgggacgtacccgttacggaacctattaccgttacggaaccggtaaaccggaacccgggtccggttacctttaaacgtttaaccgttggttacggccggaaacggtaccggttacccccgaaaccggtacggttaccccgggttaggaaccggtacccccggttaaaccgggccgtaacggggtcccgggtttaccgtttacgggttacccgtttcgggggtcccgggggaccccgggtaaagggggtacccccggg

SEQ ID NO: 395049 - DNA, 658 bp, Homo sapiens
  misc_feature: GZ8MTXP02G9T6A.17.25.C03.1.454.CMB.2.raw
  modified_base (273)..(273): a, c, t, g, unknown or other
  modified_base (332)..(332): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctctatagtatcaacgtgggtncgccaggccgctaggacaacgacctggagtggagtgggatcggggaccaaacccctaanacgtggtgtaccacgtagtccgtccttaccgacccctacttcccgtaccggggacacggtaccttacatcgaacccaacgaacctccctaccaaataaaccgacacgaccttaacagtcggagttggaaggacgtacccgtaggacctagtaccgtacggaaccgaccgacccgggtcccgttacttaacgtttaccgtgggtcgacggacgtaacccgttccccgaacgtacgtcccgggtagaaaccggtcccgtaaccgggtccacggtcccggttcctttacggacccgtttcgggacggggtaccccgaagggggtccccg

SEQ ID NO: 395050 - DNA, 562 bp, Homo sapiens
  misc_feature: GZ8MTXP02IUDH0.17.25.C03.1.454.CMB.2.raw
  modified_base (353)..(353): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatggggatggggacgaaccctaacacgtggngtcacagtgtcttcacccatccctccgggacagaccttaccgatacgaccacgaactccctaccaactaaacactacgcctaacagttacggagttaggaggtagcccgtagaccattcgagacgacacggcctctaacttacgtgtcgacgacgtacgtcccgaacgacgtcccggtagacgtccgtaacggccacggtccggttccg

SEQ ID NO: 395051 - DNA, 574 bp, Homo sapiens
  misc_feature: GZ8MTXP02JJKH0.17.25.C03.1.454.CMB.2.raw
  modified_base (274)..(274): a, c, t, g, unknown or other
  modified_base (366)..(366): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattccacgtttacctcctatagtatcaactgggtncgccaggccgctggacaacgctgagtggatggatgggcgaaaccctaacgactggtcgtcactagtcgtcttccaccctatccgtaccggancgacttaccatcaccacgaactccctacataaacacacgcctacatggagttgaggagcctagacatctgaaccgacgaccggtccgtatacttacgtgtacggcgaagacgtcccgaacggtcgtccgggtacgacgcccgtaacggccgagggccggttccctttaggacccgttcgtaccgggggtaccgaacgggggtacccgg

SEQ ID NO: 395052 - DNA, 583 bp, Homo sapiens
  misc_feature: GZ8MTXP02J1WOH.17.25.C03.1.454.CMB.2.raw
  modified_base (302)..(302): a, c, t, g, unknown or other
  modified_base (415)..(415): a, c, t, g, unknown or other
  modified_base (462)..(462): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcgagtcaccatcacttgccggacaagtcacggtacttaaaacctatttaaatggtatcagcagaaacctaggaaaacgccccagacctcctgactctctggtncatccactctgccgaagtcggctcccatcgaggttcaggtgcagtggatcgtgggacagtattcaatctacaccatccaccactctagacctaaaccgtgacggtattggtanacctaattcctaactacttcggtaccaaacgtacgtacgtttaaccnccggtttcccctacgtcgttaccgttttcgggacccgtaacggggtaacctaaaaggttcggaaacgtactaacgaaacgtaccgtggtacgctacgactacgtactctacgttctttacc

SEQ ID NO: 395053 - DNA, 562 bp, Homo sapiens
  misc_feature: GZ8MTXP02FUZZ4.17.25.C03.1.454.CMB.2.raw
  modified_base (302)..(302): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggcgttaaaacctatttaaattggtatcagcaagaaacctggaaaacgccccagacctcctgatctctggtncatcccactctgacgaagtggcctcccatcgaggttccagtgcaggtgatctggggacagtattacaatctcacatccaccactctgcaaccgtgaaggtattgtagctaaatcctaactactgtacaaacagtacgttacacgttacccctcgtcctacgttttcgggaccgtaacggggaacctaaagtttcggaaagtaactaacgaaaacgtaacgttggtaacggtctacggacctacctatccgttcgtttacc

SEQ ID NO: 395054 - DNA, 597 bp, Homo sapiens
  misc_feature: GZ8MTXP02G2UUS.17.25.C03.1.454.CMB.2.raw
  modified_base (375)..(375): a, c, t, g, unknown or other
  modified_base (455)..(455): a, c, t, g, unknown or other
  modified_base (497)..(497): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggcccgctggacaacgcctgagtggagtggggatcgggcgaaaaccctacacgtggtgtcactagtcgtccttcaccctactcccgtacccggganccggtaccttaccatacgacccaacgaacctccctaccaaagtaaaccacacgtaccctaacagtcggagttgagggacnctagactagtcgacgaccgacgaccggtcctattacgttcgngtcgacgtacgaccgtacccgacgtctaccgatacggacgtacccgtacggcaacgggtccgttccgtttacgaccgtttcgggccggggacgtacgggg

SEQ ID NO: 395055 - DNA, 540 bp, Homo sapiens
  misc_feature: GZ8MTXP02ILQAI.17.25.C03.1.454.CMB.2.raw
  modified_base (271)..(271): a, c, t, g, unknown or other
  modified_base (320)..(320): a, c, t, g, unknown or other
  modified_base (327)..(327): a, c, t, g, unknown or other
  modified_base (359)..(359): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctctgcaaggcttctggattcacgtttacctctatagtatcaactgggtncgccaggccgctggacaacgactgagtggatgggatgggcaaaccctanactggtntcacagtcgtcttcacccatccctccgggacngacttaccatcgaccagaactcctacataaacacagcctacatggattgagagctgacatctgacgacacggccgtcattactgtgacgagacgtaccccaggtactccgggttagacgtaccgtaacggcccaaggccggtccgtttgaccgtttcggtcgggggaccctaaggggcccg

SEQ ID NO: 395056 - DNA, 569 bp, Homo sapiens
  misc_feature: GZ8MTXP02G6POS.17.25.C03.1.454.CMB.2.raw
  modified_base (273)..(273): a, c, t, g, unknown or other
  modified_base (324)..(324): a, c, t, g, unknown or other
  modified_base (332)..(332): a, c, t, g, unknown or other
  modified_base (364)..(364): a, c, t, g, unknown or other
  modified_base (405)..(405): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacaaccctaanacgtggtntcactagtcgtcttcacccatccctccggacngacttacatgaccacgactccctacataaaccacagcctanatggagttgagacgcctagactatctagaccgacacggccgtacttagttactggtacgcgaacgtaccggttaccccaaggtacgtcccggggtagaccggcccgttaccggctaacggtccggtcctttacggacctttcggcggggcccgaaggggtcccg

SEQ ID NO: 395057 - DNA, 706 bp, Homo sapiens
  misc_feature: GZ8MTXP02HICHK.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctcagtgaggtctcctgcaaggcttctggattctacgtttacctctatagtatcaacgtgggtcgcgcccaggcccgctggaccaacgacctggagtggagtggggagtggggaccaaaccccgtaacgactcgggtagctaactaggtcgtcctttccaccccctaacgttccccgtacccggggtaaccacggtaacccttaacccgaacgttacccgaaaccccctaaccggtaaaaccccttcccccgttaacccaaaattaaaaaccccacgaaaccgtaccctttaaaccgaagtttaccgggaagtttacgggaaacggggtacgacccgttaaggaacctaaacgttcgttacgaaaccgtaaccggaccggtacccgttataacgttacgtcgtacgacgtacgtaccgtcccgaacggtcgtcccgggtagaccggccgtacggcgacgtccggtacttcgtacgttccgcggggccacgggggtcccg

SEQ ID NO: 395058 - DNA, 603 bp, Homo sapiens
  misc_feature: GZ8MTXP02GYVBQ.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaacgtggtgccgccaggccgctggaaccaacgacctgagtggagtgggagtgggaccgaaaccctaacacgtggtcgtcacgtagtcgtccttccaccctactcccgtccgggacacgtaccttaccatcgacccaacgaacctccctaccaaataaaccacacgcctaacagtcgggagttggaacggagccctagacctagtctacgacgaccgacggtccctattacttacgcgttagacgacgacgtcccgaacgtcgtacccggtgaacgtcccgtaacggctacgggtccggtacctttcggacgttcggtcgggggaccaaggggtcccgg

SEQ ID NO: 395059 - DNA, 762 bp, Homo sapiens
  misc_feature: GZ8MTXP02J3944.17.25.C03.1.454.CMB.2.raw
  modified_base (215)..(215): a, c, t, g, unknown or other
  modified_base (240)..(240): a, c, t, g, unknown or other
  modified_base (277)..(277): a, c, t, g, unknown or other
  modified_base (287)..(287): a, c, t, g, unknown or other
  modified_base (493)..(493): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggactcctcttcttggtggcagcagctacaagtcgcccactcccaggtgcagctggtgcagtcgtggggctggaggtgaagagccgtgggcctnagtgaaggtctcctgcaaggtcttntggtattctacgttacctctatagtatcaacgtggcncgccaggccntacgacaacgccgtggagtcggagtgggatcggggccaaaccctaaacgcgttggcgttaccaaacgtcgttcccgtccctttaccaaccccctaacgtttccccgtacccggggaactaccggtaaacctttaaaccccaagtccgaaaccccaacctaaacctttcccctaaacaaactaaaacccggactacggacccctaanagggtttacggagtttaggaacggggtacctcgtacgtactacgtacgtaccggtaacccgtaacccgttaccgttacctttacgttacgttacggtacgggtaccgaaccggtaaaccggtaccccggtaccccgtaacgggtaccggtacccggggtacgtacccggtacccggtaccggtaccggtaccgggttcccggtttacccggtttaccggtacccgggtttaccggggacccgggggtaccggtaaccgggggtaccccg

SEQ ID NO: 395060 - DNA, 563 bp, Homo sapiens
  misc_feature: GZ8MTXP02H570C.17.25.C03.1.454.CMB.2.raw
  modified_base (299)..(299): a, c, t, g, unknown or other
  modified_base (331)..(331): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctctgtgggggtcagagtcaccatcacttgccggacaagtcacggacgttaaaacctattaaattggatcagcaagaaacctggaaaacgccccagacctcctgatctctggtncatccactctgacgaagtggctcccagtcggnggttccaggtgcaggtggatcgtgggacagtatttcaatctacaccataccacctactctcgactaaccgtggaacggtattgtagacaattctaactactgtacaaagtagtaacgttacacgtttcccctcgtaccttacgtttcgggacccgtaacggggaaccctaaaggttacgacgactaaccgaaacgtacgtaggtcggcgtacgacaacctctctttacgtcc

SEQ ID NO: 395061 - DNA, 618 bp, Homo sapiens
  misc_feature: GZ8MTXP02GOYIV.17.25.C03.1.454.CMB.2.raw
  modified_base (274)..(274): a, c, t, g, unknown or other
  modified_base (448)..(448): a, c, t, g, unknown or other
  modified_base (478)..(478): a, c, t, g, unknown or other
  modified_base (526)..(526): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggattcacgtttacctctatagtatcaactgggtncgccaggccgctggacaacgcctgagtggagtgggatgggaccaaaccctaacgacgtgggtgtccaacgtaggttcgtccttccaacccctacttccccgtacccggggaacacggtaaccctttaacccacgttaccggaacccacgtaaacctccctaccaaataaaaccncaacgccctaagatgggacgttagaaggcnccgtagacctagttcgagacgacgaccgggtcccttaatacttacggngtgacgacgaccgtacccgacggtacgtccggacacgtaccgacggcgacggtccgttcgttacggtaccgttcgggcgggaccgacggccg

SEQ ID NO: 395062 - DNA, 657 bp, Homo sapiens
  misc_feature: GZ8MTXP02GE1GL.17.25.C03.1.454.CMB.2.raw
  modified_base (438)..(438): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggcctcgagtgaaggtctcctgcgaaggtcttcgtggtacttctacgtttacctctaatagtatcaactgggtgcgccaggccgcgtggaaccaacgacctgagtggagtgggatcgggaccaaccctaagcgtggtgtacacgtagtcgtcctaccacccactcccgtaccgggacacgtaccttaccgataccgaacccaccgtaaacctccctaaccaaataaaacccnctacgacctacgaagtgggtaagttggaaggacgacctaggaacctatcgtacgaacccgtaccggaccgggtaccctattaacgttaccgtggtcggaccgtagacccgtacccgacggtcgtacccgggtaggaccgtcccgtaacggccgtacgggtcccgggttccctttacggaccgtttccggggccgggggaaccccgtagggggtcccccg

SEQ ID NO: 395063 - DNA, 607 bp, Homo sapiens
  misc_feature: GZ8MTXP02IHTPE.17.25.C03.1.454.CMB.2.raw
  modified_base (209)..(209): a, c, t, g, unknown or other
  modified_base (230)..(230): a, c, t, g, unknown or other
  modified_base (265)..(265): a, c, t, g, unknown or other
  modified_base (324)..(324): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggcctnagtgagtctctgcaggcttcnggattcacgtttacctctatagtatcaactgggtncgccaggcccgctggaccaacgacctgagtggatggggatggggaccgaaacccctaanacgtggtgtcactagtcgtaccttccgaccctatcccgtaccggggacacgtaccttaaccattacgaacccacgaaacctccctaccaaataaaccacacgaccctaacacgtagggattaggaaggacgccgtagaacctatcgtagaccgacgaccggtccgtacttaacttacgtggtcgaccgaggtaaccgtccccgaagtacgtcccggtagacgtcccgtaacgggcacggccggttcctttacgaccgttcggtacgggggcctaaggggtccg

SEQ ID NO: 395064 - DNA, 587 bp, Homo sapiens
  misc_feature: GZ8MTXP02JW3ZS.17.25.C03.1.454.CMB.2.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaacgccccaagacctcctgactctctggtcgcatccactctgcgaagtggctccatcgaggttccagtgcagtggatcgtgggacagtatttcaattcacaccatcaccactctgccactgacgtatcgtgacaaattctactacgtagttacaaactaacgtacgttaccgtacgtttcccctcgtaccttacgttttcggacccgtacgggggtaaacctaaagggttacgaaacggtaacttaaccgaaaaccggtaaaccgttagggtaacggtcgttacggacccaaaccgtacttaccgtcggtttaccc

SEQ ID NO: 395065 - DNA, 602 bp, Homo sapiens
  misc_feature: GZ8MTXP02GZB6P.17.25.C03.1.454.CMB.2.raw
  modified_base (283)..(283): a, c, t, g, unknown or other
  modified_base (308)..(308): a, c, t, g, unknown or other
  modified_base (409)..(409): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccactcctccctgtctgcctctggtgggggtcagagtcaccatcacttgccggacaagtcacggtacgttaaaacctatttaaattggtaatcagacaagaaacctaggaaacnccccagacctctgactctctggtcncatcccacttctgcggtaaggtcggcccgtcccagtcggtaggttccaggtggcaggtggacttcgtggggaactaggtatttcaatctcacactcaaccnctctgacctaactggaggtatttggacactaaattcctaactacttgacctaaacgtggtaacctttaccgaccggtttcccctacgtaccgtttacgtttacgggaccgtaacggggaaaccttaaaggtcgaaagtacctaaccgaaaacgtcgtaggtcggacctacgacctactacttcgtactttccc

SEQ ID NO: 395066 - DNA, 590 bp, Homo sapiens
  misc_feature: GZ8MTXP02IH0UD.17.25.C03.1.454.CMB.2.raw
  modified_base (224)..(224): a, c, t, g, unknown or other
  modified_base (296)..(296): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatcctccctgtctgcctcgtggtgggggtcagagtcaccatcacttgccganagtcacggtacttaaactattaatggtatcagcagaaacctaggaaacgccccagacctctgatctctggtncatccactctgcgaagtcggcctccagtcgagttccaggtcgcaggtggactcgtggggactaggtactttacaacttctacacatcaccactccgactaaccgtgacggtattcgtacgactaacttacttaaccttacgttacgtaacctaaacgtacgtaacgttaccgtaccgtttaccccgtcgtaccgttacgtttacgggaccgtaacgggtaaaccgtaaagttacgaaagtaactaaacgtaaacgtaaacgttgacggtctacgactactatcttcgtactttc

SEQ ID NO: 395067 - DNA, 731 bp, Homo sapiens
  misc_feature: GZ8MTXP02JJW17.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtgcagcagctacaagtgcccactcccaggtgcagctggtgcagtctggggctgaggtgaagaagcctggggcctcagtgaggtctcctgcaaggcttctggattcacgtttacctctatagtatcaacgtgggtgccgccaggccgctggaacacgctgagtggagtggatggggacaaaccctaacacgtggtgtcactgtcgtcttccaccactccgtaccgggacacggtacctttaaccacgtacgaaccctaaccgtaaacccttcccttaaccccaaacttaaaaacccaacaaccggtaacccttaaccgaagttacggggaacgttcgggaaggggaacgtccccgttaaggaaccctagtttacccgtacgggaacccgaacccggaacccggtaccccggttaacgtttaactttaaaccggttggttacggaccggtaaacgtaaccgggttacccccgaaacgggcccggtttacccgggacgggtaccggaccccgggttaaaccgggccgtaaccgggtcccggggttcctttttacggaccggtttccggttccggggggaccccaacgggggtccccgg

SEQ ID NO: 395068 - DNA, 595 bp, Homo sapiens
  misc_feature: GZ8MTXP02IL2GM.17.25.C03.1.454.CMB.2.raw
  modified_base (284)..(284): a, c, t, g, unknown or other
  modified_base (323)..(323): a, c, t, g, unknown or other
  modified_base (429)..(429): a, c, t, g, unknown or other
  modified_base (437)..(437): a, c, t, g, unknown or other
  modified_base (471)..(471): a, c, t, g, unknown or other
tcagcgtagactagcacgaccggtgctcgatttagtagtgtagatttgggtttgggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtggtcgcgccaggccgntggacaacgactgagtggatgggatgggccaaaccctanacgtggtcgcacagtcgtccttccacccatcccgtcgggacagtacttaccatcgacccagacctccctacataaaccacacgcctacagtggtagttgaaggacnctagactntcgtagacgtacgaaccgtccgtatacgttacgnggttgaccgaagaccgtcccgaacggcgttacccgggtgaaaccggtcccgtaacggtccgaacggtcccgggtaccttttcggtacccgtttcggtccgggggacccgtaagggggtccccgg

SEQ ID NO: 395069 - DNA, 635 bp, Homo sapiens
  misc_feature: GZ8MTXP02HVWGO.17.25.C03.1.454.CMB.2.raw
  modified_base (210)..(210): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctggggcctnagtgagtctctgcaggcttctggattcacgtttacctctatagtatcaacgtggtgcgccaggccgctggacaacgacctggagtggagtgggatcggggaccgaaccctaacgcgtggtgtaccacgtagttcgttccttccgacccctacgttcccgtacccggggaacacggtacctttaacccattacccggaacccaaccgtaaaccttcccctaccaaataaaccacacgaccctaacagttcgggtagttacggagggacgccgttagaacctacgttcgtacggaaccgaccgaccggtccgttacttacgttacgtggtcgacgacgtacgtccccgtacggtacgtcccggtagaccgtccgtaacggcgacggtccggtctttcggtacttcggtacggggccgtaggggcccg

SEQ ID NO: 395070 - DNA, 581 bp, Homo sapiens
  misc_feature: GZ8MTXP02J0WBO.17.25.C03.1.454.CMB.2.raw
  modified_base (482)..(482): a, c, t, g, unknown or other
  modified_base (522)..(522): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgattggagtgggatggggaccgtaaaccctaaccacgtgggtgtcacgagttcgtcttccgacccactcccgtccggggactacgaccttaacccgatcgaaaccccagtaaccctccctaccaaataaaaccacacgtaccctaacgagtcggtagttgaagganccctagacactcgagaccggacacgggtcctcttataccnggtcgaccgagaccgtccccaagtacgtccggagacgtcctacgggcacggtcggtacc

SEQ ID NO: 395071 - DNA, 669 bp, Homo sapiens
  misc_feature: GZ8MTXP02FZ3NR.17.25.C03.1.454.CMB.2.raw
  modified_base (254)..(254): a, c, t, g, unknown or other
  modified_base (275)..(275): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttaccncctatagtatcaactgggtcncgccgaggccgcgtggacacgactggagtggatggggatcggggaccgaaaccctaacgcgttggtacgtacaacgtagttcgttcccttaccgaaccccctagttccccgtaccggggaacacggtaacctttacccaagttaccgaacccctaacggaaaccttcccctaacccaaacttaaaacccacgaacgacccttaacgagtacgggtagtttacggaggacgccttagaacctatcgtacggaccgaacgaccggtcccgttactaacgtttccgtaggtcgacggagaccgtacccacggtacgtcccggtagaccggtacccgtacgggccagggtcccggtccgtttacggtaccgttcggtcggggaccgaggggtacccgg

SEQ ID NO: 395072 - DNA, 577 bp, Homo sapiens
  misc_feature: GZ8MTXP02FE0SC.17.25.C03.1.454.CMB.2.raw
  modified_base (253)..(253): a, c, t, g, unknown or other
  modified_base (273)..(273): a, c, t, g, unknown or other
  modified_base (375)..(375): a, c, t, g, unknown or other
  modified_base (477)..(477): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtncgccaggccgctggacacgacctgagtggatggggatcggggaccgaaaccctaacacgtgggtgtcactagtcgtccttccacccatcccgtccggggacncgaccttaccatcgaaccacgaacctccctaccaaataaaacacacgcctaacagtaggagttgagggacgcctagaccatctagaccgacgacggcccgtntacttactgtcgcgagacgtcccacgatcccgggtagacggcccgtaacggcacggccggtcccttttagaccgtttcggcgggggaccagggggtaccg

SEQ ID NO: 395073 - DNA, 578 bp, Homo sapiens
  misc_feature: GZ8MTXP02FTRCF.17.25.C03.1.454.CMB.2.raw
  modified_base (302)..(302): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggcgttaaaacctatttaaatggtatcagcagaaacctggaaaacgccccaagaccctctgatctctgggtncatccactctgacgaagtcggctccatcgagttccagtgcagtgatcgtggggacaggtatttcaatctacaccatccaccactctcgactaaccgtgagtattgagactaaatcctaactacttgtacaaacagtaacgttacaccgtttaccccgtcgtaccttaacgttttcgggaccgaaacgggggtaaccctaaaaggtttggaaacgtaactaacgaaaacgtaacgttggtaacgggtactacggaccacctaactccgttactttcc

SEQ ID NO: 395074 - DNA, 568 bp, Homo sapiens
  misc_feature: GZ8MTXP02GW41Z.17.25.C03.1.454.CMB.2.raw
  modified_base (271)..(271): a, c, t, g, unknown or other
  modified_base (345)..(345): a, c, t, g, unknown or other
  modified_base (357)..(357): a, c, t, g, unknown or other
  modified_base (450)..(450): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactggtncgcaggccgctgacacgactgagtggatgggatgggacgaaccctaagcgtggtctcacagtcgtcttcacccntccctccggacngtacttacatcgaccacgactccctacaataaaccacacgcctacagtcggagttcgaagtcgctagacagtctagaccgacgaccgccgttntacttacgtgagtcgacgtcgtaccccacggacgtcccggtgaaccgtcccgtacggaccgtacggtcccggtcctttcggtaccttccgggtacggggcccggaacggggtccccgg

SEQ ID NO: 395075 - DNA, 580 bp, Homo sapiens
  misc_feature: GZ8MTXP02JRS8T.17.25.C03.1.454.CMB.2.raw
  modified_base (225)..(225): a, c, t, g, unknown or other
  modified_base (258)..(258): a, c, t, g, unknown or other
  modified_base (275)..(275): a, c, t, g, unknown or other
  modified_base (302)..(302): a, c, t, g, unknown or other
  modified_base (314)..(314): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatccctccctgtctgcctcgtggtgggggtcagagtcaccatcacttgccganagtcacggtacttaaactattaaatgtatcagnagaaacctaggaaaacnccccagacctctagactctctgggtcncactccactcgngaccgagtcgcctccagtcgaggttcccaggtgcaggtgatcgtgggactagtactttacgaacttcacaccactcccgaaccctacttctacgacccaaaccgtggaagttacttaggcactaacttcttactactgtacaaacgtagtacgttaccgtaccgttccctacgtcgttacgttacgggacgtaacggggaactaaggtacggaaatacgtaacgaaccgtaagtggtaacgtcgactaccatacgttctacgttcc

SEQ ID NO: 395076 - DNA, 654 bp, Homo sapiens
  misc_feature: GZ8MTXP02IZ1Z2.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattctacgtttacctcctatagtatcaacgtggtcgcgccgacggccgctggaccaacgacctgagtggagtgggatcgggaccgaaaccctaagactggtcgtcacgagtcgtccttcaccctactcccgtaccgggacagaccttaaccagtaccgaccaacgaacctccctaccaactaaaccacacgaccctaacagtacggtaagttcggaagggacgcccgttagaaccgtattaccgtacgaaccggaccgtaacccgggtaccgttacgttaacgttacgtacgtacggacgaaggaaccggtccccgaacggtacgtcccggtaggaaccgtcccgtaaccgggcgaacggtccggtcccgtttacgggtaccttcggccgggggtaccgacgggggtacccgg

SEQ ID NO: 395077 - DNA, 546 bp, Homo sapiens
  misc_feature: GZ8MTXP02I880O.17.25.C03.1.454.CMB.2.raw
  modified_base (223)..(223): a, c, t, g, unknown or other
  modified_base (301)..(301): a, c, t, g, unknown or other
  modified_base (349)..(349): a, c, t, g, unknown or other
  modified_base (394)..(394): a, c, t, g, unknown or other
  modified_base (420)..(420): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgganaagtcacggacttaaacctatttaaattggtatcagcagaaacctggaaaacgccccagacctcctgatctctgggtncatccatctgcgaagtggctccatcgaggttccagtgcagtggatcgnggggacaggtatttcaatctcacatcaccacgtctcgactaaccngaggtattgagcaaatctactacgtntacaacaagtacgtactacgttcccctcgtctacgttttacgaccgtacggggacctaaaggttacgaaggtaactaccgaaaacggtacgtagtgggactaggaccactacttcctagtttaccc

SEQ ID NO: 395078 - DNA, 584 bp, Homo sapiens
  misc_feature: GZ8MTXP02IC58U.17.25.C03.1.454.CMB.2.raw
  modified_base (236)..(236): a, c, t, g, unknown or other
  modified_base (381)..(381): a, c, t, g, unknown or other
  modified_base (422)..(422): a, c, t, g, unknown or other
  modified_base (488)..(488): a, c, t, g, unknown or other
  modified_base (497)..(497): a, c, t, g, unknown or other
  modified_base (538)..(538): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcnggattctacgtttacctctatagtatcaactgggtgcgccaggccgcgtaggaccaacgacctgagtggatgggagtggggaccgaaacccgtaacacgtggtgtacacgtagtcgtaccttccaccccagtcccgtccgggacncgtaccttaccaactcgaacccaacgaaactcccactaaanaaaacacacgaccctaagatcgggtaattcggagacgcctagactatcgtagaccgacacggcctntaacttcgngtgacgtgacgtcccaagtcgtccggtgacgtccgaacggnacggtcggtccctttggaccttcgggcgggacccgaacggggcccg

SEQ ID NO: 395079 - DNA, 571 bp, Homo sapiens
  misc_feature: GZ8MTXP02GN1OJ.17.25.C03.1.454.CMB.2.raw
  modified_base (370)..(370): a, c, t, g, unknown or other
  modified_base (443)..(443): a, c, t, g, unknown or other
  modified_base (473)..(473): a, c, t, g, unknown or other
  modified_base (480)..(480): a, c, t, g, unknown or other
  modified_base (552)..(552): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacgaaaccctaacacgtggtgtcacgtagtcgtcttccacccatcccgtccggacncgacttaccatcgacccaacgaacctccctaccaaataaaacccacaacgccctaacagtcggagttgaggancctagacatctagaccgtacgcggcccttntattacnggtgacgagacgtcccaggactcccggtgacgtcccgtacggcacggtccggtcctttacggactttccggngggggcccaaggggtcccg

SEQ ID NO: 395080 - DNA, 576 bp, Homo sapiens
  misc_feature: GZ8MTXP02JY23F.17.25.C03.1.454.CMB.2.raw
  modified_base (331)..(331): a, c, t, g, unknown or other
  modified_base (372)..(372): a, c, t, g, unknown or other
  modified_base (417)..(417): a, c, t, g, unknown or other
  modified_base (433)..(433): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcagtgaaggtctcctgcaaggcttcgtggtattctacgtttacctcctatagtatcaacgtgggtgcgccaggccgctggacaacgacctgagtggatggatggggccgaaaccctaancgtggtgtcacgtagtcgtccttcacccatccgccgggacngacttaccatcgaccacgactccctaccaataaacacacgcctanacgtggagttgaaggngcctagactatcgtagaccacgaccggccgtctagttacgtgacgcgagacgtacccgacgacgtcccgggtgacggtcccgtacggccgacggccggttccgtttcgacggtttccggtcgggggacccgagggggtacccg

SEQ ID NO: 395081 - DNA, 551 bp, Homo sapiens
  misc_feature: GZ8MTXP02GDMXR.17.25.C03.1.454.CMB.2.raw
  modified_base (282)..(282): a, c, t, g, unknown or other
  modified_base (322)..(322): a, c, t, g, unknown or other
  modified_base (359)..(359): a, c, t, g, unknown or other
  modified_base (392)..(392): a, c, t, g, unknown or other
  modified_base (402)..(402): a, c, t, g, unknown or other
  modified_base (450)..(450): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtgcgccaggccgntggacaacgacctgagtggatgggatgggccaaccctaanactggtgtcacagtcgtcttcaccatcctccgggacngacttaccatgaccacgaactcctacataaacncacgcctaanatggattgaggtagcctagacatctgacgacacggccgtatattacgngtcgcgtagacgttcccacgagtcccggtagacgtcctaacgggcctaaggcccgggtacctttcggaccgtttcggacgggggaccccgaaggggtcccg

SEQ ID NO: 395082 - DNA, 585 bp, Homo sapiens
  misc_feature: GZ8MTXP02IDEVP.17.25.C03.1.454.CMB.2.raw
  modified_base (279)..(279): a, c, t, g, unknown or other
  modified_base (302)..(302): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgccggacaagtcacggtacttaaacctatttaaattggtatcagcaagaaacctggaaaacnccccagacctctgatctctggtnactatccactctagacgaaggtcggctccccaagtccggagttcccgagtgcaggtggatcgtgggaactagtatttacaattcactaccgatccaacctctctcgacctaactagagtattgtactactaattacttaaccgtattcgaacaaacgtagtagttaccacgtttcccctacgtacttaccgtttcggacccgtaaggggtaacctaaaagtgaaacgactaaaccgtaaacgaagttcggaagacgtacacctaaccttacttccgttatacc

SEQ ID NO: 395083 - DNA, 539 bp, Homo sapiens
  misc_feature: GZ8MTXP02JDMNR.17.25.C03.1.454.CMB.2.raw
  modified_base (273)..(273): a, c, t, g, unknown or other
  modified_base (321)..(321): a, c, t, g, unknown or other
  modified_base (327)..(327): a, c, t, g, unknown or other
  modified_base (356)..(356): a, c, t, g, unknown or other
  modified_base (399)..(399): a, c, t, g, unknown or other
  modified_base (411)..(411): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggatgggcaaccctanactggngtcacagtgtcttcacccatcctcggacngacttaccatcgaccacgaactcctcataaacacagccctaanatgagtgagacnctagacatctagacgacgaccgctactatacgtgtcgacgagacgtacccaggtacgtccgggtagaccgtaccgtaccggcgacggtccggtcgtttacgaccgttcggacggggaccgacggggcg

SEQ ID NO: 395084 - DNA, 589 bp, Homo sapiens
  misc_feature: GZ8MTXP02H3HXE.17.25.C03.1.454.CMB.2.raw
  modified_base (245)..(245): a, c, t, g, unknown or other
  modified_base (284)..(284): a, c, t, g, unknown or other
  modified_base (346)..(346): a, c, t, g, unknown or other
  modified_base (389)..(389): a, c, t, g, unknown or other
  modified_base (422)..(422): a, c, t, g, unknown or other
  modified_base (454)..(454): a, c, t, g, unknown or other
  modified_base (493)..(493): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaagccgtggggcctcgaggtgaaggtctccgtgcaaggcttcgnggtattctacgtttacctcctatagtatcaacgtgggtnccggccaggccgctggaccaacggcctggagtggaagtggggatggggaccaacccgttaanacgtgggatacacgagttcgtcttccaccattccgccgggacngacttacatacgacctacgaactcccacctaanaaacacacgaccacatcgggagttagagggtnacctgacactgacgacacgtaccggcttactatttacgngtcgacgacgtaccgtccgacgtcggtccgtacgaccgtaccgacggcgaccgttccgtccgttacggccgttcgggtacgggtaccgacgggccg

SEQ ID NO: 395085 - DNA, 672 bp, Homo sapiens
  misc_feature: GZ8MTXP02F3JX4.17.25.C03.1.454.CMB.2.raw
  modified_base (210)..(210): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctnagtgaggtctcctgcaaggcttctggattcacgtttacctcctatagtatcaacgtgggtgcgccaggccgctggacaacgacctggagtggatggggatggggaccgaaccctacgacgttggtcgtcactagtcgtccttaccaccctatcccgtaccggggacacggtaccttaaccataccgaaccctaacgaaacctccctaccaaataaaaccacaacgccctaacagtcgggtaagttggaaggtacgccctagacctatccgtagaaccgaccgaccgggtacccgttactaaactttccgttggtcggaccggaaacggttacccgtacccccgaacgggttaaccgttccccgggggtagaccgggtacccccgttaacgggggcccaacgggtccgggttacccttttacggacccgttttccggacgggggtaccccagggggtaccccg

SEQ ID NO: 395086 - DNA, 514 bp, Homo sapiens
  misc_feature: GZ8MTXP02GPKX6.17.25.C03.1.454.CMB.2.raw
  modified_base (203)..(203): a, c, t, g, unknown or other
  modified_base (222)..(222): a, c, t, g, unknown or other
  modified_base (272)..(272): a, c, t, g, unknown or other
  modified_base (295)..(295): a, c, t, g, unknown or other
  modified_base (395)..(395): a, c, t, g, unknown or other
  modified_base (416)..(416): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagngtcaccatcacttgccganagtcacggacgttaaaactattaatggtatcagcagaaacctggaaaacnccccagacctctgatctctggtncatccactctgcgaagtgcctccatcgagttccagtgcagtggatcgtggggacagtatttcaattctacacatccaccactccgacacctgagtatgtnacaatactactactgtacaanagtattactacgttccctcgcttacgtttggaccgtaggtaacctaagttgaacgtacaacaaacgtacgtcgtgaactcgacacctatcttgtactc

SEQ ID NO: 395087 - DNA, 515 bp, Homo sapiens
  misc_feature: GZ8MTXP02F8BHL.17.25.C03.1.454.CMB.2.raw
  modified_base (362)..(362): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctacactggtgtcacagtcgtcttcacccatccctccggggacngacttaccatgaccacgaaactcctccataaaccacagcctacatggagttgaggagcctgacatctgacgacacggccgtctattactgtgcgagagtcccacgatccggtgacgcctacggcagcggctttgacttctggggccagggacg

SEQ ID NO: 395088 - DNA, 693 bp, Homo sapiens
  misc_feature: GZ8MTXP02GSKL0.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggtcttcgtggtattctacgttacctctatagtatcaacgtggtcgcgccaggccgctggacaacgacctgagtggagtggggagtcggggaccaaaccctaacgacgttggtcgtacacgtgtccgtccttaccaccctacgtccccgtacccgggaactacggtaaccttaccgaacttaccgaaccctaaaccggtaaccccttccctaaaccctaaaacttaaaacccaacccaacgtaaccccttaacgtaaggtacggggtaaggtttacggaacgggtaccgtaccgtacgactaacgtcgtacgaaccggtaccgaccggtaccccgttagttaacgttacgtggtacgacgtaacgaccgttacccgacggtaccgtccgggtacgaccgccgtacggacgtacgtccggttccttacggtaccgttcggccggggtaccgacgggtacccg

SEQ ID NO: 395089 - DNA, 556 bp, Homo sapiens
  misc_feature: GZ8MTXP02GAXHF.17.25.C03.1.454.CMB.2.raw
  modified_base (333)..(333): a, c, t, g, unknown or other
  modified_base (365)..(365): a, c, t, g, unknown or other
  modified_base (399)..(399): a, c, t, g, unknown or other
  modified_base (424)..(424): a, c, t, g, unknown or other
  modified_base (468)..(468): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggaccaacgacctgagtggatggggatgggacgaaccctacacgtggtntcacagtcgtccttcacccatccgtccgggancgacttaccatcgaccacgactcctacataaacncagacctacatcggtagtgaggacncgtagacatcgtagaacgacgaccggccgttctaattacgttgngcgacgacgtacccagtactccgggtagacgccgtacggcaacggtccgtccctttaggaccttcggtacggggccaacggggtcccg

SEQ ID NO: 395090 - DNA, 554 bp, Homo sapiens
  misc_feature: GZ8MTXP02F6AYX.17.25.C03.1.454.CMB.2.raw
  modified_base (278)..(278): a, c, t, g, unknown or other
  modified_base (391)..(392): a, c, t, g, unknown or other
  modified_base (405)..(405): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaatggtatcagcaagaaacctggaaaacnccccagaccctcctgatctctggtgcatcccactctgcgaagtcggccgtcccatcgaggttccagtggcagtgatcgtggggacagtatttcaatctacacatcaccactcnncaactgagtatgngacaatctactactgtacaacagtacgttactacgttcccctcgtcctacgtttcggaccgtaacggggaacctaaaaggttcgaaagtaactaacgaaaacgtaaccgtagaacggtctacggaccaactacgttcctacgtttaccc

SEQ ID NO: 395091 - DNA, 593 bp, Homo sapiens
  misc_feature: GZ8MTXP02GZD33.17.25.C03.1.454.CMB.2.raw
  modified_base (213)..(213): a, c, t, g, unknown or other
  modified_base (344)..(344): a, c, t, g, unknown or other
  modified_base (381)..(381): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctnagtgaaggtctcctgcaaggcttctggattcacgtttacctctatagtatcaacgtgggtgcgccgaggccgcgtggaacaacgacctggaggtggagtggggagtgggaccgaaaccctaacacgtggtntcactagtcgtcttaccacccatcccgtaccgggacngtaccttacatcgaacccacgaacctccctaccaataaaccacacgcctacagtggagttggaggacgcctagactatctaggacaccgaccggtcccttatacttacgtgtagcggagtaccgtcccgacgtacgtccgggtagacgtcccgtaacggcaacggtccggtcctttacggaccgtttcggcggggaccgaggggtaccccgg

SEQ ID NO: 395092 - DNA, 552 bp, Homo sapiens
  misc_feature: GZ8MTXP02GQBFE.17.25.C03.1.454.CMB.2.raw
  modified_base (284)..(284): a, c, t, g, unknown or other
  modified_base (297)..(297): a, c, t, g, unknown or other
  modified_base (333)..(333): a, c, t, g, unknown or other
  modified_base (362)..(362): a, c, t, g, unknown or other
  modified_base (411)..(411): a, c, t, g, unknown or other
  modified_base (438)..(438): a, c, t, g, unknown or other
  modified_base (463)..(463): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacaacgaccngagtggatgggatgggcgaaaccctacactggtgtnacagtcgtcttcacccatccctcgggacngactaccatcgaccacgaaactcctaccaataaaccacacgacctacancggtagttagaggagcctagacattcngacgactacggcctactatactggngacgagcgtacccagtacgtcggtacgacgtaccgtacggcgacgtccggttccgttacgtaccgttcgggacggggaccgtaggggcg

SEQ ID NO: 395093 - DNA, 600 bp, Homo sapiens
  misc_feature: GZ8MTXP02JJHBN.17.25.C03.1.454.CMB.2.raw
  modified_base (450)..(450): a, c, t, g, unknown or other
  modified_base (507)..(507): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctctgcaaggtcttcgtggacttctacgtttacctcctatagtatcaacgtgggtgcgccaggccgcgtggaccaacgacctggacgtggagtggggagtcggggaccgaacccgtaacacgtggtacgtcacgtagtccgtacttccaccctatcccgtaccgggaacacgtaccttaccacgtcgaaccaacgtacctccctaccaaataaaccacagaccctanagtcggagttagaggacgctgactatcgtagaccgtacgacggccttatacttacgngtagacgagcgtacccgagtacgtccgggtgaacgcccgtacggacgtcgccggtccgtttcgaccgttcggtacggggccgaacgggtcccg

SEQ ID NO: 395094 - DNA, 523 bp, Homo sapiens
  misc_feature: GZ8MTXP02H32YS.17.25.C03.1.454.CMB.2.raw
  modified_base (236)..(236): a, c, t, g, unknown or other
  modified_base (281)..(281): a, c, t, g, unknown or other
  modified_base (412)..(412): a, c, t, g, unknown or other
  modified_base (424)..(424): a, c, t, g, unknown or other
  modified_base (461)..(461): a, c, t, g, unknown or other
  modified_base (484)..(484): a, c, t, g, unknown or other
  modified_base (488)..(488): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcnggattcacgtttacctcctatagtatcaactggtgcgcaggccgntggacaacgacctgagtggatggggatggggcaaaccctaacacgtggtgtcacagtcgtcttcgacccatccctccggggacagaccttaccatcgaccacgaactcctaccataaacacacgaccctanatggagtgagancctagactatcgtagacgacacggccgtctaattacngtgaccagcgtccagtagtccgngacnccgacgcagcgcttagcttacgcgggcagggtccg

SEQ ID NO: 395095 - DNA, 745 bp, Homo sapiens
  misc_feature: GZ8MTXP02H6SVA.17.25.C03.1.454.CMB.2.raw
  modified_base (210)..(210): a, c, t, g, unknown or other
  modified_base (230)..(230): a, c, t, g, unknown or other
  modified_base (263)..(263): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctggggcctnagtgagtctctgcagcttcnggattcacgttacctctatagtatcaactggtncgcaggccgctggacacgacctggagtggagtggggatcggggacgaaaccctaacacgtggtgtaccaacgtagttcgtccttaccaacccacgttccccgtaccggggaacacggtaaaccctttaacccaagttaccggaacccctaaccggtaaaacccttccccctaaccctaaaataaaaacccaccgtaacgtacccccttaaacgtaagttacgggggtaaacggtttacggggaaacggggtacgtacccgtttaacgggaacccttaaacgttcccggttaacggaaaccccggtaacccggaacccgggggttacccccggtttaactttaacgttttaaccggtggttaccggaccggtaacggtaccgttaccccgaacggtaccgttaccgggtacgacggtacccgtacgggccacgggtcccggtcctttacggaccgttcggtacgggggcctaagggggtcccg

SEQ ID NO: 395096 - DNA, 562 bp, Homo sapiens
  misc_feature: GZ8MTXP02FYPRJ.17.25.C03.1.454.CMB.2.raw
  modified_base (281)..(281): a, c, t, g, unknown or other
  modified_base (308)..(308): a, c, t, g, unknown or other
  modified_base (335)..(335): a, c, t, g, unknown or other
  modified_base (359)..(359): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccaggtgtgacatccagatgacccagtctccatcctccctgtctgcctcgtggtgggggtcagagtcaccatcacttgccggacaagtcacggtacgttaaaacctatttaaatggtatcagcaagaaacctaggaaaacnccccaagaccctcctgactctctggtncatcccactctgcgaagtcggctcccngtcgaggttcagtgcagtgatcgngggacagtatttacaatctacaccatccaccactctacgactaacctgagtacttgtcgactaatctacgtactgtacaacgtagtacgttaacctcgttacccctgtacttacgtttcggaccgtaacgggtaacctaaggttagaacgtaatacgaaacgtacgtggtcgaactgacctactacgttctacgttcttaccg

SEQ ID NO: 395097 - DNA, 609 bp, Homo sapiens
  misc_feature: GZ8MTXP02JQ4V1.17.25.C03.1.454.CMB.2.raw
  modified_base (295)..(295): a, c, t, g, unknown or other
  modified_base (438)..(438): a, c, t, g, unknown or other
  modified_base (449)..(449): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctcctatagtatcaacgtgggtncgccaggccgctggacacgacctgagtggagtgggagtcgggaccgaacctaacacgtggtcgtacacaggtctccttccacccatccgtccgggacacgtaccttaaccatcgaacccacgaacctcccaccaataaaaccncagaccctaanagtagggagttaggaggtacgcccttagaactcttcgaggaccgaccgaccggggtcctacttaacgtttacgtggtacggaccgtaacggaccgtaccccgaaacgtcggtaaccggtacgaccggacccgtacgggaccgtacgggtccggtttcccg

SEQ ID NO: 395098 - DNA, 583 bp, Homo sapiens
  misc_feature: GZ8MTXP02IKS5F.17.25.C03.1.454.CMB.2.raw
  modified_base (211)..(211): a, c, t, g, unknown or other
  modified_base (233)..(233): a, c, t, g, unknown or other
  modified_base (270)..(270): a, c, t, g, unknown or other
  modified_base (336)..(336): a, c, t, g, unknown or other
  modified_base (415)..(415): a, c, t, g, unknown or other
  modified_base (421)..(421): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctnagtgaggtctctgcaggcttcnggtattcacgtttacctctatagtatcaacgtgggtncgccgaggccgcgtggaccaacgcctggagtggagtgggatgggacctaaaccctaacacgtggtntcactgtctacctccacccatcccgtaccggacacgtactaccatcgaacccacgaacctcccacaataaaccacaacncctaanagtaggtagttagaggacacctagaactatcgtagaccgacgtacccggcgtacttagttacgtggtacgacgagaccgtcccgaacgtacgtccggtagaccgtaccgtacggcacggtccggtccgtttacgaccgttcggcggggtaccacgggtcccg

SEQ ID NO: 395099 - DNA, 517 bp, Homo sapiens
  misc_feature: GZ8MTXP02IUUTX.17.25.C03.1.454.CMB.2.raw
  modified_base (272)..(272): a, c, t, g, unknown or other
  modified_base (320)..(320): a, c, t, g, unknown or other
  modified_base (359)..(359): a, c, t, g, unknown or other
  modified_base (394)..(394): a, c, t, g, unknown or other
  modified_base (438)..(438): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgcctgagtggatgggatgggcaaccctanactggtgtcacagtcgtcttcacccatccctccgggacngtacttaccatcgaccacgaactcctacataaacncagcctacatggattgagagctgacatctgacgacacggccgtntattactgtgacgagacgtcccagactccggtgacgccgtacggcagcggtaccttgaccttcgtcggggccagggccg

SEQ ID NO: 395100 - DNA, 749 bp, Homo sapiens
  misc_feature: GZ8MTXP02GRXOJ.17.25.C03.1.454.CMB.2.raw
  modified_base (313)..(313): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccactccctccctgtctcgcctcgtggtgggggtcagagtcaccatcacttgaccggacagtcgacggtacgttaaaaccttaatttaaattggtatcagacaagaaacgtaggaaacgccccagacctctgatctgtggtnctactcccactctcggacgtaaggtcggccgtacccgtagtacggtacggttacccgagggtggacgtagggtaggtacgttcgggtagggggtaactaggttaactttactaaacttacctaccaaccctactaccctaaccctacttaccgtacgtaccctaaaaccgttgggaacgggttaatttcgacgtaaccttaaaacgtttccctttaaacttaaccgttagtaaaccctaaaccgttaaggttaacccgtttaccctacccgggttttccccctacgggtacccgttttaacgggtttaccgggaacccggggtaaaacggggttaaaaccctaaaggtttacggaaacgtaaaaccgttaaaccgaaaaaccgttagttcggtaaccggtactaccgacctaaccttacgtttccgtctttaaccc

SEQ ID NO: 395101 - DNA, 694 bp, Homo sapiens
  misc_feature: GZ8MTXP02J3EJG.17.25.C03.1.454.CMB.2.raw
  modified_base (273)..(273): a, c, t, g, unknown or other
  modified_base (322)..(322): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcgaaccctanacgtggtgtcacagtcgtccttcacccctatcccgtccggggacaggtacctttaacccattacggacccaacgtaaaccttcccctaccaaattaaaacccacaaccggaccccttaacgacgttacgggaacgtttaggaaacggggtacgacccgtttagggaacccgtaaatcccgttaggaccgaaccgtaacccggggtcccgtaccctttaagtttaacccgtggtttacgacggaaacgggtaacttcccccgaacggtaacgttaccccgggggtacgtaccggtacccgtaccggaccgtacggggtcccgttaccgtttacggtaccgtttcgggaccgggggtacccgacggggtcccgg

SEQ ID NO: 395102 - DNA, 852 bp, Homo sapiens
  misc_feature: GZ8MTXP02IXIMU.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcgtgggcctcagtgaaggtctcctgcaaggcttcgtggtattcgtacgtttacctcctatagtatcaacgtggtgcgccaggccgctggacaacgacctgaggtggagtggggagtggggaccaaacccgtaacgacgttggtacgttccaacgtaggttccgttccgtttaccaacccctacgttccccgtacccggggaacacggtacctttaaaccgaacttaccggaacccctaaacggtaaacccttacccctaaaccctaaaacttaaaaacccgacccgtaaacgtacccccttaaaacgtaacggttacggggtaaacgtttaggggaaaaccgggtaccgtaccccgtttaacgggaaaaccctaacgtttacccgggttaacggaaacccccgggaaacccggtaaccccggggtaccccgtttaacctttaaaaccgttttaaccggtgggttaccggaaccgggtaaacggtaaccccgttaacccccggaacggtaaccggttaccccgggggttacgaaacccgggacccgtttaaaccggggccgtaaaccgggttccccggggttaccgtttttacgggtaaaccccggttttcggggtacccggggggtaccccgaaacgggggttccccccgg

SEQ ID NO: 395103 - DNA, 587 bp, Homo sapiens
  misc_feature: GZ8MTXP02GD5WO.17.25.C03.1.454.CMB.2.raw
  modified_base (274)..(274): a, c, t, g, unknown or other
  modified_base (285)..(285): a, c, t, g, unknown or other
  modified_base (323)..(323): a, c, t, g, unknown or other
  modified_base (365)..(365): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaactgggtncgccaggcccntggacaacgcctgagtgatggatggggacaaaccctanactggtgtcacgagtcgtcttaccacctctcccggtaccgancgtaccttacactaccgaccacgtactcccacaaactaaaccagacctaccatagtggtagtacggagacgtcgtagacgtatcgacgacgacgcgtcgtacttactcgtgtcgacgactaccgtacccacggtacgccgggtacgaccgttaccggacggacctagggtcccgttctttacggtaccgttcggggaccggggaccgttaagggggtccccg

SEQ ID NO: 395104 - DNA, 599 bp, Homo sapiens
  misc_feature: GZ8MTXP02HOFKD.17.25.C03.1.454.CMB.2.raw
  modified_base (375)..(375): a, c, t, g, unknown or other
  modified_base (419)..(419): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggtattcacgtttacctcctatagtatcaacgtgggtgcgccaggccgctggaccaacgacctgagtggatgggatcggggacaaaccctacacgttggtgtcacgtagtcgtccttccaccctatcccgtccgggacncgtacttacatcgaccacgactccctacataaacacacgcctanacgtggtagttgaggtacgcctagactagtcgtacgaccgtaccgaccggtcccgtacttaacgtttaccgtggtacggacggaacgacccggttacccgacggtaccgtccgggtagacgtcccgtaacggccgacggtcccggtacttcggtcgttcggtcggggccgagggtacccg

SEQ ID NO: 395105 - DNA, 561 bp, Homo sapiens
  misc_feature: GZ8MTXP02GWD6D.17.25.C03.1.454.CMB.2.raw
  modified_base (367)..(367): a, c, t, g, unknown or other
  modified_base (405)..(405): a, c, t, g, unknown or other
  modified_base (463)..(463): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaaccctaacacgtggtgtcactagtcgtcttccacccatcccgtccgggacncgacttacatcgaccacgaactccctacaataaaaccncacgcctaacatggattgaggacgcctaggacctatcgtagacgtacgacggcccttntattactggtagcgaagtacgtacccagtactccgggagacgtccgtacgggcacggcggtccctttggacctttccggcggggacccgagggacccg

SEQ ID NO: 395106 - DNA, 660 bp, Homo sapiens
  misc_feature: GZ8MTXP02F4133.17.25.C03.1.454.CMB.2.raw
  modified_base (354)..(354): a, c, t, g, unknown or other
  modified_base (368)..(368): a, c, t, g, unknown or other
  modified_base (412)..(412): a, c, t, g, unknown or other
  modified_base (573)..(573): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaagcttctggattcacgtttacctcctatagtatcaactgggtgcgccaggccgctggaccaacgacctgagtggatggggatggggaccgaaaccctaacacgtggtgtcactagtcgtctccaccnctccgtaccgggancgacttaccatacgaccacgtaaacctcctacccaataaaaccncgaacgccttaacaatcgggtaagttcggagggaacgcccgttagacctagtcccgtaggaaccgaccggaaccggggtccccgttattaacgttaacccgttggtacggaccgtaacggaaccgtttccccccggaaaaggtaccgtttaccccgggggntaacccgggtacccgtaacggccgtacgggtcccggtttacctttcggtaccgttcggggaccgggggaacccgtacggggtacccg

SEQ ID NO: 395107 - DNA, 540 bp, Homo sapiens
  misc_feature: GZ8MTXP02H5O1T.17.25.C03.1.454.CMB.2.raw
  modified_base (365)..(365): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacaaccctaacactggtcgtcacagtcgtcttccacccatccgtcgggacngacttaccatacgaccacgaactccctaccaataaacacacgaccacagtggagttgaggagcctagacatctagacgacacggccgtactattactgtgcgagactccacgtagtccgtgacgccgtacggcgacgtccggcctttacgacttcgtcggggccgtacgggcccg

SEQ ID NO: 395108 - DNA, 709 bp, Homo sapiens
  misc_feature: GZ8MTXP02HFC93.17.25.C03.1.454.CMB.2.raw
  modified_base (208)..(208): a, c, t, g, unknown or other
  modified_base (276)..(276): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggctnagtgagtctctgcagcttctggtattctacgtttacctctatagtatcaacgtggtgcgccaggccgntggacacgactggagtggatgggagtgggaccgaaccctacacgtggtactcaactgtccgtcttaccaccctatcccgtccggacagtaccttacatacgaccaacgacctaccctaccaaataaaccacacgacctaacgagtacggtagttacggaacggtacgtccccgttaggaacctaacgttaccgtaacgaacccggtaacccggtaccggggttaccccctttacgttaaaccgttttaccgtcgggttaccggaaccggtaacgtaacccggttaacccccgaaacgggttaaccggttccccggggttaaacggacccggtttacccccggtaaaaccgggtccgaaccggggttccccggtttacccgttttaccggtacggttttacccggcgggggtacccgtaaacgggggtccccgg

SEQ ID NO: 395109 - DNA, 624 bp, Homo sapiens
  misc_feature: GZ8MTXP02JGT77.17.25.C03.1.454.CMB.2.raw
  modified_base (237)..(237): a, c, t, g, unknown or other
  modified_base (274)..(274): a, c, t, g, unknown or other
  modified_base (327)..(327): a, c, t, g, unknown or other
  modified_base (333)..(333): a, c, t, g, unknown or other
  modified_base (438)..(438): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattctacgtttacctctatagtatcaacgtgggtncgccaggccgctggaaccaacgacctgagtggatgggatgggaccaaccctanctggtntcactagtcgtcttaccaccctatcccgtaccgggacacgaccttacatacgaccacgacctccctaccaataaaccacacgcctaacagtaggagttgaggacnccgtagacagtctacggacgaccgaccggtaccgttctaacgtttaccgtggttacggccgtaaaggtacccgtaccccgaacggtacgttcccggggagaaccggtcccgtaaccgggcgaacgggtccggttcccgtttacggtacccgttcggggtaccgggggaccggtaacggggccccgg

SEQ ID NO: 395110 - DNA, 589 bp, Homo sapiens
  misc_feature: GZ8MTXP02GE347.17.25.C03.1.454.CMB.2.raw
  modified_base (300)..(300): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacgttaaaacctatttaaatggtatcagcagaaactggaaacgccccagacctcctgatctctggtncatccactctgcgaagtcggccgtccatcgagttccagtgcagtgatcgtgggacagtatttacaatctacaccatccaccactctcgacctaaaccgtgtaaggtatttgacgactaaattcctaacttacgtgtacaaacgtagtaacgtttacaccgtttcccctcgtacttacgttttcgggacccgtaacgggggtaaccctaaaggttcgaaagtaacgttaaccgaaaacgtaacgttacggtaacggtcctacggacctaaccctagttcctcgtttaccc

SEQ ID NO: 395111 - DNA, 706 bp, Homo sapiens
  misc_feature: GZ8MTXP02F7A9I.17.25.C03.1.454.CMB.2.raw
tcagcgtagactagcacgaccggtgctcgatttagtagtgtagatttgggtttggggaaccacatctgtcctctagagaaaaccctgtgagcacaactcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgctggacaacgacctgagtggatgggatcggggaccgaaacccctaacgacgtgggtcgtacacgtaggtcgtcccctttaccgaccccacttcccccgtacccggggaacctacggtaccctttaccaacttacggaaaccccaaccgtaaacctcccctaaccaaactaaaaccaccacgaccctaacagtaggacgttaggaggtacgcctaggaacacgtcgtacggaccggaaccaaccggggtcccttacttaacgtttaccgtggttacggcggtaacggtaccgttacccccaacggtacgttcccggggttagaaaccgtccccggttaacgggccgacggggtccccggttaaccgtttttcggaacccgttttcggggaccgggggacccgacgggggtaccgttcccccgggg

SEQ ID NO: 395112 - DNA, 533 bp, Homo sapiens
  misc_feature: GZ8MTXP02GLT2B.17.25.C03.1.454.CMB.2.raw
  modified_base (300)..(300): a, c, t, g, unknown or other
  modified_base (310)..(310): a, c, t, g, unknown or other
  modified_base (369)..(369): a, c, t, g, unknown or other
  modified_base (403)..(403): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtaatcagcagaaacctggaaaagccccagaccctcctgatctctggtncatccactcngcgaagtggcgtcccatcgaggttccagtgcagtggatcgtgggacagatttcaattcncacatacaccactctgcaacctgagattgtaganaatactactactgtacaaacagtacgttactacgttcccctcgctacgttttcggaccgtaacggggaacctaaaagttcgaagaactacaaaaccgaatcggtaaggctacggcaccgtatcctgttcc

SEQ ID NO: 395113 - DNA, 544 bp, Homo sapiens
  misc_feature: GZ8MTXP02I43GW.17.25.C03.1.454.CMB.2.raw
  modified_base (272)..(272): a, c, t, g, unknown or other
  modified_base (321)..(321): a, c, t, g, unknown or other
  modified_base (328)..(328): a, c, t, g, unknown or other
  modified_base (362)..(362): a, c, t, g, unknown or other
  modified_base (390)..(390): a, c, t, g, unknown or other
  modified_base (395)..(395): a, c, t, g, unknown or other
  modified_base (402)..(402): a, c, t, g, unknown or other
  modified_base (413)..(413): a, c, t, g, unknown or other
  modified_base (440)..(440): a, c, t, g, unknown or other
  modified_base (447)..(447): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattcacgtttacctcctatagtatcaacgtgggtncgccaggccgctggacaacgcctgagtggatgggatgggacaaccctancgtggtntcatagtcgtccttcacccactcccgtccgggancgacttaccatcgaccacgactccacanaaacncagctanatggatgaganctagacatcgtagacgacacggtcctntattcgngtcgcgagaccgtacccaggtcgtcccgggtagacgtcccgtaacggccaggtccggtacctttcgaccgtttcggcgggggacccgaggggtcccg

SEQ ID NO: 395114 - DNA, 589 bp, Homo sapiens
  misc_feature: GZ8MTXP02GTDHF.17.25.C03.1.454.CMB.2.raw
  modified_base (286)..(286): a, c, t, g, unknown or other
  modified_base (367)..(367): a, c, t, g, unknown or other
  modified_base (383)..(383): a, c, t, g, unknown or other
  modified_base (462)..(462): a, c, t, g, unknown or other
  modified_base (486)..(486): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttcgtggattcacgtttacctctatagtatcaacgtgggtgcgccaggcccncgtggaccaacgcctggagtggagtggggatggggaccaaaaccctacgacgtggtgtcacgtagtacgtcctccaacccntcccgtccggggaacncggtaccttaccatcgaacccacgtaaacctcctaccaaataaaaccacgtacgaccctaacagtcggagttggaggancctagacatctgacacgacgcgtntactacgtgtgcgacgacgtcccgacgtacgtccggtagaccgtccgtacggacgcggtccggttccgttcgtacgtttccggcgggacccggtaggacccgg

SEQ ID NO: 395115 - DNA, 633 bp, Homo sapiens
  misc_feature: GZ8MTXP02G2290.17.25.C03.1.454.CMB.2.raw
  modified_base (236)..(236): a, c, t, g, unknown or other
  modified_base (271)..(271): a, c, t, g, unknown or other
  modified_base (282)..(282): a, c, t, g, unknown or other
  modified_base (304)..(304): a, c, t, g, unknown or other
  modified_base (319)..(319): a, c, t, g, unknown or other
  modified_base (366)..(366): a, c, t, g, unknown or other
  modified_base (409)..(409): a, c, t, g, unknown or other
  modified_base (418)..(418): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttcnggattcacgtttacctctatagtatcaactgggtncgccaggccgntggacaacgctgagtgagtggntgggacaaccctaancgtggtctacagtagtcgtccttccgaccctatcccgtaccgggacncgtaccttaccatacgaccacgaacctccctacaataaaccanacgcctaanagtcggagttgacgggactccgtaggacctatccgtagaacccgcgtaaccggtcccgttacttaacttacggtcggcgacggtaacgacccgttaacccggacgtaacggtcccggggtaggaccgtaccccggtaacggcccgtaacgggtcccggttacccgttttacgggacccgtttcgggaccgggggtacccgacgggggttaccccg

SEQ ID NO: 395116 - DNA, 701 bp, Homo sapiens
  misc_feature: GZ8MTXP02HL5N4.17.25.C03.1.454.CMB.2.raw
  modified_base (274)..(274): a, c, t, g, unknown or other
  modified_base (333)..(333): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatccctcttcttggtggcagcagctacaagtgcccactcccaggtgcagctggtgcagtctggggctgaggtgaagagcctggggcctcagtgaaggtctcctgcaaggcttctggacttcacgtttacctctatagtatcaacgtggtncgccaggccgctggaccaacgacctggacgtggagtgggagtcgggaccaacccgtaancgtggtctcaactggtccgtccttccacccgtattcccgtaccggggaacacggtacctttaaccagtaccgaaccctaaccgaaccttccctaccctaaataaacccacgacgtaccctaacacgttaggggacgtttaggaacgggtacgtccgtaaggacctacgttacgttacggaacccgtaacgtaacccggggtcccgttactttaacgttaccgttggtaccggtaccggaacggtacccgttacccccgaacgggtaccgttcccgggagttacccggacccgttaaccgggtccgacggtcccggggttcctttacggacccttttcggggcccggggtaccgtacgggggtaccccg

SEQ ID NO: 395117 - DNA, 778 bp, Homo sapiens
  misc_feature: GZ8MTXP02JLOA6.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattctacgtttacctctatagtatcaacgtggtgcgccaggccgctggacacgacctgagtggagtgggagtggggaccgaaaccctaacgacgtggtcgtacacgtagtccgtcttaccgaccctacttaccccggtccggggaaccctacggtaaccctttaaaccgaacgttaccgaaccccgtaacccgtaaacccttcccctaacccaaacttaaaacccaaccgtaaccgacccttaaacgaagtacgggtaaggtttacggaaaggggacctcccgttaaggaaccctaagttcccgttacgaacccggaaccgaaccgggttaccccggtttaacttaaccgtttacggttcggttaacgggccggtaaaacgtcccggtttaacccccgaacggtaaccggtttccccggggtagggaacccggtacccccggttaaaccggggccggtaaccggggtcccggttccccgtttttacgggaacccggttttccggggaccgggggtacccggaacgggggtacccccgg

SEQ ID NO: 395118 - DNA, 723 bp, Homo sapiens
  misc_feature: GZ8MTXP02JCQSW.17.25.C03.1.454.CMB.2.raw
  modified_base (275)..(275): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggattcacgtttacctcctatagtatcaacgtgggtncgccgaggccgctggacaacgacctgagtggatggggagtggggaccgaaaccctacacgttggtcgtaccacgtacggttccgttaccttaccacccctacgttccccgtacccggggaactaccgggtaaaccctttacccgaacgttaccggaaacccccgtaaaccggtaaaccccctttccccgtaaacccctaaaacttaaaaaccccacccgtaaaccgtaccccttaaccgaagttacggggtaagtttacgggaagggaaccggtcccttaggaacctacgttccgtacgaacccgaccgaccggtcccgttactactttacgtggtcgacgacgtaccgtacccgacggtacgtccgggtgaccggtaccgtaaccgggctacggtccggttccctttaggtacccgttcggggccggggaccggtagggtaccccgg

SEQ ID NO: 395119 - DNA, 618 bp, Homo sapiens
  misc_feature: GZ8MTXP02IH5Z3.17.25.C03.1.454.CMB.2.raw
  modified_base (211)..(211): a, c, t, g, unknown or other
  modified_base (268)..(268): a, c, t, g, unknown or other
  modified_base (416)..(416): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcgtgggcctnagtgagtctctgcaggcttctggattcacgtttacctctatagtatcaacgtggtcncgccgaggccgctaggacaacgcctggaggtggagtgggatcgggaccaaccctagcgtggtgtacacgagttcgtcctaccacctactcccgtaccggacacgtacttaccataccgaaccacgaacctccctaacaaactaaaccncacaccctactagtagggtaagttaggacggacgctagacctatcgtacgaccgtaacgaccggtcctacttaacgttacgtggtacgacgaacgtacccgtcccgacggtacgtaccggtacgaacggtccccgtaacggccgacggtaaccggttcccgttacggtaccggttcggtccggggaccgtacggggtcccgg

SEQ ID NO: 395120 - DNA, 592 bp, Homo sapiens
  misc_feature: GZ8MTXP02IUFO5.17.25.C03.1.454.CMB.2.raw
  modified_base (275)..(275): a, c, t, g, unknown or other
  modified_base (287)..(287): a, c, t, g, unknown or other
  modified_base (300)..(300): a, c, t, g, unknown or other
  modified_base (361)..(361): a, c, t, g, unknown or other
  modified_base (369)..(369): a, c, t, g, unknown or other
  modified_base (402)..(402): a, c, t, g, unknown or other
  modified_base (425)..(425): a, c, t, g, unknown or other
  modified_base (586)..(586): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatcctccctgtctgcctctggtgggggtcagagtcaccatcacttgccgacagtcacggtacttaaaactattaaatggtatcagcaagaaacctaggaaacnccccagacctcngatctcgtggtcncatccactctaggacgaaggtcggccgtccagtccgtaggttcccgagtgcaggtgatcgnggacagtnttacaatctacaaccactaccacctactcgtanaccaacgtgacggtattcggtanactaaattccttaactaccgttagaacctaaacgtaacgtacgttaaccgtacccgttacccctcgtaccttaacgtttaccggaacgtaacggggaaactaaagggtcaaagtactaaacgaaaccgtatacggtcgtacacgtaccaactcttaccgtnttaccc

SEQ ID NO: 395121 - DNA, 746 bp, Homo sapiens
  misc_feature: GZ8MTXP02IUAB3.17.25.C03.1.454.CMB.2.raw
  modified_base (276)..(276): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtgggcctgagtgagtctcgtgcaggtcttcgtggtattctacgttacctctatagtatcaacgtgggtcncgccgaggcccgcgtcggaacaacgaccgttggacggtggagtggggagtcggggacccgtaaaaccctacgtacgtgggtcgtacacgtagttccgttcctccgacccctattccccgaccggggaacacggtaaccctttaaccgacgttaccggaacccaaccgtaaacccttcccctacctaaactaaaaccacccgtaaccggacccttaaacgacggttaacggggaaggtttacggaaacggggtcgtaccccgtaagtaaacccgtacgttacgtacggaaccggaccccgtaaccggggtcccttaacttacgttaaccgtggttcgacggtaacgtaacccggtacccgacggtaccgtcccggggtacgtaaccgggtcccgtaaacgggtcctaacggggtccgtttacccgtttacgtaccggttcgggacggggtacccggaacggggtcccccgg

SEQ ID NO: 395122 - DNA, 686 bp, Homo sapiens
  misc_feature: GZ8MTXP02J2FVN.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtccagctggtgcagtcgtggggctgaggtgaagaagccgtggggcctcagtgaaggtcctcctgcgaaggtcttcgtggattcgtaaccgttttacctccttatagtactcgaacgtgggtcgccgccgaggcccgcgtacggaaccacgaccgtgacgtggagtgggagtcggggaaccgtaacccctaacgacgttggtcgtaccacgtaggtcgttcccctacccgaccctacgttccccgtacgggaaccacgtacccttacgactcgaaccctaaccgaaccttacccacctaaagtaaaacccacaaccgtacccttaacgaagtcgggtattacgggaacggtacgaccttaggaacctagttccgaacggaccgaaccgttccggtcccgttactacgttaccgtggtacgcggtaacgaccgtcccgaacggtacgttccggaggaccgtaccgccggacaccggtcgtccgtttacgccgttcggtaccgggccgaacggggctccccgg

SEQ ID NO: 395123 - DNA, 608 bp, Homo sapiens
  misc_feature: GZ8MTXP02FEKSM.17.25.C03.1.454.CMB.2.raw
  modified_base (223)..(223): a, c, t, g, unknown or other
  modified_base (322)..(322): a, c, t, g, unknown or other
  modified_base (468)..(468): a, c, t, g, unknown or other
  modified_base (589)..(589): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctcctgtctgcctcgtggtgggggtcagagtcaccatcactcgccgganaagtcaacggtacgtttaaaactatttaaatggtatcagacaagaaaacctggaaaacgccccagacctcctgactctcgtggtcactactccacttcnggacgaaggtcggaccttcccgaagttcccggtaaggttcccagggttcgacgtaggttaggactcggtaggggacctaagttactttacaattccgacacctactaccgaaccctactaccgactaaaccgtgacggtattcggnactaactcctaacgtactcgtaacaaacgtacgtagttaccctacgttcccctgtacttacgttacggaccgaaacggggtaacctaaaggtgaacgtataacgaaacgtacgtgtcgctnacctactctctctcttacc

SEQ ID NO: 395124 - DNA, 552 bp, Homo sapiens
  misc_feature: GZ8MTXP02I84JX.17.25.C03.1.454.CMB.2.raw
  modified_base (253)..(253): a, c, t, g, unknown or other
  modified_base (272)..(272): a, c, t, g, unknown or other
  modified_base (321)..(321): a, c, t, g, unknown or other
  modified_base (328)..(328): a, c, t, g, unknown or other
  modified_base (356)..(356): a, c, t, g, unknown or other
  modified_base (421)..(421): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactggtncgccaggccgctggacacgacctgagtggatgggatgggacaaccctanactggtntcacagtcgtctcaccatcctccggacngacttaccatcgaccacgaactcctaccaataaacacacgaccttaacatcggagttagaggacncctagacatcgtgaccgacgaccgccgtatacttacgtgtcgcgtagaccgtacccgagtacgtcccggtagaacgcccgtaacggcgacggccgtccgttacgacttcggtcggggccgaaggggtcccg

SEQ ID NO: 395125 - DNA, 624 bp, Homo sapiens
  misc_feature: GZ8MTXP02FNJFL.17.25.C03.1.454.CMB.2.raw
  modified_base (237)..(237): a, c, t, g, unknown or other
  modified_base (277)..(277): a, c, t, g, unknown or other
  modified_base (337)..(337): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcagtgaaggtctcctgcaaggcttntggattctacgtttacctcctatagtatacaacgtgggtncgccaggccgcgtggaccaacgacctggacgtggatgggagtcgggaccgtaaaccctanacgtggtgtcactagtcgtctccacccgactcccgtaccgggaactacgaccttaccattacgaacccaacgtaaacctccctaaccaaactaaaacccacaacgacccgttaacagtcggtaagttaggaaggacgcctaggaacatcgtagaccgacgaccgggccttactattacgtcgtgacgtaagggtactcccgacgtacggtcccgggtagcgtacccgtacggccgtaggcccggttaccgttcggaccgtttcggacggggcccgtaacggggcccg

SEQ ID NO: 395126 - DNA, 648 bp, Homo sapiens
  misc_feature: GZ8MTXP02G0OBM.17.25.C03.1.454.CMB.2.raw
  modified_base (584)..(584): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttactctactagtatcactggtgcgcacggccgctcggacaacgacctgagtggagtgggagtcggggacgaacccgtaaacacgtggtgtcacagtcgtcttcacccactccgtccggacacgtaccttaccactacgacccaacgaaacctccctaccaaataaaaccaacacgaccttacctaagtcgggtaagtttgggaaggacgcccgttagaaccgtaatctacgacggaaaccgtacggggtacccttacgttactttaaccgttggtccggacgaacgggtacgtcccctaaacgacggtccggttacggacgtaccgtacccggganaaccggtccggtccccgttttgtaacccggttttcggaccgggggtacgaccggggtacccggg

SEQ ID NO: 395127 - DNA, 569 bp, Homo sapiens
  misc_feature: GZ8MTXP02IBEVT.17.25.C03.1.454.CMB.2.raw
  modified_base (275)..(275): a, c, t, g, unknown or other
  modified_base (370)..(370): a, c, t, g, unknown or other
  modified_base (481)..(481): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggtattcacgtttacctcctatagtatcaactgggtncgccaggccgctggacaacgacctgagtggatggggatggggacaaaccctaacactggtcgtcactagtcgtcttccacccatcctccgggacncgacttacatcgaccacgaactccctacccaaataaaccacacgaccctaacatacgggagttgaaggacgcctagactatctagacgtacgacggtcccgtatattacgngttgcgagacgtccccagtactccggttgacgacccgtacggacacggtccggtctttacgaccttcggtcggggccgtaagggcccg

SEQ ID NO: 395128 - DNA, 561 bp, Homo sapiens
  misc_feature: GZ8MTXP02GZV9N.17.25.C03.1.454.CMB.2.raw
  modified_base (271)..(271): a, c, t, g, unknown or other
  modified_base (321)..(321): a, c, t, g, unknown or other
  modified_base (328)..(328): a, c, t, g, unknown or other
  modified_base (358)..(358): a, c, t, g, unknown or other
  modified_base (423)..(423): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatggatgggcaaaccctaanactggtntcactagtgtcttcacccatcctccggganacgacttaccatcgaaccaacgaaacctcctaccaataaaccacagcctacatgagttgaaggancctgactatctgacgacaccggcctctattactgtgcgaagacgtcccacgtaatcccgggtagaacgtcccgtaacggcgaacggccgggtccccttttaggacccgtttcgcggggggtaccccagggggaaccgg

SEQ ID NO: 395129 - DNA, 658 bp, Homo sapiens
  misc_feature: GZ8MTXP02GP0PH.17.25.C03.1.454.CMB.2.raw
  modified_base (331)..(331): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggtcttctggattcacgtttacctcctatagtatcaactgggtgcgccaggccgcgtggaccaacgacctggagtggagtgggatcgggacgaaccctanacgtggtgtcactagtcgtccttccaacccatccccgtaccgggacagtacctaccagtccgaacccacgaacctccctaccaaataaaccacacgcctaacatggacttggagacgcctagactagtccgtagaaccgaccgtaaccgggcccttacgttaactttacggtaggtacgaccgaaacggtcggttacccccgacgggtaccgttcccggggtaagaccgggtacccccgttaacggggccgtaacgggtccccgggttccgttttaacgggtacccgtttccggtaccggggggacccttaacgggggtacccccgg

SEQ ID NO: 395130 - DNA, 645 bp, Homo sapiens
  misc_feature: GZ8MTXP02FYLHG.17.25.C03.1.454.CMB.2.raw
  modified_base (223)..(223): a, c, t, g, unknown or other
  modified_base (257)..(257): a, c, t, g, unknown or other
  modified_base (299)..(299): a, c, t, g, unknown or other
  modified_base (423)..(423): a, c, t, g, unknown or other
  modified_base (435)..(435): a, c, t, g, unknown or other
  modified_base (443)..(443): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctcgcctctggtgggggtcagatcaccatcacttgccgganaagtcacggtacttaaaactatttaaatggtatnagcagaaactaggaaacgcccagacctcctgactctctggtnacactcccactcgtcgacggaaagtcgggacccgtcccagtccggtaggttccgaggtgacaggtagacttcgtggggacaaggttactttacgaacttctaccacctatacccacctacttcncgacctaaacgngtaacgtntagtacgctaaaacttcctaaacttacctaggtaccctaaaacgtaggttaaccgtttaaccttaccggtttccccgttaacgtcctttaccgggtttacggaccccggtaagggggtaaccctaaaaggttgaaacgtaacggtaacctaaaacggtactggtaacggcttacggacctacctacgtttcctacgtttccc

SEQ ID NO: 395131 - DNA, 584 bp, Homo sapiens
  misc_feature: GZ8MTXP02JZH59.17.25.C03.1.454.CMB.2.raw
  modified_base (222)..(222): a, c, t, g, unknown or other
  modified_base (299)..(299): a, c, t, g, unknown or other
  modified_base (420)..(420): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcacatcacttgccgganagtcacggacttaaacctattaaatgtatcagcagaaacctggaaaacgccccagtaccctctagatctcgtggtcncatccactctgcgaagtcgctccatcgtaggttccagtgctagtggatcgtgggacagtactttacaattcctacgaccacttaccaaccctcttctcgacctaaccgtgaggtattgtanactaaatcctactacttagtaccaaagtacgtacgttaccgtacgttcccctacggtccttaacgttttcggaaccgtaacgggggtaaacctaaaggtacgaagtacgtaacgaaaaccgtaacgtcggtcggacttacgaccaaccttctccgtttactacg

SEQ ID NO: 395132 - DNA, 563 bp, Homo sapiens
  misc_feature: GZ8MTXP02GUR31.17.25.C03.1.454.CMB.2.raw
  modified_base (365)..(365): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatgggcgaaccctaacacgtggtgtcacgagtcgtcttccacccatccgtccgggacngtaccttaaccatcgacccaacgaacctccctacaataaaaccacacgacctacagtggagttgaggacgcctagacagtctgacgaccgaccggccgtactaattcgagtcgcgtagacgtacccgacgcgtcccgggtgacgtcccacggcacggtccgtactttcggacttcggtcggggaccgaggggtacccg

SEQ ID NO: 395133 - DNA, 650 bp, Homo sapiens
  misc_feature: GZ8MTXP02JIY6F.17.25.C03.1.454.CMB.2.raw
  modified_base (552)..(552): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctccgtgcaaggtcttcgtggtacttcctacgttttaccctccgttaatagtacttcgaacgttggggtcgcgccaggcccgcgtggaaccaacggacctggacgtggagtggggatcggggaccgaaacccctaacgcgttgggtcgtcgaacgtagttccgtccttaccgacccctatccccgtacgggacacgtaccttaccgatccgaaccacgaaacctcccaccaaagtaaaccacacgacccttaagagtacggtagttacggaagacgtccctagacctagtcgtacgaccgaccgaccgggtcccttatagtttaccgngtacgcgtaacgccgtacccgagtccgtaccggagaccgtaccgacggcgtacgtccgttcgtttacggaccgttcggacggggtaccgacgggtccg

SEQ ID NO: 395134 - DNA, 595 bp, Homo sapiens
  misc_feature: GZ8MTXP02GUWRO.17.25.C03.1.454.CMB.2.raw
  modified_base (272)..(272): a, c, t, g, unknown or other
  modified_base (323)..(323): a, c, t, g, unknown or other
  modified_base (370)..(370): a, c, t, g, unknown or other
  modified_base (480)..(480): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtncgccaggccgctggacaacgcctgagtggatgggatgggacaaaccctaanacgtggtgtcacgagtcgtccttcgaccccatccccgtccgggaacncgtaccttaccatcgacccacgaaacctccctaccaaactaaaccacaacgcctaacagtggattgagacgcctagacagtctagacgacgacggcccgtactattacgngtcgacgtagactacccgacgtacgttcccggagtaccgaccgtaaccggccgtaacggccggttcccctttacggaccgtttccggacgggggtacccgaacggggttccccgg

SEQ ID NO: 395135 - DNA, 551 bp, Homo sapiens
  misc_feature: GZ8MTXP02F2LKT.17.25.C03.1.454.CMB.2.raw
  modified_base (275)..(275): a, c, t, g, unknown or other
  modified_base (299)..(299): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaatggtatcagcagaaacctggaaaanccccagacctcctgatctctggtncatccatctgcgaagtcggctcccatcgagttccagtgcaggtgatcgtggggacaggtatttcaatctacaccatcaccactctgcaacctgaggtattcgtagactaattactaactactcgtacaaacagtacgttactacgttcccctcgtcctacgttttcggacccgtaacggggtacctaaaggttacgaaggtaactaccgaaaacgtacgtacgtggactacggcaccgtactctcgtttccg

SEQ ID NO: 395136 - DNA, 663 bp, Homo sapiens
  misc_feature: GZ8MTXP02GOQ4V.17.25.C03.1.454.CMB.2.raw
  modified_base (427)..(427): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctcagtgaagtctctgcaaggcttctggattcacgtttacctctatagtatcaacgtggtgccgccaggcccgcgtggaaccaacgacctggagtggagtgggagtcgggaccgaaaccctaacgacgtggtacgtcaacgtagtccgtcttccgacccactcccgtaccggacacgaccttacagtcgaccacgtaacctccctaccaaataaaaccncaacgtaccctacgaagtcggaagttcgaagggactcccgtagactaacgttcgtacggaaacccgacgaccgggtacccgttacttaaattccgtaggtccgaggacgtaccgtaccccgaacggtaccggttccggggtacgaaccggtcccgaaccgggtcaacggggtcccggtttacccttttacggacccggtttcgggtaccgggggaacccgtaacggggggtccccg

SEQ ID NO: 395137 - DNA, 502 bp, Homo sapiens
  misc_feature: GZ8MTXP02F8XLA.17.25.C03.1.454.CMB.2.raw
  modified_base (345)..(345): a, c, t, g, unknown or other
  modified_base (476)..(476): a, c, t, g, unknown or other
tcagcgtagactagcacgaccggtgctcgatttagtagtgtagatttgggtttgggaccatatttggactcaacaaccacatctgtcctctagagaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttactcctatagtatcaactgggtgcgccaggccgctggacaacgacctgagtggatgggatggggcgaaccctaacactggngtcacagtgtctcacccatcctccgggacagacttaccatgaccacgaactcctcataaacacagcctacatggattgagagcctgacatctgacacacggccgtctattactgtgcgagacgtcccaganccggtgacgcctacggcagcggtccg

SEQ ID NO: 395138 - DNA, 600 bp, Homo sapiens
  misc_feature: GZ8MTXP02HDOMF.17.25.C03.1.454.CMB.2.raw
  modified_base (215)..(215): a, c, t, g, unknown or other
  modified_base (273)..(273): a, c, t, g, unknown or other
  modified_base (283)..(283): a, c, t, g, unknown or other
  modified_base (401)..(401): a, c, t, g, unknown or other
  modified_base (439)..(439): a, c, t, g, unknown or other
  modified_base (444)..(444): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctnagtgaaggtctcctgcgaaggtcttcgtggtattcctacgtttaccctctaatagtanctaacgtggncgaccgaggccgcgtaggaaccaacgcctgagtggaagtgggatcggggaacctaaaccccgtaagacgttggtacgtaccagtacgttcgtccttacacccacgtccgtaccggaanagtaccttacgatccgaaccacgtaacctcaaccaaanaaacncacgtacagtagtaggtagagagacactagactactacgtacgacgacgaccgtacgtactacgtacgtcgtacgacgacgacgtaccgtacgtacgtcgtacgacgaccgtacgacgacgtcgtcgttacgtacgtcggtacggacggacggtcg

SEQ ID NO: 395139 - DNA, 563 bp, Homo sapiens
  misc_feature: GZ8MTXP02HHJX0.17.25.C03.1.454.CMB.2.raw
  modified_base (329)..(329): a, c, t, g, unknown or other
  modified_base (373)..(373): a, c, t, g, unknown or other
  modified_base (411)..(411): a, c, t, g, unknown or other
  modified_base (470)..(470): a, c, t, g, unknown or other
  modified_base (481)..(481): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccctctatagtatcaacgtggtgcgccaggccgctggaccaacgacctgagtggatggagtgggaccgaaacccctaanacgtggtcgtcactagtcgtcttccaccctatccctccgggacngtaccttacatcgaccacgaactcctaccataaaaccncacgaccaacatgagtgagacgctgactatcgtagacacgaccgtccgtactacttacnggtcgacgaanacgtacccgagtacgtcccggtagaaccgccgtaacggcgtaacgcggtccttacgtacttcggcgggccgtaacgggcccg

SEQ ID NO: 395140 - DNA, 713 bp, Homo sapiens
  misc_feature: GZ8MTXP02HTO8N.17.25.C03.1.454.CMB.2.raw
  modified_base (209)..(209): a, c, t, g, unknown or other
  modified_base (229)..(229): a, c, t, g, unknown or other
  modified_base (246)..(246): a, c, t, g, unknown or other
  modified_base (266)..(266): a, c, t, g, unknown or other
  modified_base (328)..(328): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggcctnagtgagtctctgcaggcttntggattcacgtttaccnctatagtatcaacgtgggtncgccaggcccgctggaacaacgacctggacgtggatggggatcggggaccaaacccgtaaanacgttggtagtccaagacggttcgtcctttaccaacccctacgttcccgtacccggggacacggtaactttacccagttaccgaacccacgtaaacctccctacctaaacttaaaacccgacaacgaccctaacctagtacgggtaagttagggaacggaacgtcccgttaggaaccctaaacgttccggttaacggaaccccggtaaccgacccgggggtacccgttaccgttaactttaaccgtgggttaccgacggtaacggtacccggttaccccaaacgggtaccgtaccggggtacgaccggtacccgtaacggccgtaacgggtccggtcccgtttacggtaccgtttcggtaccgggggacccgtaggggaccccgg

SEQ ID NO: 395141 - DNA, 751 bp, Homo sapiens
  misc_feature: GZ8MTXP02JU9GD.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctcctatagtatcaacgtgggtgcgccacggccgcgtaggaaccaacggacctggacggtggagtggggagtcggggaccgtaaacccctaaacgaccgttagggtcgtaccgaacgtaggttcccgttaccttaccgacccctaacgttccccgtacccggggaacacggtaaccttaccgattaccgaacctaaccgaaaccttccctaacctaaactaaaaccaccgtaacaccctaacctaagttacgggaacgtttaggaacggtacgaccgttacggaactaacgttaccgtaaggaacccgtaaccgggaaccggtacccgtttaccgttaacgtttacggtcgtacggtaccggaaacgtaccgttaccccgacggttaccgtacccggggtacgtacccggtaccgtaaccggggacacgggttcccggtcccggtttacggtaccggtttaccgggtcgggggtaccccggaagggggttacccccgg

SEQ ID NO: 395142 - DNA, 688 bp, Homo sapiens
  misc_feature: GZ8MTXP02GRV5R.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatgggacaaccctaacactggtgtcacagtcgtccttcacccatcccgtaccgggacagtaccttaaccatacgaacccaacgaacctccctaccaaataaaaccacacgtaccctaacacgtggtaagttggaagggtaacgccgttacggaactacgttcgtacggaacccgaaccgaaccggggtaccccgttacttaaacgtttaaccgtggttacggaccggaaacggtaacccgttacccccgaaacggtacgttaccccggggttaggaacccggacccgtaaaacccgggtccgaaacgggtcccggggttacccgttttacggtaacccgttttccggtccggggggtaccccgaagggggtaacccccggg

SEQ ID NO: 395143 - DNA, 578 bp, Homo sapiens
  misc_feature: GZ8MTXP02G1YWM.17.25.C03.1.454.CMB.2.raw
  modified_base (369)..(369): a, c, t, g, unknown or other
  modified_base (404)..(404): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatggggacgaaccctaagacgtggtgtcactagtcgtccttcaccctatcccgtccgggacncgacttaccatcgaccacgaactcctacataaacncagccctacagtcggagttggaggacgccctagacctagtccgtgaaccgacgacggccgttactacgttacgtcgtgacgaagtaccgtacccacggtacgtcccgggtagaccgcccgtaacggcgtacggcgtcctttacgtacgttcgccgggggaccgaaggggtcccg

SEQ ID NO: 395144 - DNA, 619 bp, Homo sapiens
  misc_feature: GZ8MTXP02HQ6QO.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgacctgagtggatggggatggggacgaaccctaacgacgtggtgtcactaggtcgtccgtttcacccctactcccgtcccggggaacacggtacctttaaccatcgaacccacgaaacctccctaccaataaaccacacgccctaacatcgggtattggaggtagcctgacattctcgacgaccgaccgtccgtacttacgttacctggtcgcgtaagaccgttccccgaacgtcgtacccgggtgaaccggccgttaccgggaccgaacggtcccggtccctttacggtaccggtttccgacgggggtaccctagggggtcccgg

SEQ ID NO: 395145 - DNA, 672 bp, Homo sapiens
  misc_feature: GZ8MTXP02IUAG3.17.25.C03.1.454.CMB.2.raw
  modified_base (375)..(375): a, c, t, g, unknown or other
  modified_base (430)..(430): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattctacgtttacctcctatagtatcaactggtgcgccaggccgctggacaacgacctggagtggatgggagtggggaccgtaaaccctaacacgtggtgtcacgagtcgtcttcacccatcccgtaccggacngtaccttacgatccgaaccacgaacctccctaccaaataaaccacacgccctaanacgtggacgttgaaggcgactagactatacgtagaaccgaccgaccggtcccgttacttaattaccgtggttacgaccggtacgtaaccggtaccccgaacggtaccggttacccggggtacggaaaccggtcccccggttaaaccggggccgtaaccgggtaaccccgggtttcccgtttttacgggtaacccgttttccggggaccggggggttaccccgaaacggggggttacccccgg

SEQ ID NO: 395146 - DNA, 593 bp, Homo sapiens
  misc_feature: GZ8MTXP02G1PEQ.17.25.C03.1.454.CMB.2.raw
  modified_base (281)..(281): a, c, t, g, unknown or other
  modified_base (366)..(366): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattcacgtttacctctatagtatcaacgtggtgcgccaggccgntggacacgcctgagtggatggggatcgggacaacccgtacacgtggtgtcacgtagtcgtctccaccctatcccgtaccgggacncggtaaccttaccagtacgaaccctacgtaacctccctaccaaataaaccacacgcctaacgatgggacgttgaggacgtcctagactatcgtagaccgacgtaccggccgttactactttacgtggtcgacgagtacccgtacccacggtacgtccggggtagaccgtacccgtacggcacggtcggtcctttacggccgtttcggccggggaccgagggtacccg

SEQ ID NO: 395147 - DNA, 633 bp, Homo sapiens
  misc_feature: GZ8MTXP02ITGP3.17.25.C03.1.454.CMB.2.raw
  modified_base (472)..(472): a, c, t, g, unknown or other
  modified_base (538)..(538): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctccgtgcgaaggtcttcgtggtattctacgtttacctctatagtatacacgtgggtcgcgccgacggcccgcgtacggaaccaaccggaccgtggacgtaggagtggggacgtcggggaccgtaaaaccccgtaacgacgttggtacgtacgacgtagttccgtccttaccgaccctttacgccccgtccgggacacgtacctacatcgaaccacgacctccctacaactaaacacacgaccctaanagtggtagttggacggtacgccgtagactagtccgtagaccgacgaccgtccgttactacttacgngtcgacgtagacgtccgagacgtcggtacgaccgtaccgtacggccgaggtccgtacgtttcggaccgtttccgggaccgggtacgacgggtccg

SEQ ID NO: 395148 - DNA, 523 bp, Homo sapiens
  misc_feature: GZ8MTXP02I3RJQ.17.25.C03.1.454.CMB.2.raw
  modified_base (321)..(321): a, c, t, g, unknown or other
  modified_base (357)..(357): a, c, t, g, unknown or other
  modified_base (418)..(418): a, c, t, g, unknown or other
  modified_base (445)..(445): a, c, t, g, unknown or other
  modified_base (453)..(453): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatgggcaaccctanactggtgtcacagtgtctcacccatcctccgggacngacttaccatcgaccacgaactccctacaataaacacagacctacatggagttcgaggacnctgacatcgtagacgacacggccgttntattacgngtgcgagacgtccagactccggtagacgcctaacgggcaggccgtcttcgactcgtcggggctagggccg

SEQ ID NO: 395149 - DNA, 558 bp, Homo sapiens
  misc_feature: GZ8MTXP02FLWSY.17.25.C03.1.454.CMB.2.raw
  modified_base (331)..(331): a, c, t, g, unknown or other
  modified_base (367)..(367): a, c, t, g, unknown or other
  modified_base (433)..(433): a, c, t, g, unknown or other
  modified_base (445)..(445): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggaccaaccctacacgtggtntcactagtcgtccttcacccactcccgtccgggacncgaccttaccatcgaccacgaacctcctaccaataaaaccacacgcctacatggagttgagggacncctagactatcngacgacgacggcctatattacgtgtgacgagacgtcccgagtacgtccggtagacgccgtacgctacggccgtacctttcgtaccgtttcggacgggggccagggggtacccg

SEQ ID NO: 395150 - DNA, 563 bp, Homo sapiens
  misc_feature: GZ8MTXP02GGQP3.17.25.C03.1.454.CMB.2.raw
  modified_base (233)..(233): a, c, t, g, unknown or other
  modified_base (256)..(256): a, c, t, g, unknown or other
  modified_base (437)..(437): a, c, t, g, unknown or other
  modified_base (444)..(444): a, c, t, g, unknown or other
  modified_base (463)..(463): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctnagtgaggtctctgcaggcttcgnggattctacgtttacctctatagtatcaagtgggtgcgccagggccgctaggaccaacgccgtggaggtcgggagtgggagtacggggaccgaacctaacgtacgtggtgtcacagttctcctccgacctatcccgcggacacgtacttacataccgacctacgaccttcacagaaacacncgtacanagtaggataggagcacganactctcgacgacgacgacgtacgtactacgtacgtagtcgacgacgaccgtaccgacgtacgtaacggtacggacgtaccgtacggacggacggtcgtcg

SEQ ID NO: 395151 - DNA, 625 bp, Homo sapiens
  misc_feature: GZ8MTXP02HB4SM.17.25.C03.1.454.CMB.2.raw
  modified_base (279)..(279): a, c, t, g, unknown or other
  modified_base (292)..(292): a, c, t, g, unknown or other
  modified_base (304)..(304): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacgttaaaacctatttaaattggtatcagcaagaaactaggaaacnccccagacctccngatctctggtcncactcccacttctcgcgtaagttgccgtccagtcgtagttccagtgcagtggatcgtggggacagtctttacaattctacaaccactaccaccctactctacgaccaacgtgagtattgtacgtactaaattaccttaccttacgttacgtacgtaactaacgtacgttacctaccgtttcccctacgtacgttaccgtttacgggacccggtaacgggggtaaccctaaaaggttaccggaagtaaacgttaaccgaaaaacgtacgttacggtaacggtaccgttacggtaccaaccgtacgttccttacggtttaccc

SEQ ID NO: 395152 - DNA, 531 bp, Homo sapiens
  misc_feature: GZ8MTXP02F0RNA.17.25.C03.1.454.CMB.2.raw
  modified_base (364)..(364): a, c, t, g, unknown or other
  modified_base (425)..(425): a, c, t, g, unknown or other
  modified_base (458)..(458): a, c, t, g, unknown or other
  modified_base (484)..(484): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtcgtcttcacccatccctccgggacngacttaccatcgaccacgaaactcctaccaataaaccacagccctacatggagttgaggancctgacatctgacgacacggccgtactattacngtgcgagacgtcccagatccgggtanacgcctacggcacgcggcctttgaccttcgtcggggcccagggaccg

SEQ ID NO: 395153 - DNA, 647 bp, Homo sapiens
  misc_feature: GZ8MTXP02GYZAF.17.25.C03.1.454.CMB.2.raw
  modified_base (355)..(355): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggtcttctggtattctacgttacctctatagtatcaacgtggtgcgcaggccgctgacaacgcctgagtggagtgggatgggacaaccctaagcgtggtcgtcacgtagtcgtcttccaccctntcccgtaccggactcgtaccttacatacgaaccacgtaacctccctaccaataaacacacgacctactagtcggtagttgaagacgcctagacctaatcgtacgaaccgaccgtaccggtacccgttacgttaaacgttaccgtggtacgtacggtaacgtacccggttaacccgaaccggtaacgtcccggggttacgaaccggtacccgtaaccggggccgtaaccggtccgggtttcccgtttaccggtaccgtttccgggtaccgggggtaacccacgggtaacccgg

SEQ ID NO: 395154 - DNA, 731 bp, Homo sapiens
  misc_feature: GZ8MTXP02HBK87.17.25.C03.1.454.CMB.2.raw
  modified_base (283)..(283): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatcctccctgtctgcctcgtggtgggggtcagagtcaccatcacttgccggacaagtcacggtacgttaaaacctatttaaattggtatcagcaagaaacctaggaaaacncccccagaccctctagactctcgtgggtcacactccactcgtcggacggtaagtcggcccgtaccctagtccggtaggtttccccgaggtcggacgtaggttggacttccggtggggaacctaggttaactttacgaacttcctacaaccctactacccaaccctacgtacgtacgaccgtaaaccgtaggacggtattacggtactactaaacttaccttaaccttacgtacgtaacctaaacgtacgttaaccgtttaaccgtacccgtttaccccttaccggttaccgtttaaccgttttaccggggaacccggtaacgggggtaaaaccttaaacgggtttacggaaaacggttaccgtaaaaccgtaaaaccggttaacggttacggtaacggtaccgttacggaacccgttaaccctacgtttccgtttaccggtttaaccc

SEQ ID NO: 395155 - DNA, 650 bp, Homo sapiens
  misc_feature: GZ8MTXP02G193R.17.25.C03.1.454.CMB.2.raw
  modified_base (552)..(552): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcgtgggcctcagtgaggtctctgcaagcttctggtattctacgtttacctctatagtatctaacgtggtcgccgcgaggccgcgtcggaaccaacgacctggtaggtggagtggggagtcgggaccgtaaacccgtaacgacgtggtcgtacacgtagtccgttaccttaccacccctacgtccccgtaccggaactacggtaccttaaccgacgtaccgaaccctaaccgtaaaccctaccctaacctaaactaaaacccaacgaccgtacctaactagttaggagttacggaagtacgtcgtacgaactagtcgtacgaacgtaccgacgtcccgttattaacgtttnggtcgacggacgtacgtacccgacggtacgttccgggacgaccgtccgaccggtcacggtccgttcgttcggtacttcgggcggaccgacgggtcccg

SEQ ID NO: 395156 - DNA, 668 bp, Homo sapiens
  misc_feature: GZ8MTXP02GOY0L.17.25.C03.1.454.CMB.2.raw
  modified_base (222)..(222): a, c, t, g, unknown or other
  modified_base (276)..(276): a, c, t, g, unknown or other
  modified_base (302)..(302): a, c, t, g, unknown or other
  modified_base (438)..(438): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcacatcacttgccganaagtcacggtacgttaaacctatttaaatggtatcagcagaaacctggaaaacnccccagaccctctgatctcgtggtcncactccactcgtacgacggtaaaggttcgggccctaccccgatacggtaggtttccccaggtggactaggtggacttcgtgggggaacctagttactttacaactcctacaccctactaccgtaaccctacttccngtacccgtaaacctgggtaacggtatttagacgaccttaaaacttccttaaaccgttacgttcggtaaacctaaacgtaacgtaccgtttaacccgttaacccgtttccccgtacgtaccctttacggtttacggacccggtaaagggggtacccttaaaggttacgaaacgtacgtaaacgaaaaccgtatcggtaacggactacaccgccttagtccttactttaccc

SEQ ID NO: 395157 - DNA, 755 bp, Homo sapiens
  misc_feature: GZ8MTXP02IJWOY.17.25.C03.1.454.CMB.2.raw
  modified_base (286)..(286): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgacaaggtcttcgtggtattcctaccgttttacctcctatagttatcaacgtgggtncgccaggccgcgtggacaacgcctgagtggagtgggagtgggaccaaaccctacgacgtggtctacaacgtagtccgttccttacccgaccctagtccccgtccggggaactacggtaaaccctttaccaacgttaccgaaaccccctaacgtaaaccccttcccctaaaccctaaactaaaaacccaccgaaacgtacccttaaaccgtaaggttaggggtaaacggtttacgggaaacgggtacgtaccccgttaaaggaaaccttacgtttaccgtaacgggaaaccgacccggacccggtacccgtttacttaacgtttacgtcggttacggaccggtaacgaacccggtttccccgaaacggtacggttacccggaggaccgttacccgtacggggacccgacggtcccggttccgttttacgaacccggtttcgggaccgggggtacccgtacgggggacccg

SEQ ID NO: 395158 - DNA, 540 bp, Homo sapiens
  misc_feature: GZ8MTXP02H9R45.17.25.C03.1.454.CMB.2.raw
  modified_base (504)..(504): a, c, t, g, unknown or other
  modified_base (506)..(507): a, c, t, g, unknown or other
  modified_base (509)..(509): a, c, t, g, unknown or other
  modified_base (511)..(540): a, c, t, g, unknown or other
tcagcgtagactagcacgaccggtgctcgatttagtagtgtagatttgggtttgggagggggtcagagtcaccatcacttgccggacaagtcacggcgttaaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccatctgcaacctgagattgtgcaatctactactgtcaacagacgttacacgttccccctgcctacgttttcggcccgaggggaccctaaaagtttgaggacttacaaaacgacgtgtcggctaggcccaacctactctcgttctttaccacttcccttcccccgacctaacttcctagtacgttacgttcccgtaaccgtcgttacggacgggccggggtcgttcggggaccgaaaaccggggccggtacaaacgttaacggngnngngnnnnnnnnnnnnnnnnnnnnnnnnnnnnnn

SEQ ID NO: 395159 - DNA, 666 bp, Homo sapiens
  misc_feature: GZ8MTXP02FGZYQ.17.25.C03.1.454.CMB.2.raw
  modified_base (250)..(250): a, c, t, g, unknown or other
  modified_base (271)..(271): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgagtgaagagcctggggcctcagtgaaggtctcctgcaaggcttctggattcacgtttaccncctatagtatcaacgtgggtncgccaggccgctggacaacgacctgagtggatggggatggggaccaaaccctaacacgttggtcgtcactagtccgtccttaccaccccatccccgtaccggggtacacgtaccttaacccgattccgaaccctaacggaaacccttccctaaacccaaattaaaacccaaccacgtaccctaacagtcgggtaagttggaacgggacgtccctaggacctaatccgtacggaacccggaccgaacccgggtcccgttacttaagttaccgttggacgacggtaacgaccgttaccccgaacgtacgtaccccggggtagaaccggtcccgtaacgggcctacgggcccgggtaccttttcggaaccgtttcggcgggggaccacggggtcccgg

SEQ ID NO: 395160 - DNA, 755 bp, Homo sapiens
  misc_feature: GZ8MTXP02JHQMD.17.25.C03.1.454.CMB.2.raw
  modified_base (274)..(274): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaggtctctgcaggcttctggtacttcacgtttaccnctatagtatcaacgtggtgcgccgaggccgctaggacaacgccgtggacggtaggtagtaggggagtcggggaccgtaacccgtaaccgtacgtagggtacgtacgaacgtaggttcgtccgtttaccaccccgtacgttaccccgtaccgggggtaactaacggtaccctttaacccgattaccggaaacccctaacggtaaacccttcccgtaaaccctaaacttaaaacccgaccgtaaccgtaacccgtaaccgtaaagttacggggtaacggttaacgggtaaacggggtaccgtaccgttacgaaacccgttcgttaaccgtaccgggtaaaccgaaccccggtaacggttacccccggttaactttaccgtttaacgttcggtttacggacccgtaacggtaccgtacccccgaaggtacccggtcgggtacgaccggtacccgtacgggcgtaaccgggtcccggtttaaccg

SEQ ID NO: 395161 - DNA, 536 bp, Homo sapiens
  misc_feature: GZ8MTXP02H4I12.17.25.C03.1.454.CMB.2.raw
  modified_base (215)..(215): a, c, t, g, unknown or other
  modified_base (226)..(226): a, c, t, g, unknown or other
  modified_base (235)..(235): a, c, t, g, unknown or other
  modified_base (325)..(325): a, c, t, g, unknown or other
  modified_base (333)..(333): a, c, t, g, unknown or other
  modified_base (360)..(360): a, c, t, g, unknown or other
  modified_base (388)..(388): a, c, t, g, unknown or other
  modified_base (393)..(393): a, c, t, g, unknown or other
  modified_base (414)..(414): a, c, t, g, unknown or other
  modified_base (420)..(420): a, c, t, g, unknown or other
  modified_base (475)..(475): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagagccgtggggcctnagtgagtctcngcagcttcngattcacgtttcctctatagtatcacgtgggtgcgccaggccgctcggacaacgcctgaggtggagtgggatcggggaccaaacccctanacgtggtncatgtcgtctcacccatccgtcggacngacttacatccgaccacgactccacaanaaccnacgctacagtgattgaaggcncagacntacgtgaccacgacggtccgtcttatactgtgcgagctcccgagacgtccgggtnaccggtccgaccggctaccggccgttctttcgacgtttcggacggggccgaacgggcccgg

SEQ ID NO: 395162 - DNA, 574 bp, Homo sapiens
  misc_feature: GZ8MTXP02HPMPN.17.25.C03.1.454.CMB.2.raw
  modified_base (237)..(237): a, c, t, g, unknown or other
  modified_base (273)..(273): a, c, t, g, unknown or other
  modified_base (439)..(439): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttaccctctatagtatcaactgggtncgccaggccgctggacaacgcctgagtggatgggatgggaccaaaccctaacgactggtgtcactagtcgtccttcgacccctatcccgtaccgggacacgtaccttaccatcgaaccacgaactcctaccaataaacacacgcctaacatggagttggaacgganaccctgaccatctagacgacgaccgccgtatacttactgtcgcgaacgacgtacccacgtacgtcccggtaggacctcccgtacggacgaggtcccggtcttttacgcgttcggtacggggccctaaggggcccg

SEQ ID NO: 395163 - DNA, 634 bp, Homo sapiens
  misc_feature: GZ8MTXP02J1T8K.17.25.C03.1.454.CMB.2.raw
  modified_base (226)..(226): a, c, t, g, unknown or other
  modified_base (310)..(310): a, c, t, g, unknown or other
  modified_base (444)..(444): a, c, t, g, unknown or other
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatcgacccagtctccatccctccctgtctgcctcgtggtgggggtcagagtcaccatcacttgccganagtcacggtacgttaaacttatttaaatggtatcagcaagaaacctaggaaacgccccaagaccctcctgacttctcgtgggtnacctactccactcgtgacgaggtcggcctcccagtcgtaggttccgaggtcgcgtaggtggagttcgtggggactaagttattacactctaccaactactccacctactctacgacctaacggtgaaacggttntagtactactaacttaccttaacgtacgtacgtaaacaaacgtacgttaccgttacccgtacccgttccccttaggtaccgtttacgggttacgggaaccggtaaacgggtaactaaaggtacgaaagtaacgtaaaccgaaacggtcgtcggaacgtacctacgtaccctacttcgttacgttacttcc

SEQ ID NO: 395164 - DNA, 686 bp, Homo sapiens
  misc_feature: GZ8MTXP02FSK76.17.25.C03.1.454.CMB.2.raw
  modified_base (228)..(228): a, c, t, g, unknown or other
  modified_base (252)..(252): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtgacagcagctacaagtgcccactcccaggtgcagctggtgcagtcgtggggctggaggtgaagagccgtggggcctcgagtgaaggtctcngcagctctggattctacgtttccnctatagtatcgaacgtgggtcgcgccgaggcccgcgtcggaaccaaccgtacctggacgtgggtagtggggagtcggggaccaaacccgtaacgacgttgggtacgtcaacgtaggttcccgttcccttaccacccctacgtccccgtaccggggaactcgtaacccttaccataccgaaccctaaccgtaacctcccctaaccaaataaaacccacaaaccgccctaacagttcgggtaagttacggaggaccgtccgtacgactagtaccgtacgaacccgaaccggacccggtaccgttccttaagttaccgtggtcgacggacgtaccgtaccccgacggtaccgtccgggtacgacgtacccgtacgggacctcgggaaccgttccgtttacggtacgtttccgggacggggtacccgaggggtccccg

SEQ ID NO: 395165 - DNA, 576 bp, Homo sapiens
  misc_feature: GZ8MTXP02JK0CR.17.25.C03.1.454.CMB.2.raw
  modified_base (224)..(224): a, c, t, g, unknown or other
  modified_base (306)..(306): a, c, t, g, unknown or other
tcagcgtagactagcacgaccggtgctcgatttagtagtgtagatttgggtttgggggagtcagtctcagtcaggacacagcatggacatcgagggtccccgctcagctcctggggctcctgctactctggctccgagctgccagatgtgacatccagatgacccagtctccatcctccctgtctgcctctggtgggggtcagagtcaccatcacttgccgganaagtcacggtacgttaaaacctatttaaattggtatcagcaagaaacctaggaaacgccccaagaccctctgatctctggtncactccactctgaccgtaagtcggccgtccagtcggtaggttcccagtggactaggtgattcgtggggactagtactttacaatctaccaccactaccacctactctcgaccaaccgtggaacgtattgtgactaagtctaactactgtacaacgtagtaacgttacctacgtttcccctacgtccttacgtttcggaccgtacggggtaacctaaaggtacgacgtactaccgaaacgtactaggtcgctacgacacctatctcgtacc

SEQ ID NO: 395166 - DNA, 754 bp, Homo sapiens
  misc_feature: GZ8MTXP02HZQLN.17.25.C03.1.454.CMB.2.raw
  modified_base (216)..(216): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctggaggtgaagaagccgtggggcctnagtgaaggtctcctgcaaggcttcgtggtattcacgtttacctcctatagtatcaacgtgggtcgcgccgaggcccgcgtacggaaccaacgacctaggaggtaggagtggggatcggggaccaaacccgtaacgcgtggtctaccacgtagtcgtccttacccaccctacgttcccgtaccgggaactaccgtaacctttaaccaacgttccgaaacccgtaaaccgtaaacccttccccctaaccctaaaactaaaacccaacgaaccgtaacccctaacgtaagttacggggtaaacgttagggaacggtaacgtcccgtaaacggtacctagttacccgtacggaaaccccgaccgaaacccggggttccccttacgttaacgtttaccgtaggtcgaaccggtacgtaaacccggtcccgaaaacggtccgtacccgggtagtacccggacccgttacggcccgtaacgggtccccggttaccgtttacgggtcccgtttccggggtaccggggacccgtacggggtccccgg

SEQ ID NO: 395167 - DNA, 579 bp, Homo sapiens
  misc_feature: GZ8MTXP02IOXPJ.17.25.C03.1.454.CMB.2.raw
  modified_base (210)..(210): a, c, t, g, unknown or other
  modified_base (338)..(338): a, c, t, g, unknown or other
  modified_base (379)..(379): a, c, t, g, unknown or other
  modified_base (390)..(390): a, c, t, g, unknown or other
  modified_base (493)..(493): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctggggcctnagtgaggtctcctgcaggcttctggattcacgtttacctcctatagtatcaacgtgggtgccgccaggcccgcgtggaaccaacgcctggagtggagtgggagtggggaccaaccctaacgactggtntcgactagttcgtccttccacccctatcccgtaccgggacncgtacttaccntcgacccagaacctccacaataaaccacacgcctaacgagtagggtagttagacggtacgccgtagacctatccgtagaccgacggaccggcttactaattcngtagcgagaccgtccagtacgtccggagtaccgaccgtacggcacggcgttccgtttagccgtttcgacggggcgacggggacccg

SEQ ID NO: 395168 - DNA, 679 bp, Homo sapiens
  misc_feature: GZ8MTXP02FNPJO.17.25.C03.1.454.CMB.2.raw
  modified_base (211)..(211): a, c, t, g, unknown or other
  modified_base (275)..(275): a, c, t, g, unknown or other
  modified_base (328)..(328): a, c, t, g, unknown or other
  modified_base (335)..(335): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctnagtgaaggtctcctgcaaggtcttcgtggattcaccgtttacctctaatgtatcaacgtgggtncgccaggccgcgtggacaacgacctgagtggatgggatgggaccaaccctaancgtggtncactgtcgtccttccaccctatcccgtaccggacacgtaccttacatacgaccaacgaacctcctaccaaataaaaccacaacgacctaacagtacgggtaattacggaggaacgtccgtagaactacgttaccgaggacccgtaaaccgaccggtacccgttacgttaactttaccggtacggtcgaaccggaacgtacccgtaaccccgtaacgggtacgtttcccggggtagaaccggttccccgtaaccgggggcctaaccgggtcccgggttaccccgtttttacgggaccccgttttaccggggtaccgggggtaccccggaagggggtaacccccgg

SEQ ID NO: 395169 - DNA, 630 bp, Homo sapiens
  misc_feature: GZ8MTXP02IJND0.17.25.C03.1.454.CMB.2.raw
  modified_base (267)..(267): a, c, t, g, unknown or other
  modified_base (277)..(277): a, c, t, g, unknown or other
  modified_base (435)..(435): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtctggggctggaggtgaagaagccgtggggcctcagtgaaggtctcctgcaaggtcttctggtattcacgtttacctctatagtancaacgtggtncgccaggccgctggacaacgcctggagtggatggggatacgggaccgtaaaaccctaagacgtggtacgtcaacgtgtcgtcctaccaccctagtcccgtaccgggactacgtacctttaacaagttcgaacccaacgtaacctccctaacccaaaanaaaccacacgtacctaagtagtagtaagtagaacggactactacgaactacgtacgtacgaccgaccgaccgtaccttaccgttaagttccgtgtacggcgtaacgtaccgtaccacgtaccggtaccggagaccgtccgtacggcgtacggtccgtacgttacgtaccggttcggacggtaccggtacggtccg

SEQ ID NO: 395170 - DNA, 545 bp, Homo sapiens
  misc_feature: GZ8MTXP02GA44W.17.25.C03.1.454.CMB.2.raw
  modified_base (326)..(326): a, c, t, g, unknown or other
  modified_base (334)..(334): a, c, t, g, unknown or other
  modified_base (367)..(367): a, c, t, g, unknown or other
  modified_base (399)..(399): a, c, t, g, unknown or other
  modified_base (403)..(403): a, c, t, g, unknown or other
  modified_base (408)..(408): a, c, t, g, unknown or other
  modified_base (411)..(411): a, c, t, g, unknown or other
  modified_base (422)..(422): a, c, t, g, unknown or other
  modified_base (429)..(429): a, c, t, g, unknown or other
  modified_base (449)..(449): a, c, t, g, unknown or other
  modified_base (485)..(485): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaagcttctggattcacgtttacctctatagtatcaactgggtgcgccaggccgctggacaacgacctgagtggagtgggatcgggacaaccctaanacgtggtntcacgtagtcgtctccaccactccgtccggacncgactacatcgaccacgactcctacataaacncacncctanagngagttgagacnctagacntcgtagacgacacggccgtntattacgtgtgaccgagcgtacccaggtactccggngaccgtccgtacggcacggtcggtccctttggaccgttcggccgggggaccagggtcccg

SEQ ID NO: 395171 - DNA, 619 bp, Homo sapiens
  misc_feature: GZ8MTXP02H0IVD.17.25.C03.1.454.CMB.2.raw
  modified_base (226)..(226): a, c, t, g, unknown or other
  modified_base (278)..(278): a, c, t, g, unknown or other
  modified_base (289)..(289): a, c, t, g, unknown or other
  modified_base (300)..(300): a, c, t, g, unknown or other
  modified_base (341)..(341): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatccctccctgtctgcctcgtggtgggggtcagagtcaccatcacttgccgganaagtcacggtacttaaaactattaaattggatcagcagaaacctggaaaacncccagacctcngatctctggtncactccactctgacgagtggcctccatcgagttccagtgcngtggatcgtggggacagtactttacgaacttcacaaccactacccaaacctactctacgacctaaaccgtggacggtatttgacgactaaattcctaattacgtgtaaccaaacgtaacgtacgtttaaccgaccgtttcccccgtcgtaccgtttaccgttttccgggaaccggtaacgggggtaaaacccttaaaagggtttacgaaacggtaacttaaacggaaaaccgtaacgttggtaacgacttacgacctaccgtacttcgttactttacc

SEQ ID NO: 395172 - DNA, 675 bp, Homo sapiens
  misc_feature: GZ8MTXP02GAF5X.17.25.C03.1.454.CMB.2.raw
  modified_base (255)..(255): a, c, t, g, unknown or other
  modified_base (332)..(332): a, c, t, g, unknown or other
  modified_base (344)..(344): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttaccnctatagtatcaacgtgggtgcgccaggccgctggaaccaacgacctggagtggagtgggatggggaccaaaccctanacgtggtgacanagtcgtcttccaccctatcccgtaccgggaacacgtaccttaaccagtacgaacccaacgaaccttccctaccaaactaaaaccaccgaacgaccctaacacgtggggtaagttaggaacggacggtaccctaggtaaaccactttaccgacggaacccggtaaccgaaccggggtaccccgtttacttaacgtttaaccgtggttacggacggaacggtacccgttacccgaacggtaacgtcccgggtagaccggtccccggtaacggccgaacggccggttcccgtttacggaccgtttccggtacgggggacccgtagggggacccg

SEQ ID NO: 395173 - DNA, 648 bp, Homo sapiens
  misc_feature: GZ8MTXP02G4VUM.17.25.C03.1.454.CMB.2.raw
  modified_base (248)..(248): a, c, t, g, unknown or other
  modified_base (251)..(251): a, c, t, g, unknown or other
  modified_base (253)..(253): a, c, t, g, unknown or other
  modified_base (256)..(256): a, c, t, g, unknown or other
  modified_base (292)..(292): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttagtggcagcagctacaagtgcccactcccaggtgcagctggtgcagtctggggctgaggtgaagagccgtggggcctcagtgaggtctctgcagntcngntcncgttctcctatagtatcaactggtgcgccaggccgngtcggaacaacgacctggagtggagtgggatggggaccgaacctaaccgacgtgggtcgtacacgagttcgtccttccaccctagtccccgtacccggggtactaacgaccctttaaccacgttaccgaacccgaaccgaaccttccctacctaaactaaacccaacaacgaccctaagactcgggtaagtttgggaggacgtacccgtagaacccgtatcgtaggaaccgaccgtaccggcccgttacttacgtttacgtggttacggacgtaacggtaccggttaccccaacgtacgttaaccgggttcggaaaccggtcccgtaaccggccgtaaccgggtccggtttcccgg

SEQ ID NO: 395174 - DNA, 704 bp, Homo sapiens
  misc_feature: GZ8MTXP02HNM7B.17.25.C03.1.454.CMB.2.raw
  modified_base (224)..(224): a, c, t, g, unknown or other
  modified_base (274)..(274): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagacgccgtgggcctgagtgagtctcngcagtcttcgtggattcacgtttacctctatacgtatctaacgtgggtcncgaccgaggccgctaggaacaacggacctggacgtggagtgggacgtcggggaccaaaacccgtaagaccgttggtctaccgacgtacgttccgtacccttaccaccccgtagtcccgttacccggggaatcggtaaccttaacgacttacccgaaccctaaccgtaccttacccaaacctaaactaaaaccacaacgtaccctagtaagtcgggtagttacggaacgggacgtaccgtagaacccttagtacgtaaccggaaccggaaccgacccggtaccgttaccttaacgttaaccggtggtacgtacggacgtaccggtacccgaaacggtccggttacggacgaaccggaccgtacggactaaccggtccgggttccttacggtacccgtttcgggaccggggtaccgtaacggggttccccgg

SEQ ID NO: 395175 - DNA, 571 bp, Homo sapiens
  misc_feature: GZ8MTXP02IQ9ES.17.25.C03.1.454.CMB.2.raw
  modified_base (272)..(272): a, c, t, g, unknown or other
  modified_base (331)..(331): a, c, t, g, unknown or other
  modified_base (359)..(359): a, c, t, g, unknown or other
  modified_base (425)..(425): a, c, t, g, unknown or other
  modified_base (456)..(456): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacacgacctgagtggatggatgggcaaccctacacgtggtgtcanagtcgtccttcaccatccctccgggacncgacttaccatcgaaccacgaacctcctaccaataaaccacacgcctaacatggagttgagggacnccgtagacatctagaccgacgacggcccgtntacttcgtgtcggacgtacgacgttcccagtaccgtccgggtagacgtcccgtaacgggctacgggtccggtaccttttcggaccgtttcggacgggggaccgacggggtcccgg

SEQ ID NO: 395176 - DNA, 556 bp, Homo sapiens
  misc_feature: GZ8MTXP02HQSIR.17.25.C03.1.454.CMB.2.raw
  modified_base (262)..(262): a, c, t, g, unknown or other
  modified_base (272)..(272): a, c, t, g, unknown or other
  modified_base (320)..(320): a, c, t, g, unknown or other
  modified_base (364)..(364): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaggtctcctgcaaggcttctggattcacgtttacctctatagtancaactgggtncgccaggccgctggacaacgcctgagtggatggatgggcaaccctaanctggtgtcacgagtcgtccttccaccctactcctcccggggaancgtaccttaccatccgacccaacgaaactccctaccaataaaaccacaacgcctaacatggagttagagagcctagaccatctagacgacacggcctatatactgtgacgagacgtcccagacgtcggtgaacgccgtacgcacgtccgggtccctttaggtccgttcggtcggggccctaaggggtccccg

SEQ ID NO: 395177 - DNA, 547 bp, Homo sapiens
  misc_feature: GZ8MTXP02I8TRD.17.25.C03.1.454.CMB.2.raw
  modified_base (207)..(207): a, c, t, g, unknown or other
  modified_base (217)..(217): a, c, t, g, unknown or other
  modified_base (231)..(231): a, c, t, g, unknown or other
  modified_base (275)..(275): a, c, t, g, unknown or other
  modified_base (322)..(322): a, c, t, g, unknown or other
  modified_base (401)..(401): a, c, t, g, unknown or other
  modified_base (403)..(403): a, c, t, g, unknown or other
  modified_base (408)..(408): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagagctgggctnagtgaggtcncctgcaaggcttcnggattcacgttacctctatagtatcaactgggtgcacaggccgntggacaacgactgagtgagtggatggggcaaacccgtaacacgtggngtcacgagtcgtcttaccgacctactcctccgggactgaaccttacatcgaccacgaaacctcctaccaataaaacacnanacacnataggagtacgtacgagactcgtacgacacgacgacgacgacgtacgtactactacgtagtacgtacgacgacgtaccgacgacgaccgtacgacgaccgtacgcgtacgtcgtcgttcggtaccgtcggtacgggcgg

SEQ ID NO: 395178 - DNA, 646 bp, Homo sapiens
  misc_feature: GZ8MTXP02H965Q.17.25.C03.1.454.CMB.2.raw
  modified_base (431)..(431): a, c, t, g, unknown or other
  modified_base (448)..(448): a, c, t, g, unknown or other
  modified_base (514)..(514): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcgtggtattctacgttacctcctatagtatcaacgtggtgcgccaggccgcgtggaccaacgacctggaggtggagtggggagtcggggaccgtaaacccgtaacgtacgtggtcgtaccacgtagtccgtccttaccgaccctactcccgtaccgggacacgtaccttaccatacgaccacgaactcctacaaanaaacacgacgccctaanagtcggtaagttggaaggcacctgaactacgtcgtagaccgacgaccggtcttaactacgttacgnggttcgacgaaacgtccgttacccgaaacggttccgttccggaggacccgtaccgtaaccggcgtacgggtcccgggtttacctttacgggtaccgtttccggggaccggggtacccgtaaggggtcccccg

SEQ ID NO: 395179 - DNA, 789 bp, Homo sapiens
  misc_feature: GZ8MTXP02IB9RR.17.25.C03.1.454.CMB.2.raw
  modified_base (236)..(236): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcagtgaaggtctctgcaaggcttcnggtattcacgtttacctcctatagtatcaacgtgggtcgcgccgaggccgcgtaggaccaacgacctggagtggagtggggagtcggggaccgaaaacccgtaacgacgtcggtcgttaccgaaccgtaggttccgttaccctttacccacccccgtaacgttcccccggttaacccggggacctacggttaaaccctttaaacccgacgttaccccggaaaccccctaacccggtaaaccctttaccccctaaacccttaaaacctaaaaaacccgtacccaaaccggtacccccttaaaacccgtaggttaaccgggggtaaagtttaacgggaaaccggggtacgaacccccgttagggtaaaacctaccgttaccggttaacggaaacccggtaacccggtaacccgggtacccgtttacttaaacgtttacccgttgggtaccggacgtaacggaacccgttccccgaacggtacgtcccggttagaccgttaccgacggcgtacggtcccgtcgttacgtaccgtcggtcgggaccgtacgggcccg

SEQ ID NO: 395180 - DNA, 804 bp, Homo sapiens
  misc_feature: GZ8MTXP02FFSQ1.17.25.C03.1.454.CMB.2.raw
  modified_base (265)..(265): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgacgaaggtcttcgtggattcctaccgtttaccncctatagtatcaacgtgggtcgccgccgaggccgcgtaggaacaaccggactggaggtggagtggggagtcggggaaccaaaccctaacgacgtggtcgacacgtagttccgtccttaccaccctacgtcccggtacccggggaactacgtaacccttaaccgagttacccgaaacccctaaacgtaaacccttacccctaaaccctaaaacttaaaaacccgaccgtaaaccgtacccttaaacgtagtacgggggtaaagttacggggaggaccgtacccgtagaaccctaagttccgaccgggaaacccggtaaccccggtaccgggtaccccgtttaacttaacgtttaacggttcggtaccggacgggtaaacggtacccggttaaccccgaacgggtacccgtttacccgggggtaacggtacccggaccccggttaaacgggccgttaaccggggtccccgggtttaccgtttttaccgggacccggttttccgggggaccgggggtaccccggacgggggttaacccccgg

SEQ ID NO: 395181 - DNA, 785 bp, Homo sapiens
  misc_feature: GZ8MTXP02HXI4O.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaaggaagccgtggggcctcgagtgaaggtctcctgctaaggcttcgtggtattccacgtttacctcctaatagtatcaacgtgggtgccgccgaggccgcgtggaaccaacgacctggagtggagtgggagtcggggaccgaaacccgtaaacgacgtgggtcgtaccacgtaggttccgtacctttaccccgaacccctacgttaccccggttacccggggaactaccggtaaaccctttaaacccaacgttaccgaaaccccgtaaacccgtaaacccttacccctaaccctaaacaaaaaccctaacccaaacgtacccccgtaaactaaacggttcgggtaaacggtttacgggaacgggtaacgtcccgttaaggacctaacgttaccgttacgggaaccgaaccggacccgggtcccgttaccgtaacgtttacccgtggttccggacgtacggaaccgttaccccggaacgtaacgtcccggttaggaccggtacccgtaccgggacgtacggtcccgggttcccgttttacgggtaacccgtttcggggtaccgggggtacccgtaacgggggtccccgg

SEQ ID NO: 395182 - DNA, 578 bp, Homo sapiens
  misc_feature: GZ8MTXP02GJ1GK.17.25.C03.1.454.CMB.2.raw
  modified_base (271)..(271): a, c, t, g, unknown or other
  modified_base (412)..(412): a, c, t, g, unknown or other
  modified_base (420)..(420): a, c, t, g, unknown or other
  modified_base (436)..(436): a, c, t, g, unknown or other
  modified_base (448)..(448): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattcacgtttacctcctatagtatcaactgggtncgccaggccgctggacaacgacctgagtggatgggatgggaccgaaaccctaacgacgtggtcgtcacgtagtccgtccttccaccctactccgtccgggacacgtacttacatcgaccacgacctcccacaaataaaccncagcctanagtggagttgaggacncctgactatcgngaccgacgaccggtcctatatacgtgtcgacgtagactccccgagtacgtcccggtagaccgtaccgtacgggcacgggtcccggttacctttaggaccctttcgggaccggggtaccgaaggggccccg

SEQ ID NO: 395183 - DNA, 711 bp, Homo sapiens
  misc_feature: GZ8MTXP02JGQ7Y.17.25.C03.1.454.CMB.2.raw
  modified_base (276)..(276): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagcgtggtgcagtcgtggggctggaggtgaagagcgtgggcctgagtgaggtctccgtgacaggtcttcgtggattctacgtttacctctatagtatcagtggtcncgccgacggccgcgtaggaaccaaccgactggaggtggagtgggagtcggggaccaaaacccgtacgacgtggtcgcaacgtagtccgtccttaccaccctactcccgtaccggacacgtaccttaaccgactacgaacccaaccgtaaccttacccaaccaaataaaacccgactacgtacccttaagagtagggtaacggttgaaggaccgtcctaaggacctagtacgtacggaacccgacggtacccggtaccgttattagttacccgtggacgacccggtaagacccccggtacccgtaacgggtcggtttaccccggggtaggaaccccggtacccgggtaacggacccgtaccggggttaacccgtttaccggttttacggtacccgggtttccgggggaccgggggacccgtaacggggtacccccg

SEQ ID NO: 395184 - DNA, 758 bp, Homo sapiens
  misc_feature: GZ8MTXP02I0JI5.17.25.C03.1.454.CMB.2.raw
  modified_base (281)..(281): a, c, t, g, unknown or other
  modified_base (294)..(294): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagcgtgggcctgagtgacgtctcgtgcgaggtcttcgtggtacttccgtaccgtttacctctatagtatcgaacgtgggtcncgccgaggcccgngtaggaccaacgctggagtggagtgggacgtcgggaaccctaaaccctagcgttggtctaccaaagtcgttccgttccttaccgaccctaccgttcccggtaccccgggaactaccggtaccctttaaaccgacgttacccgaccccgtaaacgtaacccttcccttaaaccaaacttaaaacccgcctaacgtacccctaaagaggttcggggtaaggttacgggaacggacgcccgtttaaggacctaacgttccggaacggaaaccccgtacgggttaaacccggttccccgtttaattaacggtttcccgagggttaccgacggttaacgaccccgttaccccggaagttccggtacgggtacgaaccggtcccgtacgggtaccgaacgggttcccggttcccgtttttaacgggcccggtttccgggtaccggggaccggggtttaacggggtccccg

SEQ ID NO: 395185 - DNA, 560 bp, Homo sapiens
  misc_feature: GZ8MTXP02FH84V.17.25.C03.1.454.CMB.2.raw
  modified_base (363)..(363): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgagtgaagaagcctggggcctcagtgaaggtctcctgcaaggcttctggattcacgtttacctcctatagtatcaactgggtgcgccaggccgctggacaacgacctgagtggatgggatgggcaaaccctaacacgtggtgtcacgagtgtcttcacccatcccgtccggacngacttaccatcgaccacgaactcctaccataaacacacgctacatggagttgaggagcctagacatctgaccgtacgacggacccgtacgttacttacgtggtacgcgaacgacgtcccaaggacgtccggtcgacgacccgtaccggcacggccggtcctttacgaccgttcgtcgggggaccgacggggtaccgg

SEQ ID NO: 395186 - DNA, 673 bp, Homo sapiens
  misc_feature: GZ8MTXP02HVIBY.17.25.C03.1.454.CMB.2.raw
  modified_base (577)..(577): a, c, t, g, unknown or other
  modified_base (605)..(605): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggaccctcttcttggtggcagcagctacaagtgcccacctcccacggtgcagctggtgcagtcgtggggctgaggtggaagaagccgtggggcctcagtgaaggtctcctgcaaggtcttctggattctacgtttacctcctaatagtatcaacgtggggtcgccgccgagggcccgcgtcggaacaaccgtaccgtggaggttggagtggggaatcggggaccgaaacccctaaagacgtgggtagtccaacgacggttctccccgtttcccaacccccagttcccccgttaccggggaccaacggttaccctttaaccagttaccgacccctaaacgtaaccctcctacccaaaattaaaaccactacgaccctaacgagttggggaacgtttggaagggacgtccctagaactcttacgcggaacgacgaccgggtccttataacgtttacgnggcgacgacgacgtcccagtcgtcgganaccgccgtacggctacggtccggttaacctttggacccgttcgggacggggccgacgggtacctcccg

SEQ ID NO: 395187 - DNA, 674 bp, Homo sapiens
  misc_feature: GZ8MTXP02H2PYA.17.25.C03.1.454.CMB.2.raw
  modified_base (472)..(472): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggtattcacgtttacctctatagtatcaacgtggtcgcgccgaggccgcgtggacaacgacctaggaggtaggagtggggagtcggggaccgaaaccctaacgacgtgggtacgtacacgtagtccgtccttaccacccctacgtcccgtaccggggacacgtaccttaaccacgtacgaacccaacgaaacctaccctaccaaactaaaaccacacacctaacgtagtaggngtaggacggacgtcctgacctagtccgtaggaacccgaccgaccggtaccgttacctaatttaccggaggtggaccggaacgtaacccgtcccgaacgtacggtacccggtacggaccggtacccgtaccgggacgtaccgggtcccggttaccgtttacggacccgtttcgggaccgggggtaccggaacggggtccccgg

SEQ ID NO: 395188 - DNA, 587 bp, Homo sapiens
  misc_feature: GZ8MTXP02GF8NQ.17.25.C03.1.454.CMB.2.raw
  modified_base (223)..(223): a, c, t, g, unknown or other
  modified_base (277)..(277): a, c, t, g, unknown or other
  modified_base (305)..(305): a, c, t, g, unknown or other
  modified_base (423)..(423): a, c, t, g, unknown or other
  modified_base (431)..(431): a, c, t, g, unknown or other
  modified_base (527)..(527): a, c, t, g, unknown or other
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccganaagtcacggtacttaaaactatttaatggtatcagcaagaaacctaggaaaacnccccagaccctctagacttctctgggtnctaactccacttctgacgaagtcggccgtcccagtccgtaggtccagtggcaggtgatcgtggggacagtacttacaattccacaccactccacctaccaccgaccaaccgtgacgtnttcggtanactaaattcctaactactcgtaacaactaggtacctaacctaccgttcccctagtccttacgtttcgggaccgtaacggggtaacctaaaaggttnaacggtactaaacgaaacgtaacgttcgacgcgtccgaactactatcctacttacttacc

SEQ ID NO: 395189 - DNA, 654 bp, Homo sapiens
  misc_feature: GZ8MTXP02FGXQR.17.25.C03.1.454.CMB.2.raw
  modified_base (223)..(223): a, c, t, g, unknown or other
  modified_base (274)..(274): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctctggtgggggtcagagtcaccatcacttgccganaagcacggacttaaaactatttaaatggtatcagcagaaacctggaaaacnccccagacctctagatctctggtcgcatcccactctggacgaagtggcctccagtcggtaggttcccaggtggactaggtggactcggtgggacaagtatttaccaattcctacaacactaccaaccctactcgtacgtaccaaaccgttaggaaggtaacgtttgtacgtacctaaacttaccttaaactaccgttaggtacccaaaacgtacggtaaaccgtttaaccgtacccgtttacccccgtccggtaccttaccggttttaccgggaacccggaaacgggggtaaacctaaaagggtttacgaaaggtaaacttaccgaaaaacgtaccgtaggtaacggtacgtacgacaccgtaacttccgtagtttaccc

SEQ ID NO: 395190 - DNA, 647 bp, Homo sapiens
  misc_feature: GZ8MTXP02I7CRW.17.25.C03.1.454.CMB.2.raw
  modified_base (504)..(504): a, c, t, g, unknown or other
  modified_base (550)..(550): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctccgtgcaaggtcttcgtggtattctacgtttacctctatagtatcaacgtggtcgcgccgacggccgcgtacggaaccaaccgaccgtggaacggtggaagtggggacgtcgggaccgaacccgtaacgtacgtggtcgtcaacgtagttccgtaccttaccaccctacgtcccgtaccgggaactacgtaaccttaacacgtaccgacccgtaaccgtaacctacccgtaccaaactaaacccaacaccgacctaacgagtcggagttcggaggacnccgtagactagtcgtacgacgaccgacggtaccttactacttacgngtacggacgtacgtaccgtcccgaggtacgtccggacgaccgtccgtaacggcgacgtcccggtcgttcgtaccgttcggcgggccgtaggggcccg

SEQ ID NO: 395191 - DNA, 655 bp, Homo sapiens
  misc_feature: GZ8MTXP02ILNTA.17.25.C03.1.454.CMB.2.raw
  modified_base (277)..(277): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtctggggctggaggtgaagagcctggggcctcgagtgaaggtctcctgcaaggcttctggtattcacgtttacctcctatagtatcaacgtgggtncgccaggccgctggacaacgacctgagtggagtgggatcgggaccaaaccctacacgtggtctacacgtaggttcgtccttaccacccctaacgttcccgtacccggggaacacgtaacctttaacccaacgttaccgaacccaaccgtaaaccttccctaacccaaactaaaaccaccgaacgaccctaacgagtggaacgttaggaacggacgcctagactactcgtagacgaccgacggccgttactacgttacgtggtagacggacgaccgtacccacggtacgtcccggtagacggtcccgtacgggaccacgggcccggttaccgtttacggtacccgtttcgggaccggggacccggtacggggtacccgg

SEQ ID NO: 395192 - DNA, 651 bp, Homo sapiens
  misc_feature: GZ8MTXP02I8YJR.17.25.C03.1.454.CMB.2.raw
  modified_base (235)..(235): a, c, t, g, unknown or other
  modified_base (251)..(251): a, c, t, g, unknown or other
  modified_base (269)..(269): a, c, t, g, unknown or other
  modified_base (328)..(328): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctctgcaaggcttcnggattcacgtttaccnctatagtatcaactggtncgccgaggcccgcgtggacaacgacctggagtggatggggatcggggaccaaccctacncgtggtgtacacgtagtccgtcttccaccctactcccgtaccggggactcggtaaccttacccgataccgaacccaacgtaaccctccctaccaaactaaaccacacgcctaacagtcggagttagacggacgtccgtagacctatcgtacgacgtaccgacggtaccttacgtaacttcgtcggtacggaccgtaacgaccggttaccccacggtaccgttcccggggatacccgggtccgtaacggccgtaacggggtccccggtaccgttttacggtacccggtttcgggaccgggggacccgtacgggggtaacccccg

SEQ ID NO: 395193 - DNA, 574 bp, Homo sapiens
  misc_feature: GZ8MTXP02GJ08S.17.25.C03.1.454.CMB.2.raw
  modified_base (221)..(221): a, c, t, g, unknown or other
  modified_base (252)..(252): a, c, t, g, unknown or other
  modified_base (267)..(267): a, c, t, g, unknown or other
  modified_base (279)..(279): a, c, t, g, unknown or other
  modified_base (290)..(290): a, c, t, g, unknown or other
  modified_base (433)..(433): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcacatcacttgccganaagtcacggacttaaactattaatgtatcancagaaactggaaacnccccagacctcngatctctggtncatccactctgacgaagtcggcctcccagtccggaggttcccaggtgacaggtggatcgtggggacagtatttacaatctacactactcaccactcacgactaacctggaggtactgtacactaaattctacctatgtacaanacgtacgttactaccgttccctacgtactacgtttcggaccggtaacgggtaaacctaaaggttcgaaacgtaacgtaaaccgtaaaacgtaaccgttaggtcgtacgtacggaccctacgtaacgttccgttactttccg

SEQ ID NO: 395194 - DNA, 622 bp, Homo sapiens
  misc_feature: GZ8MTXP02IZLCP.17.25.C03.1.454.CMB.2.raw
  modified_base (214)..(214): a, c, t, g, unknown or other
  modified_base (359)..(359): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctnagtgaaggtctcctgcaaggcttctggtattctaccgtttacctcctatagtatacaacgtgggtcgcgccgaggccccgcgtacggaaccaacggtacctgggacggtggaagtggggagtcggggacctaaaacccccgtaanacgttgggtactccgaacgtacgttcgtacctccacccgtacgttcccgtaccgggacacgtccttaaccagtaccgacccaacgtaccttcccaacctaataaaccacacgcctaacgagtcgggagttcggaagcgcctagactagtctgacccgacgaccgtccgtataattcgtagtcgagtacgaccgtccgacgtaccggtcgacgacgccgtacgcgtacggcgtacctttgacgttcggcggtccgacgggtccg

SEQ ID NO: 395195 - DNA, 580 bp, Homo sapiens
  misc_feature: GZ8MTXP02F4JB1.17.25.C03.1.454.CMB.2.raw
  modified_base (207)..(207): a, c, t, g, unknown or other
  modified_base (321)..(321): a, c, t, g, unknown or other
  modified_base (482)..(482): a, c, t, g, unknown or other
  modified_base (497)..(497): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagctgggctnagtgagtctctgcaggcttctggattcacgtttactcctatagtatcaactggtgcgccaggccgctggaacaacgacctgagtggagtggggatcggggaccaaacccgtaanacgtggtcgcacagtccgtcttccacccgtactccgtccgggacacgaccttaccatacaccctaacgaacctccctaaccaataaaaccgacacgacctacaagtggtaacgttgaggacgcctaggtaacatacgtgaaccgaccgtaccgggtccctnttaacttacgttcgngacgacgtacgtcccacgtacgtccggtagaaccgccgtaacggcacgtcggtccttcggacgttcggacgggccgagggccg

SEQ ID NO: 395196 - DNA, 715 bp, Homo sapiens
  misc_feature: GZ8MTXP02GV1BW.17.25.C03.1.454.CMB.2.raw
  modified_base (256)..(256): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaggtctcctgcaggcttcnggattctacgtttacctctatagtatcaacgtgggtgcgccgagggcccgcgtaggaaccaacggacctggaggtggagtgggatcggggaccgaaaccctaacgacgtggtcgtacacgtagttcgttccttaccaccctagttccccgtacccggggaacacgtaaccttaccataccggaacccacgtaacctccctaccaaactaaaaccacgaacgtaccctaaacgtaagttacgggaagtttacggaagggtacgtaccgtacggaaactacgttaccgttaggaaacccggaaccgtacccggggtcccttaacgtttaaactttacggttaggtacggaaccggtaaacggtacccggtaaccccgtaacggtaaccggttaacccggggtacggaaccggttacccccgtaacggggacccgtaacggggccccgggtttttaacccgg

SEQ ID NO: 395197 - DNA, 481 bp, Homo sapiens
  misc_feature: GZ8MTXP02JPTPY.17.25.C03.1.454.CMB.2.raw
  modified_base (459)..(481): a, c, t, g, unknown or other
tcagcgtagactagcacgaccggtgctcgatttagtagtgtagatttgggtttgggagggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcacatcaccactctgcacctgagattgtgacaatctactactgtacaacagtacgttacacgttccccctcgcctacgttttcggccgaacggggtaacctaaaggtttgaagactacgaaaacgtacgtgtagctgaccccacatctgtcttcacttccttcccgctactctagtactacgttcacgtcgtaggacggcgggtcgtacggacgaacggcacagtagnnnnnnnnnnnnnnnnnnnnnnn

SEQ ID NO: 395198 - DNA, 537 bp, Homo sapiens
  misc_feature: GZ8MTXP02IKIEC.17.25.C03.1.454.CMB.2.raw
  modified_base (270)..(270): a, c, t, g, unknown or other
  modified_base (282)..(282): a, c, t, g, unknown or other
  modified_base (321)..(321): a, c, t, g, unknown or other
  modified_base (329)..(329): a, c, t, g, unknown or other
  modified_base (332)..(332): a, c, t, g, unknown or other
  modified_base (405)..(405): a, c, t, g, unknown or other
  modified_base (427)..(427): a, c, t, g, unknown or other
  modified_base (453)..(453): a, c, t, g, unknown or other
  modified_base (482)..(482): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcgagtgaaggtctcctgcaaggcttctggattcacgttacctctatgtatcaacgtggtncgccaggcccgntggacaacggacctgagtggatgggatgggcaaccctanactggtancanagtcgtcttcacccatccgtccgggacacgaccttaccatcgaccacgaactcctaccataaacgcagcctanatggacttgaggagcctgaccntctgacgacgacgccgtcatttacgngtgacgtacgacgtaccgacgcgtccggngacgccgacggcgacggtccgtcttacggccgttcggacggggaccgacgggccg

SEQ ID NO: 395199 - DNA, 584 bp, Homo sapiens
  misc_feature: GZ8MTXP02JJLYD.17.25.C03.1.454.CMB.2.raw
  modified_base (211)..(211): a, c, t, g, unknown or other
  modified_base (224)..(224): a, c, t, g, unknown or other
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccntcacttgccgganagtcacggtcttaaaacctatttaattggatcagacagaaacctaggaaaacgccccagaccctcctgactcgtctaggtgcactccactctaggcgtaaggtcgccgtaccagtcggtaggttccaggtggacaggtggacttgtgggactagtacttacatctacacctatcacctactctcacctaccgtgagtagttgtagctaaacttcctaacttacttcgaactaactacgtaacgttacccacgtttcccccaggttaccttacgtttacggaccggtaaacggaaccgtaaaggttaggataaacgtaccgaaaagtctaggtcgctacgctaaccctgttctcgtttacc

SEQ ID NO: 395200 - DNA, 634 bp, Homo sapiens
  misc_feature: GZ8MTXP02IWIOA.17.25.C03.1.454.CMB.2.raw
  modified_base (209)..(209): a, c, t, g, unknown or other
  modified_base (225)..(225): a, c, t, g, unknown or other
  modified_base (229)..(229): a, c, t, g, unknown or other
  modified_base (273)..(273): a, c, t, g, unknown or other
  modified_base (433)..(433): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcgtgggctnagtgagtctctgcagnttcnggatcacgttcctctatagtatcaactggtcgcgccgaggccgntggaccaacgcctgagtggagtgggatcggggaccaaccctagacgttggtcgtcacgtagttcgttcctaccacccacgtcccgtacccggggacacggtaccttacccagtccgtacccacgtaaacctccctaccaactaaaccacgacgtacctanagtcgggtaagttaggagggacgccgtagactacttacgtacgacccgtaaccgacccgtaccgttacttagtttaccgtggttacgacgaacggtacccgtaccccgaacggtacggttccggtacgaccggtcccgttaaccggccgacggtcccggtccgtttacgaccggtttcggtcgggaccgtacggggtcccg

SEQ ID NO: 395201 - DNA, 627 bp, Homo sapiens
  misc_feature: GZ8MTXP02GY1PO.17.25.C03.1.454.CMB.2.raw
  modified_base (338)..(338): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagagccgtggggcctgagtgaaggtctcctgcaaggtcttcgtggtattctacgtttaccctctatagtatcaacgtggtgcgccgaggccgcgtggaaccaacgcctggagtggagtgggatcgggacaacccgtaancgtggtcgacactagtccgtctccacccactcccggtacggactacgtaccttacactaccgaacccaacgtacctcctacccaataaaccaccacgacctaactagtcggtaagttaggacggacgccgttagacctaacttcgagaccgaccgaccggtcccgttattaacgtacgtggtcggacgtacgaccgtcccgaacggtcgtccgggtacgacggtcccgtaacggcgacggccgttaccgtttcggaccgtttcgggccggggaccggacggtaccccgg

SEQ ID NO: 395202 - DNA, 614 bp, Homo sapiens
  misc_feature: GZ8MTXP02GM7MP.17.25.C03.1.454.CMB.2.raw
  modified_base (259)..(259): a, c, t, g, unknown or other
  modified_base (478)..(478): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtagaagaaggcctggggcctcgagtgaaggtctcctgcaaggtcttcgtggattcacgtttaccnccttatagtatcaacgtgggtcgcgccgaggcccgctggacaacgcctgagtggagtgggagtcggggacctaaacccgtagacgttggtctcacgtgttccgtccttaccgaccctacgtcccgtaccggacacgtaccttaccagtaccgaacccaacgtaacctccctaccaaataaacccacgacgtaccagtacgtaggaggttacggaggacnccgtagacacgttcgagaccgaccgacggtcccgttattacttacggtgtgacgagtccgtacccacggtacgtccggtagaccgtccgacggtcacggtccgtcgttcgaccgttcggcgggaccgtaggtcccg

SEQ ID NO: 395203 - DNA, 692 bp, Homo sapiens
  misc_feature: GZ8MTXP02HWQH5.17.25.C03.1.454.CMB.2.raw
  modified_base (222)..(222): a, c, t, g, unknown or other
  modified_base (308)..(308): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtgtgggggtcagagtcaccatcacttgccganagtcacggtacgttaaaactattaattggtatcagacagaaaccaggaaacgccccagacctctgatctctggtgcatccatctgngaagtggctcccagtccgtaggttccgaggtcgacgtaggtggagttcgtagggactaggtactttacaatcctaacaccactccacctacctaccgaccaaaccgttgaacggtattggtacactaaatccttaaacttacgttcgaactaaacgtaacgtaacgtttaaccgaccccggtttaccccctacgggtacccgtttaccggttttaccgggaaaccccggggtaaccgggggtaaaaccccgttaaaaacggtttggggaaaaccttaaaccggttaaaccgaaaaccggtaaaccgtttgggtaacggggtccccgttaggaaccccggttaaaacccgtactttacccgtttcggtttaaaccccgtttcccg

SEQ ID NO: 395204 - DNA, 463 bp, Homo sapiens
  misc_feature: GZ8MTXP02J36TN.17.25.C03.1.454.CMB.2.raw
  modified_base (223)..(223): a, c, t, g, unknown or other
  modified_base (248)..(248): a, c, t, g, unknown or other
  modified_base (333)..(333): a, c, t, g, unknown or other
  modified_base (352)..(352): a, c, t, g, unknown or other
  modified_base (385)..(385): a, c, t, g, unknown or other
  modified_base (441)..(441): a, c, t, g, unknown or other
  modified_base (445)..(463): a, c, t, g, unknown or other
tcagcgtagactagcacgaccggtgctcgatttagtagtgtagatttgggtttgggagggggtcagagtcaccatcacttgccggacaagtcacggcgttaaaacctatttaaattggtatcagcagaaacctggaaaacgccccagacctcctgatctctggtgcatccactctgcgaagtggccgtcccatcgagttcagtggcagtggatcgtggacagntttcaatctcaccatcaccactctncaactgagattgtgcatctactactgtacaacagtacgttacacgttcccctgcctacgttttggccggaaggaactaagtaganatacgaacgtatgtacgcncgtaccccactatctcgttctactctccgtccnctacgtctacgtactagtccgtacgcgtggacggtcggcgcgacggtaacggcaanagtnnnnnnnnnnnnnnnnnnn

SEQ ID NO: 395205 - DNA, 614 bp, Homo sapiens
  misc_feature: GZ8MTXP02GU3Y1.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgagagcctgggcctcagtgaaggtctctgcaaggcttctggattcacgtttacctcctatagtatcaactggtgcgccaggccgctggacaacgcctggagtggatgggatgggacgaacccgtaagacgtggtacgtcacgtagtcgtccttccacccatccccgtaccgggactacggacctttaaccatacgaccacgtaaacctccctaccaataaaaccacaacgccctaacgagtgggtagttaggaaggacgtccctaggaacctagtccgtaggaaccgaccgaaccgggtcccgttactaacgtttacgtaggtcgaccgtagaccgtacccacggtacgtcccgggtagacggtaccctaacggcacggccgtcgtttacgactttccggcggggccgtaacggggcccg

SEQ ID NO: 395206 - DNA, 675 bp, Homo sapiens
  misc_feature: GZ8MTXP02FZ554.17.25.C03.1.454.CMB.2.raw
  modified_base (230)..(230): a, c, t, g, unknown or other
  modified_base (251)..(251): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctnagtgagtctctgcaggcttcnggattctacgttacctcctatagtatcaacgtgggtcgcgccaggccgctggaccaacgccgtgagtggagtgggagtcgggaccgaacctaaccgaccgtggtgtacacgtagttcgttccttaccaaccctacgtcccccgtacccggggaactaacggtaaccctttacccagttaccgaaaccctaaaccgtaaacccttcccctaaccaaacttaaaaccactaaccgaccctaaacgtagtacgggtaaggttacggaagggtaccgtaccgttagaaccctagttccgtacggaaccgaccgtaacccggggtccttacttaacgtttacgtgtacggacgtaacgaccgttaccccgacgtaaccgttcccgggaggtaccggacccgtaacgggccgtacggtccggtttacccg

SEQ ID NO: 395207 - DNA, 626 bp, Homo sapiens
  misc_feature: GZ8MTXP02G960U.17.25.C03.1.454.CMB.2.raw
  modified_base (276)..(276): a, c, t, g, unknown or other
  modified_base (531)..(531): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctgggcctgagtgaaggtctcctgcaaggtcttctggtattctacgtttacctcctatagtatcaacgtgggtcncgtccgaggcccgcgtcggaacaaccgtacctggagtcggagtgggagtcgggacctaacccgtaaacgacgtggtacgttaccagtacgtccgttccttaccgaccctactcccgtaccgggaacacgtaccttaccgataccgaacctacgacctccctaccaaataaacccacgacgtaccctaagagtcggagttagaacggtacgctacgactactcgtacgaccgacgacccggtctactacttacgtntacggacgtacgaccgttaccgacggtacgtccggagacggtccgtacggcacgtccgtactttcgaccgtttcggacgggacgacgggtacccg

SEQ ID NO: 395208 - DNA, 566 bp, Homo sapiens
  misc_feature: GZ8MTXP02H1GKR.17.25.C03.1.454.CMB.2.raw
  modified_base (271)..(271): a, c, t, g, unknown or other
  modified_base (364)..(364): a, c, t, g, unknown or other
  modified_base (428)..(428): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctggggcctcagtgaaggtctcctgcaaggcttctggattcacgtttacctctatagtatcaactgggtncgccaggccgctggacaacgacctgagtggatggggatggggcgaaccctagactggtcgtcacagtcgtcttcaccctatccgtccgggacncgacttacccatcgacccacgaactccctaccataaaccacacgacctacatggagttgagganccgtagacatctgaccgacaccgggcctactagttactgtgacgacgacgtcccgacgtacgtcccggtgaacgcccgtaccggcacggccggtcccgtttacggacctttcggtcgggggaccccaagggggtcccg

SEQ ID NO: 395209 - DNA, 588 bp, Homo sapiens
  misc_feature: GZ8MTXP02I9UJC.17.25.C03.1.454.CMB.2.raw
  modified_base (151)..(151): a, c, t, g, unknown or other
  modified_base (231)..(231): a, c, t, g, unknown or other
  modified_base (284)..(284): a, c, t, g, unknown or other
  modified_base (310)..(310): a, c, t, g, unknown or other
  modified_base (324)..(324): a, c, t, g, unknown or other
  modified_base (445)..(445): a, c, t, g, unknown or other
  modified_base (555)..(555): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtganacccccctcagatgacccagtcctccatccctccctgtctgcctcgtggtgggggtcagagtcaccatcacttgccgganagtcacggtacttaaaactatttaatggtatcagcaagaaacctaggaaaacnccccaagaccctctgatctctggtcnctaactccacttcncggcgtaaggtcggccctaccagtacggaggttacccaggttggactagggtggtactcggtaggggactagttatttaccaatctacacactccaccactcgtacgacacgtgaacggtnttgcactaactcttactactacgtacaaactacggtaacttaccgaccgttaccctgtaccttcgtttacggacggtaacggactaaagtgaaacacgtaacaaaacgtntacgtgtactacgacaccgtatcgtacgtttcc

SEQ ID NO: 395210 - DNA, 680 bp, Homo sapiens
  misc_feature: GZ8MTXP02IJNNK.17.25.C03.1.454.CMB.2.raw
  modified_base (240)..(240): a, c, t, g, unknown or other
  modified_base (283)..(283): a, c, t, g, unknown or other
  modified_base (565)..(565): a, c, t, g, unknown or other
  modified_base (624)..(624): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctggaggtagaagaagccgtgggcctgagtgaaggtctctgacaggtcttntggtacttcctacgtttacctctatagtactcaacgtgggtcnccgaccgacggcccgcgtacggaaccaacggcctagggacgtaggagtgggagtacggggacctaaaacccgtacgacgtggtactacgaacgtagttcccgttacctacccgacctacgttccgtaccggactaccggtaacttaccagtacccgaaccctacgtaacccttaccaaccctaaaataaaccgacacgacctaacgagtacggtagtacggacggactcgtacgaactacgtacgtagaccgtaccgaaccgttcgtaactttacttacggngtacggacgtaacgtacccggttccaacgtccggtacgtaccggaacgtcccggtaacnccggtacggtaaccgttcgttaacgtcggttccggacggggaccgtcggtaacccg

SEQ ID NO: 395211 - DNA, 662 bp, Homo sapiens
  misc_feature: GZ8MTXP02GNZ76.17.25.C03.1.454.CMB.2.raw
  modified_base (261)..(261): a, c, t, g, unknown or other
  modified_base (297)..(297): a, c, t, g, unknown or other
  modified_base (347)..(347): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgacaaggtcttcgtggtattcacgtttaccnccttaagtagtatcaacgtgggtcgcgccaggccgntggacacgccgtgagtggatgggatcgggaccaaaccctagacgttggtntcacgtgtcgtcctaccacccattcccgacgggacacgtaccttacactacgacccaacgacctccgtaccaaataaaccacaacgtaccctaacagtacggagttacggaacgtagtcccaggtacagttacgacggaaccgtaccggaccgggtacccgtttacgttaacgtttaccgtaacgggtcacgggtaaacgtccggtaaccccgtaggaccgtttaccggggagtaaccgcccgttaaacggcaaacgggtcccggttaccgtttacggtaccgtttccggacggggtcccgaaacgggtccccgg

SEQ ID NO: 395212 - DNA, 612 bp, Homo sapiens
  misc_feature: GZ8MTXP02GBT41.17.25.C03.1.454.CMB.2.raw
  modified_base (213)..(213): a, c, t, g, unknown or other
  modified_base (353)..(353): a, c, t, g, unknown or other
  modified_base (401)..(401): a, c, t, g, unknown or other
  modified_base (460)..(460): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtctggggctggaggtgaagagccgtgggcctnagtgaaggtctcctgcaaggtcttcgtggattcgtaaccgttttacctacccttaatagtatcgaaacgtggggtgccgccaggtccgcgtggaaccaacggacctggaggtggagtgggatcggggaccaaaccctaanacgttggtcgtcacgtagtcgtaccttccacctatcccgtccggaacncgtaccttaccatccgaccctaacgaccttccaccaaataaaccacacgacccttaaanagtggtagtaggacgacgtctagactactacgacgaccgacgccgtaccgtactacgttacgtgacgagacgacgtccgacggtacgtcggtagaccgccgtacggcgtacggtccgttcgttacgaccgttcggacgggaccgtacggccg

SEQ ID NO: 395213 - DNA, 606 bp, Homo sapiens
  misc_feature: GZ8MTXP02JNGHS.17.25.C03.1.454.CMB.2.raw
  modified_base (278)..(278): a, c, t, g, unknown or other
  modified_base (518)..(518): a, c, t, g, unknown or other
  modified_base (526)..(526): a, c, t, g, unknown or other
  modified_base (569)..(569): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcaggtgaaggtctcctgcgaaggtcttcgtggattctacgtttacctctatagtactcaagtgggtncgccaggccgcgtggaccaacgcctgagtggacgtgggatcgggaaccgaaaccctaacgacgtggtacgtcacgtgttccgtcttccacccctacgtcccgtaccgggacacgtaccttaccagtaccgaaccctaacgtaacctccgtaaacccaaataaaacccacacgaccctaatacggtaggtaggttagacgtacgccttaggacctatcgtacgaaccgacgccggtacctntaattcgngtgaccgagaccgtaccagtacgtccggaggacctccgacggntacggccgttacttcgacgttcggcgggacagggtcc

SEQ ID NO: 395214 - DNA, 929 bp, Homo sapiens
  misc_feature: GZ8MTXP02F6IDG.17.25.C03.1.454.CMB.2.raw
  modified_base (177)..(177): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtncagtcgtgggctggaggtagaagacgccggtcggggcctcgaggtgtaacggtcctccgtgacgaacggtcttcgtaggtacttaccgttaaccgtttttacctaccttaattacgttactaccgtacggtgggtcgccgaccgacggcccgtcgtacggacctaaccgaccgtggacggtaggagtgggtacgtaccggggaacctaaacccgtaacgtacggttggtacgtaccgtagtacgttcttacccgtacccaaccgtaccgttcccccggtaaccggggaactaccgtaaccgttaaccaacgtacccgaaccccgtaaacctaaccccgttaccctaaacctaaaactaaaacccaaccgtaaccgtacccgttaaaccgtaaggttacggggtaacggttaacggggaaccgggtaacgtacccgggttaaacaacccgttaaacgttacccggtaaaccggtaaaaccccggtacccgggttaaccccggttaacccgtttaaccgtttaaacggttttacccgggtaagggttcccgggaaaccgggttaccgggttaaaacccccgttaccccggtaaaacgggttaacccgggttcccggggttacccggaaaccggttcccccggtaacgggtaacccggtaccggggttccccggttttaaaccggttttccggggtaaacccggttttccgggggtacccgggggaaaacccgggtccggggtttaacccccggg

SEQ ID NO: 395215 - DNA, 709 bp, Homo sapiens
  misc_feature: GZ8MTXP02JSVE2.17.25.C03.1.454.CMB.2.raw
  modified_base (216)..(216): a, c, t, g, unknown or other
  modified_base (284)..(284): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctggaggtgaaggagccgtggggcctnagtgaaggtctcctgcaaggcttcgtggtattcgtacgtttacctcctatagtatcgaacgtgggtcncgccgaggccgcgtggaaccaacggacctggaggtggagtggggagtcggggacctaaacccgtaacgacgttggtcgtaccaacgtaggttcccgtaccttacccaacccctacgttccccggtacccggggaactacggtaaccctttaaccgacgttacgaaccccctaacgtaaaccctccctaccaaactaaaaccaaccaacgaccctaacgtacgtacgggaggttacggaacggacgtccgtacgtaactacgtacgtacgaccgaccgtaaccggtccgttactacgttttttacgagtcggtacggaacgtaccgtacccgtacgtacgtccggttacggacggtaccgtaccggacgacggtccggttaccgttcggtaccggttacggtcggggaccggtacggggtacccgg

SEQ ID NO: 395216 - DNA, 600 bp, Homo sapiens
  misc_feature: GZ8MTXP02GZRRZ.17.25.C03.1.454.CMB.2.raw
  modified_base (548)..(548): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctccgtgacgaaggcttcgtggtattctacgtttccctctatagtatcaacgtgggtcgccgccgaggcccgcgtcggaaccaaccgcctggagtggagtggggagtcggggacctaaacccctaacgacgttggtcgtaccacgtgttcgtccttccaccctactcccgtccggacacgtaccttacactacgaacccacgtacctccctaccaaataaaccgacacgccctaacagtcggaagttggacgacgcctagacctagtcgagaccgacgacgtcctatatacgtgcgtacgacgtccgtaccacggtactccggngacgccgtacgcacggtccgtcgtttagcgttcggaccgggacgaggtcccg

SEQ ID NO: 395217 - DNA, 551 bp, Homo sapiens
  misc_feature: GZ8MTXP02I92YL.17.25.C03.1.454.CMB.2.raw
  modified_base (383)..(383): a, c, t, g, unknown or other
  modified_base (400)..(400): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaagccccaagacctctgatctctggtgcatcccactctgacgaaagtggcgtcccaatcgagttccaggtggcagtgatctggggacagatttcaaatctcacatcacactngcaactgaggtattganacaactactactactacgtacaacaagtaacgtacgtacgtccctacgtacttacgtttacgtacggtaacgggtaaccgtaaacgttacggtaagaactaacgtaaaacgtaacgtacgtaaggtacgtacgacacctactacttacgtc

SEQ ID NO: 395218 - DNA, 633 bp, Homo sapiens
  misc_feature: GZ8MTXP02IODWF.17.25.C03.1.454.CMB.2.raw
  modified_base (294)..(294): a, c, t, g, unknown or other
  modified_base (335)..(335): a, c, t, g, unknown or other
  modified_base (385)..(385): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccattccctcctgtctcgcctcgtggtgggggtcagacgtcaccatcacttgaccggaacaaggtcaacggtacgttaaaactatttaaagttggtaatcgagacaagaaacctacggaaaacnccccaagtacctccagtatctcgtgggtcactactccactntacggcgtaagtcgccgtaccagtcgtaggtcagtcgctaggtgattcgnggactagtacttacaatcactacactaccacctatcgtacgacctaaacgtggtaaacgtcgttagacgtactaaaactttccaaacttcgttaacgtaacaaacgtacgttaacgttaccctaccgttaccccgtgtaacctttacggtttacggaaccggtaacggtaaccgttaaaggttacgaacgttaacgaacaaaaccggttatcggtaacgacttacgaccctaactctacttcgttacc

SEQ ID NO: 395219 - DNA, 533 bp, Homo sapiens
  misc_feature: GZ8MTXP02FNYU4.17.25.C03.1.454.CMB.2.raw
  modified_base (220)..(220): a, c, t, g, unknown or other
  modified_base (295)..(295): a, c, t, g, unknown or other
  modified_base (305)..(305): a, c, t, g, unknown or other
  modified_base (352)..(352): a, c, t, g, unknown or other
  modified_base (392)..(392): a, c, t, g, unknown or other
  modified_base (399)..(399): a, c, t, g, unknown or other
  modified_base (404)..(404): a, c, t, g, unknown or other
  modified_base (422)..(422): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcacatcacttgccganaagtcacggacttaaactatttaaatggtatcagcaagaaacctggaaaacgccccagacctctgatctctggtncatccactcngcgaagtcggcctccatcggagttccagtgctagtgatctggggacngtactttcaattcgtacacatccactactctcgactaacnggaagtnttcgnactaaatctaactacgtntacaaacgtagtaccgttactaccgttcccagtcctacgttcgaccgtaacgggacctaaagtgaatacgacgaaacgattggaacgtcgaacaccgactacgtctacgtc

SEQ ID NO: 395220 - DNA, 544 bp, Homo sapiens
  misc_feature: GZ8MTXP02GVSI9.17.25.C03.1.454.CMB.2.raw
  modified_base (370)..(370): a, c, t, g, unknown or other
  modified_base (392)..(392): a, c, t, g, unknown or other
  modified_base (415)..(415): a, c, t, g, unknown or other
  modified_base (457)..(457): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaaggcttctggattcacgtttacctcctatagtatcaactgggtgcgcccaggccgctggacaacgacctgagtggatggggatggggcgaaaccctaaacactggtgtcacagtcgtcttcaccccatccctccgggacngacttaccatgaccacgaaacncctaccataaaacacagcctaanagtgatgagagctagacatcagacgacacggctctatactgngcgacgacgtaccgacgacgtcggtcggacgaccgtacggacgacggtccggtccgttacgtacgttcgtcgggaccggacgggacg

SEQ ID NO: 395221 - DNA, 577 bp, Homo sapiens
  misc_feature: GZ8MTXP02ILYRV.17.25.C03.1.454.CMB.2.raw
  modified_base (209)..(209): a, c, t, g, unknown or other
  modified_base (266)..(266): a, c, t, g, unknown or other
  modified_base (278)..(278): a, c, t, g, unknown or other
  modified_base (324)..(324): a, c, t, g, unknown or other
  modified_base (328)..(328): a, c, t, g, unknown or other
  modified_base (497)..(497): a, c, t, g, unknown or other
  modified_base (540)..(540): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctgggcctnagtgaggtctcctgcaaggcttctgattcacgtttacctctatagtatcaactggtncgccaggcccgntagacaacgcctgagtggatggatgggacaaaccctaagctggtcncaancgtcgtctccacccatccctaccgggacacgtacttacactcgaacccacgactcccgacaataaaacccacacgccttaaacgatacgggtaagttggaaacggtacgcccgttagaaccctaataccgtacggaccgtaaccgaaccggcccgtattaactttacgngtagacgagacgtacccagacgtcggtagaccgtccgtaacgngacggcgtaccttgaccttcgcgggaccaggggaccc

SEQ ID NO: 395222 - DNA, 571 bp, Homo sapiens
  misc_feature: GZ8MTXP02JV8OD.17.25.C03.1.454.CMB.2.raw
  modified_base (271)..(271): a, c, t, g, unknown or other
  modified_base (322)..(322): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgccaggccgctggacacgcctgagtggatgggatcggggacaaccctaanctggtgtcacgagtcgtctcgacccatcccgtcgggacacgaccttaccatacgacccacgtaacctccctaccaataaaaccacgaacgaccctaagagttgggagtttaggacggacgtcctaggaacctatcgtagaccgtacgacggccgttatagttactgtgccgaagaccgtacccaggtactccgggtgaccgacctacgggcaggccgtctttagacgttcggcggggacgagggtcccg

SEQ ID NO: 395223 - DNA, 742 bp, Homo sapiens
  misc_feature: GZ8MTXP02IV4T6.17.25.C03.1.454.CMB.2.raw
  modified_base (296)..(296): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccatcctccctgtctgcctcgtggtggggtcagagtcacatcacttgcgacagtcacggtacttaaactatttaatggtatcagcagaaacctggaaacgccccagaccctctgactctctggtncactcccactcgtggacgtaaggtcggaccgtccctagtcggtagttccgaggttcgggactaggttggaacgttccgtagggggaacctaaggtactttttaccgaatttcccaccaaaccctacgttaccaaaccctacttaccgtcggaaccctaaacccggtgggtaaggttactttacggacgtaaacctaaacgttaacctttaaccggtactttacggtaaaccaaaccggtaaacgttaaccggtttaacccttaccccggttttacccccgacggtttaccccgtttaacgggttttacccggggaaacccggtttaaacgggggaaaacccctttaaaagggtttaccgaaaaggtaaaccttaaccgaaaaacggtacccgttaaggtcgggtaccacggtaccctaaccgttactaccgtttacggtttaaccc

SEQ ID NO: 395224 - DNA, 575 bp, Homo sapiens
  misc_feature: GZ8MTXP02HQWV7.17.25.C03.1.454.CMB.2.raw
  modified_base (271)..(271): a, c, t, g, unknown or other
  modified_base (322)..(322): a, c, t, g, unknown or other
  modified_base (363)..(363): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgccaggccgctggacaacgcctgagtggatgggatcgggacgaaccctanacgtggtgtcacgagtcgtcttcaccctatccgtccgggancgacttacatcgaccacgaactccacaataaacacacgcctacagtggagttgaggtacgcctagacatcgtacgacgacgaccggtccgtacttacttacgtggtagcggaagaccgttcccaacggtacgttccgggtagacggcccgtaacgggccgacggtcccggttccgtttcgtaccgttcggtcgggggaccgacggggtcccg

SEQ ID NO: 395225 - DNA, 621 bp, Homo sapiens
  misc_feature: GZ8MTXP02GMSUD.17.25.C03.1.454.CMB.2.raw
  modified_base (275)..(275): a, c, t, g, unknown or other
  modified_base (504)..(504): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattctacgtttacctcctaatagtatcaacgtgggtncgccaggccgctggacaacgacctggagtggatggggatggggaccgaaaccctaacgacgtggtctacgacgggttgtccccttcacccctatcccgtaccgggacacgtacctaccatcgacccacgaactcctaccaataaaccactacgacctaagagtggacttggaaggacgccctaggactaatccgtacggacgacgaccgggtaccgttctaatttacgngttccggagtaacgccgttaccccacggtaacgttccgggacggtaacgcccgtacggcaacggtccggtaaccgtttcgaccgtttcggtacggggcctagggggaccgtccccgg

SEQ ID NO: 395226 - DNA, 696 bp, Homo sapiens
  misc_feature: GZ8MTXP02JV8V2.17.25.C03.1.454.CMB.2.raw
  modified_base (274)..(274): a, c, t, g, unknown or other
  modified_base (284)..(284): a, c, t, g, unknown or other
  modified_base (320)..(320): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattctacgtttacctcctatagtatcaacgtgggtncgcaggccgntgacacgcctgagtggatggatcgggacaaccctancgtgtgtcactgtcgtcttacaccctactccgtccgggacacgtaccttaaccgatacgaacccaacgtaaaccctccctaccaaacttaaaaccaccgtaacgtacccttaacgaagttacggggtaaggtttacgggaacgggtacgtacccgttaggaaacctacgttacggtacggaaacccggtaccgaacccggggtaccccgtttaacgttaactttaacggtcggttacggaccgggtaaacgtacccggttaccccgaaaacggtccgttccggggtacggaacggtaccccggtaacggccgaacgggtcccggggttcctttacgggaccctttcgggaccgggggtaccgtacgggggtacccg

SEQ ID NO: 395227 - DNA, 553 bp, Homo sapiens
  misc_feature: GZ8MTXP02IP3G6.17.25.C03.1.454.CMB.2.raw
  modified_base (274)..(274): a, c, t, g, unknown or other
  modified_base (285)..(285): a, c, t, g, unknown or other
  modified_base (327)..(327): a, c, t, g, unknown or other
  modified_base (366)..(366): a, c, t, g, unknown or other
  modified_base (432)..(432): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacaacgacctgagtggatgggatggggcgaacccctaanactggtgtcacagtcgtcttcacccatccctccgggacncgacttaccatcgacccacgaaactccctaccataaacacaagcctaacatcggaagttgaaggancctagactatctgaccacaccggccgtctaattactgtgacgagcgtacccacgtatcccggtgacgccgtacgggcaggtccgggtcctttggacctttcgcgggggccaggggtacccg

SEQ ID NO: 395228 - DNA, 572 bp, Homo sapiens
  misc_feature: GZ8MTXP02JAU87.17.25.C03.1.454.CMB.2.raw
  modified_base (216)..(216): a, c, t, g, unknown or other
  modified_base (238)..(238): a, c, t, g, unknown or other
  modified_base (273)..(273): a, c, t, g, unknown or other
  modified_base (350)..(350): a, c, t, g, unknown or other
  modified_base (373)..(373): a, c, t, g, unknown or other
  modified_base (404)..(404): a, c, t, g, unknown or other
  modified_base (530)..(530): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaaggccgtggggcctnagtgaggtctcctgcaggcttnggtattctacgtttcctctatagtatcaagtggtncgccgacggccgcgtggaaccaacgaccgtggacgtggagtgggagtcgggaccgaaaccctacacgttggtctacncgtagtcgttacctaccgacccncgttcccgtccggaactacgtaccttaaccntacgacctaacgacctccacaaactaacacacgacctagagtgagtaggacgacgtccgagactagtcgagaccgacgtaccgaccgttctacgtatggacgacgcgacgtccgaacgtcgccgtnacgtcgacggcaggtcgtcttcgactcggacggtcgagtccg

SEQ ID NO: 395229 - DNA, 521 bp, Homo sapiens
  misc_feature: GZ8MTXP02FRMU3.17.25.C03.1.454.CMB.2.raw
  modified_base (325)..(325): a, c, t, g, unknown or other
  modified_base (363)..(363): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaaccctaanactggtgtcacagtcgtcttcacccatcctccgggacngacttacatgaccacgaactcctaccataaacacagcctacatggagttgaggagcctgacatctgacgacacggcccgtctattactgtgcgagacgtaccacgatccgatcgacgcctacggcaagcggcctttgacttcgtcggggccaacgggg

SEQ ID NO: 395230 - DNA, 617 bp, Homo sapiens
  misc_feature: GZ8MTXP02H62AW.17.25.C03.1.454.CMB.2.raw
  modified_base (209)..(209): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagctgggctnagtgagtctctgcagctctgtattctacgttacctctatagtatcaacgtggtgcgcgaggccgctaggaccaacgaccgtggaggtggagtggggagtcggggaccgtaaacccgtaaacgacgttgggtcgtacgacgtacgttccgtaccgttaccaccctacgttcccgtaccggggactacgtaccttaccacgtacgacccacgaactcccaccaaataaacacacaccctaagagtacgggtagtaggaacggtacgtcctagactagttcgtacgaaccgacgaccggtccgttactacttacgtggtcgacgagtacccgtccgagtacgttccggagaccgtccgtacgcgacgggtccgtacgtttcgacgtttcggcggggacgtaacgggtcccg

SEQ ID NO: 395231 - DNA, 520 bp, Homo sapiens
  misc_feature: GZ8MTXP02FLTKA.17.25.C03.1.454.CMB.2.raw
  modified_base (277)..(277): a, c, t, g, unknown or other
  modified_base (301)..(301): a, c, t, g, unknown or other
  modified_base (390)..(390): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaatggtatcagcaagaaacctggaaaacnccccagacctcctgatctctggtncatcccactctgcgaagtggctccatcgagttccagtgcagtgatcgtggggacagtatttcaatctcaccatcaccactctgcaaccngaaggattgtagacaatctaactactgtactaaacagtaacgttactacgttcccctcgactacgtttcggaccgacgggaccaaagttagagactacaaaacgacgtagtggctcgacactactctgtc

SEQ ID NO: 395232 - DNA, 607 bp, Homo sapiens
  misc_feature: GZ8MTXP02FNYUX.17.25.C03.1.454.CMB.2.raw
  modified_base (271)..(271): a, c, t, g, unknown or other
  modified_base (281)..(281): a, c, t, g, unknown or other
  modified_base (321)..(321): a, c, t, g, unknown or other
  modified_base (329)..(329): a, c, t, g, unknown or other
  modified_base (333)..(333): a, c, t, g, unknown or other
  modified_base (356)..(356): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggtcttctggattcacgtttacctcctatagtatcaagtggtncgccaggccnctgacacgacctgagtggatggatgggaccgaaccctaanacgtggtncacngtcgtctccaccatccgccggancgactacatcgaccacgactcctacaactaaaccacacgctacatgggatgagacgtctgacaactcgtagaacgaccgaacgtcccgtattacgttaacgtgtcgacgtacggtaccttcccgagtacggtacgtttcccggggtagacccggttccctaacggggaccgaacggggtaccccgggtttcccgtttttaaccgggtaccctttttccgggggaccgggggtacccggtaaaccccggggg

SEQ ID NO: 395233 - DNA, 598 bp, Homo sapiens
  misc_feature: GZ8MTXP02JI87W.17.25.C03.1.454.CMB.2.raw
  modified_base (251)..(251): a, c, t, g, unknown or other
  modified_base (390)..(390): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcgagtcgtgggctgaggtgaagagccgtggggcctcagtgagtctctgcagctcnggatcacgttacctctatagtatcacgtggtcgcgccaggccgctggacacgcctgagtggatgggatcggggacaaccctaacgacgtggtgtacacgagttctcttcaccctatcccgtcgggacacgtacttaccntcgaaccacgaactcctacaactaacacagacctacgtagtcggtaagttggaagggacgtcccgttagaacctacgttacggtacgaaccggtaccgaacccgggtccgtttactaacgtttaccgtgggtacggacgacggtaccgtacccgacgtaccgttccgggagttaccggacccgtacggaccgacggtccggtttcccg

SEQ ID NO: 395234 - DNA, 668 bp, Homo sapiens
  misc_feature: GZ8MTXP02H27LA.17.25.C03.1.454.CMB.2.raw
  modified_base (212)..(212): a, c, t, g, unknown or other
  modified_base (230)..(230): a, c, t, g, unknown or other
  modified_base (248)..(248): a, c, t, g, unknown or other
  modified_base (261)..(261): a, c, t, g, unknown or other
  modified_base (561)..(561): a, c, t, g, unknown or other
  modified_base (575)..(575): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctnagtgagtctctgcagctngatctacgttcctctatntatcaacgtggtnacgccaggccgcgtaggacaacgaccgtggaggtggaagtggggagtcggggaccgtaaacccctaacgacgtgggtaccgtcgaaccgtgttccgtccttcccaaccctacgtcccggttacccgggaactacggtacctttaccgacttaccgaacccgacgaacctcccctaaccaaactaaaaccacccgaacgtacccctaagtaagtcgggggtaaggtttacggaaccgggactccccgaagtaaccgtaactttcgtacgggacccgaacccggtaccggggtaccccgttnttaacgttttacgnggttgacggtacgtacgttaccccaggtaccgttccggaggaccgtcgacggacaggtccggttccttgactcgggtacgggcgtaaggcccg

SEQ ID NO: 395235 - DNA, 628 bp, Homo sapiens
  misc_feature: GZ8MTXP02H4424.17.25.C03.1.454.CMB.2.raw
  modified_base (224)..(224): a, c, t, g, unknown or other
  modified_base (306)..(306): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccatcctccctgtctgcctcgtgtgggggtcagagtcaccatcacttgccgganaagtcacggtcttaaaacctatttaaattggtatcagcaagaaacctggaaaacgcccccagtaccctcagatctctggtcncactccacgtctcgcgtaggtcgccgtaccgagtcgtaggttccgaggtcgacgtaggtggtatcgtagggactagtactttacaactctaccaactatccaccgtactctacgacgtaccgtgagtactagtacactaattaccttaaccgtacgttcgtaaacgtaacgagttaccgttaccgtaccgtttccccgtacgtccttacgtttaccggaccgtaaacggggtaacctaaaaggttacgtaaacgtaccgtaaaccgtaaaacgtacgtacggtaaccgtacgtaccgacctacctacgttccgttaacgtcc

SEQ ID NO: 395236 - DNA, 616 bp, Homo sapiens
  misc_feature: GZ8MTXP02FK0V5.17.25.C03.1.454.CMB.2.raw
  modified_base (386)..(386): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggattcacgtttacctcctatagtatcaacgtgggtgccgccaggccgcgtggacaacgacctggagtggagtgggagtcggggaccaaaccctacgacgtggtctcacgtagtcgtccttaccacccctagtcccgtccgggaacncgtaccttaccatcgaaccacgtaacctcctaccaataaaccacacgcctaacagtcggtagttaggagtacgcctaggaccagtcgtacggaacccgacgaccggtcccgtattacgttactggtacgacgtacgacgtaccccagtacgtccggtacgacgacccgtacggcctacgggcccggtacgttttcgacgtttaccgggcggggtacccgaggggtccccg

SEQ ID NO: 395237 - DNA, 702 bp, Homo sapiens
  misc_feature: GZ8MTXP02FZ67F.17.25.C03.1.454.CMB.2.raw
  modified_base (278)..(278): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattctacgtttacctcctatagtactcaacgtgggtncgccgaggccgctcggaaccaacggtacctggaaggtggagtggggatcggggaccgaaacccctaaacgacgttgggtacgtcacgtaggttcgtccttccgaacccctacgttccccgtaccggggaacacgtaccttaaccgataccgaacccaacgtaaccctccaccaactaaaaccactacgacctagagtcggaagttggaacgggagtccctaggaactacgttccgaggaacccgaaccgtaccggggtcccctttagttaaactttcccggtaggtacggacgaaacggtaaccggtccccctaagggtaccgttcccggggtaagaccgtaccccggtaacggggccctacggggccccggttacgttttcggacccgtttcgggacgggggtacccgacgggggtaccccgg

SEQ ID NO: 395238 - DNA, 662 bp, Homo sapiens
  misc_feature: GZ8MTXP02J28YF.17.25.C03.1.454.CMB.2.raw
  modified_base (264)..(264): a, c, t, g, unknown or other
  modified_base (290)..(290): a, c, t, g, unknown or other
  modified_base (400)..(400): a, c, t, g, unknown or other
  modified_base (452)..(452): a, c, t, g, unknown or other
  modified_base (484)..(484): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctgagtgacgtctctgacaggtcttcgtggattctacgtttacctcctatagtntcaacgtgggtcgccgccgacggccncgtacggaccaacggtcctgggacggtggaagtggggacgtcggggacccaaccctaaagcgtggtcgtaccagtacgtcccgtcttccaccctactcccgtacgggacncgtacttaccgatcgaaccacgtacctccacaaactaacaccgactaccacnggtacgaggttgaacggtcgcgtacggaactnttaccgagaacggaccgtaccgggttaccgtactttaacgttccgttagggaccggacgtaaccggtaccggtaaccccgtacggtaccggtacccggttaggacccggtccggtacgtaccggacggtcccggttcgttacggtcccgtttacgggaccgggtcggacggtccccgg

SEQ ID NO: 395239 - DNA, 697 bp, Homo sapiens
  misc_feature: GZ8MTXP02IUQU4.17.25.C03.1.454.CMB.2.raw
  modified_base (272)..(272): a, c, t, g, unknown or other
  modified_base (283)..(283): a, c, t, g, unknown or other
  modified_base (295)..(295): a, c, t, g, unknown or other
tcagcgtagactagcacgaccggtgctcgatttagtagtgtagatttgggtttgggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctggggcctcagtgaaggtctcctgcaaggcttctggattcacgtttacctctatagtatcaacgtgggtncgccaggccgntggacaacgccnggagtggactggggatggggacaaaccctacacgtggtactcacgtagtcgtccttaccaccctacgtcccgtacccggggaacacgggtaaccctttaaccgacgttaccgaaccccgaacggtaaacctcccccgttaacccaaacttaaaacccaccgaacggacccttaaaccgaaggttcggggtaagtttacggaacgggaaccgtcccgttaggaacctagtttacccgtagaacccggtacgaaccgggtcccttaacgttaacttaccgtggttcgaccggagtacccgtacccgacggtacgttacccgggagaccgttacccgtaacggcccgtaagggtcccgttacgtttcggaccgtttcggccgggggtaccggtacgggtacccgg

SEQ ID NO: 395240 - DNA, 707 bp, Homo sapiens
  misc_feature: GZ8MTXP02F8VIM.17.25.C03.1.454.CMB.2.raw
  modified_base (663)..(663): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaggtcttgtggtattctacgttacctcctatagtatacaacgtggtcgcgccgaggccgtcgtaggaccaacgaccgtggagtggagtgggacgtcggggaaccgtaaaccctaaccgacgtcggttacgtaccgacgtacggttcgttccttacccaacccgtacgttacccccgtacccgggaactaacgtaaccctttaaccgaagttacccgaaaccctaaccgaacccttccctaaccaaaacttaaaaccgacctacgacccctataacgggttaggggttacgaaacggggtcctcgtaacggaactacgttacggagtaaccccggacgaacccgggtcctattaaacgttcggtacgtcggacgttaccgaaccggttccccaaacgggcgttcccgggtaacnccgggttacccgacggtacgtacggtcccggttactttaccggg

SEQ ID NO: 395241 - DNA, 618 bp, Homo sapiens
  misc_feature: GZ8MTXP02IYPRZ.17.25.C03.1.454.CMB.2.raw
  modified_base (213)..(213): a, c, t, g, unknown or other
  modified_base (234)..(234): a, c, t, g, unknown or other
  modified_base (270)..(270): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggcctnagtgaggtctctgcagcttcnggattctacgtttacctcgtatagtatcacgtggtncgccgaggccgctggacacgactggaggtggagtgggagtcggggaccgaaacccctacgcgtcggtgtaccagtcgttcgtaccttccaccctacgtccccgtaccgggactacggtaccttaccagtaccgacccaacgtacctaccctacaaataaacccacacgtacctaacagtcggtagttaggaacgacgtcctaggaactgttcgacgaccgtacgacccggtccttacttaattccggtagcggacgacgtacccgtaccgacgtaccgtcgggtacgacgcccgtacggcgacgtccggtacctttcggtacgttcggccggggacgtacgggtaccg

SEQ ID NO: 395242 - DNA, 750 bp, Homo sapiens
  misc_feature: GZ8MTXP02GO3DK.17.25.C03.1.454.CMB.2.raw
  modified_base (278)..(278): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggtcttcgtggattcacgtttacctcctatagtatcaacgtggtnccgcacggccgctgacaacgctgagtggagtggagtcgggacaaaccctacacgtggtgacactagtcgtccttccaaccctacgtcccgtaccgggaactacgtaccttaacactaccgaccaacgaacctaccctaacccaaataaaacccacctacgtaccctaacgtaagtacggggtaacggttaggaacgggaacgtaccccgtaaggtaaccccaagtttcccgtaacgggaacccggaaacccggtacccggggtaaccccgttttacttaaaccgtttaaccgtcgggttaccggaccggtaaacggtaaccccggtaccccgtaaccggggtaacgttcccgggggaacgtaacccggtaccccggttacgggacccggtaaccgggtcccgggtttacccgtttttacggggaacccgttttccggggaccgggggaccccggaacgggggtttcccccgg

SEQ ID NO: 395243 - DNA, 639 bp, Homo sapiens
  misc_feature: GZ8MTXP02G3YXX.17.25.C03.1.454.CMB.2.raw
  modified_base (481)..(481): a, c, t, g, unknown or other
  modified_base (568)..(568): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaaggtcttcgtggtattctacgtttacctcctatagtatcaacgtggtcgccgtccaggcccgcgtaggaccaacgacctgaggtggagtgggagtcggggacctaaacccgtaacacgtggtcgtaccacgtagttccgtccttaccaccctacgtcccgtaccgggaactacgtaccttaccataccgacccaacgtaacctccctaccaaataaaccacacgcctaacagtcggagttcgaggacnccgtagactagtcgtacgacgaccgacgtcccttacgtacttacgtcgtagaccgtagtcccgtacccgacggtacgtcccgggtanaccggcccgtacggcgtacggccggttccgtttacggaccgtttcgggacggggtaccgacgggtaccccg

SEQ ID NO: 395244 - DNA, 761 bp, Homo sapiens
  misc_feature: GZ8MTXP02JPPDR.17.25.C03.1.454.CMB.2.raw
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttcgtggtattctacgtttacctcctatagtatcaacgtgggtgccgccgaggccgcgtggaaccaacgacctggacgtggagtggggagtcggggaccgtaaaccctaacgacgtcgggtatccgaacgtagtcgttccttccaccctacgttccccgtaccggggactacggtaacctttaccaacgtacgaacccaaccggtaacctccctacctaaactaaaaccctaccgaacgaccctaacgtaagttcgggaacgtttagggaacggtaccgtaccgttaaggaacctacgtacccgtaacggaaccggtaacccggtaacccgggtcccgttaaacgttaaccgtttaaccggtggttaacggaaccgggtaacggtaaccccgttacccccgaacggttaaaccggtcccggggttacgggaacccgtaccccgttaccggggaccgtaacgggtcccgtttacccgtttcggaaccggtttccgggaccgggggtaccgaacgggggttcccccgg

SEQ ID NO: 395245 - DNA, 709 bp, Homo sapiens
  misc_feature: GZ8MTXP02JFBKO.17.25.C03.1.454.CMB.2.raw
  modified_base (295)..(295): a, c, t, g, unknown or other
  modified_base (531)..(531): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtagaagagccgtggggcctcgaggtgaaggtcctccgtgacaaggtcttcgtggtactttaccgtaccgtttacctccttaatagtatcgtaacgtgggtnccgccgaggccgcgtacggaaccaacgaccgtggacggtggagttggggacgtacggggaaccctaaaccctagtacgtggtactccaacgtactccggttaccttaccacccgtaccttcccggccggaactacgtaacccttaacagtaccgaaccaaccgtaacctccctaaaccaaactaaaacccacgtacgaccctaaagtacgtagggtagtacgggaagacctacganactaacgtcgagacccgtaccggaaccggtcccttacgttacgtacgtcggttaccggaccgtaacgtacccgtaacccgtacggtaacgttcccggacggacccgttaccggtacgaccgttacgggtcccgttcccgttacggtcgtccggggtacccgggacggtacggggcccg

SEQ ID NO: 395246 - DNA, 792 bp, Homo sapiens
  misc_feature: GZ8MTXP02FMRMT.17.25.C03.1.454.CMB.2.raw
  modified_base (211)..(211): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctnagtgaaggtctctgcaaggcttctggattctacgtttacctctatagtatcaacgtgggtgcgccgaggccgctggacacgacctggagtggagtgggagtcggggaccgaaaccctaacacgtggtcgtacacgtagttcgtccttaccaccctacgttcccgtaccgggaactacggtaccttaaccacttacgaacccctaacggtaaacccttccctaaacccaaaacttaaaaacccaccgaaacgtacccttaaacgacgttacggggtaacgtttagggaacgggtaaccgtccgttaggaaaccctaacgtttacccggtagggaaaccccgaacccggtaaacccggggttacccccgtttaactttaaaccgtttaaccgttcgggttaccggaacccggaaacgggttaaccccgttacccccgaaacggttaaaccggttcccggggttacggaaccggtaccccggttaaaccggggcccgtaaaccggggtcccgggtttaccccgtttttacggtacccggtttccggggtaccggggggacccgttaaacggggggtacccccgg

SEQ ID NO: 395247 - DNA, 613 bp, Homo sapiens
  misc_feature: GZ8MTXP02IWT64.17.25.C03.1.454.CMB.2.raw
  modified_base (273)..(273): a, c, t, g, unknown or other
  modified_base (284)..(284): a, c, t, g, unknown or other
  modified_base (310)..(310): a, c, t, g, unknown or other
  modified_base (329)..(329): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggcccnctggacaacgcctgagtggatgggangggcaaccctagactggtncacagttcgtcttaccaccctatcccgtaccgggacaggtaccttaccatcgaacccacgtaaactccctaccaactaaaccacacgccctaacagtcggaagttggaacgggtagccgttaggaacctagtaccgttagaaccgtaccgaaccggggtccctacgttaacgttacgtcggttacgaccggtacgaccgttccccgaacggtacgtccccgggtagaccgtaccgtaacgccgacgtccgtcgtttacgaccgtggtcgggacacggggtcccg

SEQ ID NO: 395248 - DNA, 732 bp, Homo sapiens
  misc_feature: GZ8MTXP02IAGKU.17.25.C03.1.454.CMB.2.raw
  modified_base (242)..(242): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcgttggtggcagcagctacaagtcgcccactcccaggtgcagctggtgcagtcgtggggctgaggtgaagagccgtggggcctgagtgaaggtctcctgcaaggtcttcgnggtacttctacgtttacctctatagtatcaacgtgggtcgcgcgacggccgcgtaggaaccaacgacctggacgtggaacgtaggggacgtcggggaccgaaaacccgtaacgtacggtggtagtaccgaacgtacgtcgtccttaccaacccacgttcccgtaccgggaactacgtaccttacaacgttacgaaccgtaaccgtaaaccttccctaaccaaaactaaaacccacctaacgaccctaaacgtaacgttacgggtaagttacggacgggtacgtaccgttacgaacgttactaccgttagaaccgtacggaccgggttcccttaacgttacgtttacggtcgtacggaccgtaacggtacccgttaacccgaccgggttacggtacccggttacggaaccggtccggtaaacggtcgaaaccggtcccggttacccgtttaggtaccggtttccggacgggggtaaccgtcggggtacccg

SEQ ID NO: 395249 - DNA, 519 bp, Homo sapiens
  misc_feature: GZ8MTXP02GAOE7.17.25.C03.1.454.CMB.2.raw
  modified_base (224)..(224): a, c, t, g, unknown or other
  modified_base (300)..(300): a, c, t, g, unknown or other
  modified_base (346)..(346): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcaggagtcaccatcacttgccgganaagtcacggacttaaaacctatttaaatggtatcagcagaaacctggaaaacgccccagacctctgatctctggtncatccactctgcgaagtggctccatcgagtccagtgcagtgatcgngggacagtattcaatctacaccatccaccactctgacaacctgagtattgacactaatctactactgtacaacgagtacttacacgttccctcgctacgtttcggacgtacggggacctaaagtcgaagactacgaaaacgtcgtagcggactacgaccactactctcgttac

SEQ ID NO: 395250 - DNA, 592 bp, Homo sapiens
  misc_feature: GZ8MTXP02JUZYL.17.25.C03.1.454.CMB.2.raw
  modified_base (272)..(272): a, c, t, g, unknown or other
  modified_base (323)..(323): a, c, t, g, unknown or other
  modified_base (331)..(331): a, c, t, g, unknown or other
  modified_base (431)..(431): a, c, t, g, unknown or other
  modified_base (450)..(450): a, c, t, g, unknown or other
  modified_base (496)..(496): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaacgtgggtnccgccaggccgctggacaacgcctgagtggatggggatgggacaaccctanacgtggtntcagtgtcgtccttccaccctatcccgtaccgggactacgtaccttaccataccgaaccaccgtaacttccctaccaaactaaaaccacacgaccctaanagttgggagttagacgganccctaggacctagtcagaacgacgaccggtcctacttattacgtgngaccgagaccgtcccaagtcgtccggtagaccggcccgtacgggccacgggtccggtcccttttggaccgttccggcggggccgacggggtccccg

SEQ ID NO: 395251 - DNA, 597 bp, Homo sapiens
  misc_feature: GZ8MTXP02FZ4GI.17.25.C03.1.454.CMB.2.raw
  modified_base (457)..(457): a, c, t, g, unknown or other
  modified_base (484)..(484): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaacgtggtgcgccagggccgctggaccaacgacctgaggtggagtgggagtcggggaccgaaccctaaccgacgtggtagtcacgtagtgtccttccaacccactcccgtccgggacacgaccttaccattcgaacccacgaacctccctaccaactaaacacacgaccctanagtacggagttgagacgtcccagaacngtcctagaaccgacgaccggtccgtacttaacgtactgtacgtacggacgtaccggtcccaacggtacgtccggtacgtacgacccggtacggccgtaggtccccggtttacg

SEQ ID NO: 395252 - DNA, 604 bp, Homo sapiens
  misc_feature: GZ8MTXP02IFHLH.17.25.C03.1.454.CMB.2.raw
  modified_base (228)..(228): a, c, t, g, unknown or other
tcagcgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgagaagcctgggcctnagtgaggtctcctgcaaggcttctggtattcacgtttacctcctatagtatcaactgggtgcgccaggccgctggacacgacctgagtggatgggagtcgggacgaaccctacacgtggtcgcactagtcgtccttccaccctactcccgtccggggacagaccttaccatcgaccacgtaactccctacaactaaacactacaccgtacacgtacggtagttacggaggacgtcccgtagaacctactcgtcggaaccgacgaccggtaccgttcttaaacgttcgtacggttgaccggacgtaccgtaccccgtaggtaaccgtccgggtacgaaccggtacccgtaacggccggtaaacggttccgtttacgg

SEQ ID NO: 395253 - DNA, 598 bp, Homo sapiens
  misc_feature: GZ8MTXP02HLP85.17.25.C03.1.454.CMB.2.raw
  modified_base (276)..(276): a, c, t, g, unknown or other
  modified_base (314)..(314): a, c, t, g, unknown or other
  modified_base (334)..(334): a, c, t, g, unknown or other
  modified_base (355)..(355): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccactcctccctgtctcgcctgtggtgggggtcagacgtcaccatcactgaccgacagtcacggtacttaaactattaatgtatcagcaagaaacctaggaaacncccagacctctgactctcgtgggtcactactccactcnggacgaaggtcgccgtaccngtcgtaggtccaggtcgacgnggtaggacttcggaggggtacagttactttacgaacttcgactaaaccactaccaccctactcgtcgaccaccgtggacgttagttacgtagactaaatccttaaactacttgaaccaagtagtacgtacctaccgttaccctgaccttacgtttcggacccggtaagggaaccttaaggttacgaagtacctaacgaaacgtacgtaggtaacgtcacggtaccactacgttcgtctttaac

SEQ ID NO: 395254 - DNA, 647 bp, Homo sapiens
  misc_feature: GZ8MTXP02GX9G8.17.25.C03.1.454.CMB.2.raw
  modified_base (212)..(212): a, c, t, g, unknown or other
  modified_base (380)..(380): a, c, t, g, unknown or other
  modified_base (514)..(514): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggcctnagtgaacggtctcctgcaaggtcttcgtggattctacgtttaccctctatagtatcaacgtgggtcgcgtccgaggccgcgtaggaccaacgacctggagtggagtggagtcggggaccaacccgtaagcgttggtacgtaccacgtgtccgttacctccgaaccccngtaccccggtaccgggaactacggttacccttaaccaacgtacccgtaacccaacgtaaacccttacccgtaaacccaaactaaacccacgtacgacctaacgtagtacggagttagacgggatccgtagactntcgacgacccgacgtaccggtccgttactacgttacgaggtcgacgacgcccgtacgaacggtcgtaccggtgaccgtacgtaccggcgcgtaacggtccttggtaccttcgggaccggtcggaacgggtccg

SEQ ID NO: 395255 - DNA, 631 bp, Homo sapiens
  misc_feature: GZ8MTXP02HREQ2.17.25.C03.1.454.CMB.2.raw
  modified_base (217)..(217): a, c, t, g, unknown or other
  modified_base (231)..(231): a, c, t, g, unknown or other
  modified_base (239)..(239): a, c, t, g, unknown or other
  modified_base (264)..(264): a, c, t, g, unknown or other
  modified_base (274)..(274): a, c, t, g, unknown or other
  modified_base (279)..(279): a, c, t, g, unknown or other
  modified_base (285)..(285): a, c, t, g, unknown or other
  modified_base (333)..(333): a, c, t, g, unknown or other
  modified_base (434)..(434): a, c, t, g, unknown or other
  modified_base (463)..(463): a, c, t, g, unknown or other
tcagcgtagactagcacgaccggtgctcgatttagtagtgtagatttggggtttggggaaccacatctgtcctctagagaaaaaccctgtgagcacagctcctcaccatggactggacctggaggatccctcttcttggtggcagcagctacaagtcgcccactcccaggtgcagctggtgcagtcgtggggctggaggtgaagagccgtgggcctnagtgaggtctctgnaggcttcngtcttctaccgtttacctctatatntacacgtggncgcgnggccgntggaccacgctggagtgagtggatcgggacaacccgtaagcgtggtanccacgtagttccgtaccttccgaaccctacgtcccgtaccgggactcgtaccttaccacgttccgaaccctaacgaacctccctacaactaaaccacgacnccctatacgtgggtagttacgagggtacnccgtacgaacctgtcgtacaccgtaccgccggtcccttacttaacgttccgtggtacggtacggaacgtcccggtaaccgtaacgggtacgttccgggaaacgccgttcccgacggacgtccggtccggtccgttacgtcggttccggacggggccggtacggtcccg

SEQ ID NO: 395256 - DNA, 623 bp, Homo sapiens
  misc_feature: GZ8MTXP02HZI6S.17.25.C03.1.454.CMB.2.raw
  modified_base (294)..(294): a, c, t, g, unknown or other
  modified_base (301)..(301): a, c, t, g, unknown or other
  modified_base (367)..(367): a, c, t, g, unknown or other
  modified_base (374)..(374): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctatggtgggggtcagagtcacatcacttgccggacaagtcaggtacgttaaaactattaaattggatcagcaagaaacctaggaaaacgccccagacctcctgactntctggtncactccatctgacgaagttcgcgtccatcgagttccagtgcagtggatcgtgggaacagtactttnaattcanaccatacacactctgacaacgtagaggatttaggtacaactaactactaacttacgtagtaacaacgtaagtaacgttaaccgtaccgttaccccgtacgtaccgtttaccgtttaccggggaacccgtaaacggggtaaaaccgttaaaaggtacgtaaagtaaaccgtaaacgtaaaaccggtaacggttacgggtaacggtaccgtaccgtaacccgtaacccttacgttaccgttacgtttaccg

SEQ ID NO: 395257 - DNA, 644 bp, Homo sapiens
  misc_feature: GZ8MTXP02HRELT.17.25.C03.1.454.CMB.2.raw
  modified_base (179)..(179): a, c, t, g, unknown or other
  modified_base (247)..(247): a, c, t, g, unknown or other
  modified_base (493)..(493): a, c, t, g, unknown or other
  modified_base (517)..(517): a, c, t, g, unknown or other
  modified_base (558)..(558): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatccctcttcttggtggcagcagctacaagtcgcccactcccaggtgcagctggtncagtcgtggggctggaggtgaaagagccgtggggcctgagtggaaggttcctcctgacaggtcttcgnggtacttctaccgtttacctctaatagtatcaacgttggtcgccgccgagggcccgacgtacggaaccaaaccgtcctagggaaggtggaaggtggggagtcggggaacccgtaaacccctaaacggtcgttagggttgtacccgaagtaggtcccgttccttacccgaccctaccgtcccgtaccggggactacgtaccttacactccgaacccaacgtactccctacaaactaaaccacgtacncctaacagtggtagtgaacgggcnctagtacatcgtagacgacgaccgtctatactcgtcgacgngacgccgtaccgacgtacgtcggtacgaccgtacgccgacgtacggtccgttacgttcgtacgtcggtacggaccggtacggaccg

SEQ ID NO: 395258 - DNA, 654 bp, Homo sapiens
  misc_feature: GZ8MTXP02J1S8F.17.25.C03.1.454.CMB.2.raw
  modified_base (257)..(257): a, c, t, g, unknown or other
  modified_base (278)..(278): a, c, t, g, unknown or other
  modified_base (338)..(338): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcgagtgaaggtctcctgcaaggcttctggtattctacgtttaccncctatagtatcaacgtgggtncgccaggccgctggacaacgcctgagtggatgggatggggaccaaccctaacgcgtggtntaccactaggttcgtccttaccaacccctatcccgtaccggggaactcggaacctttacccgataccgaaaccctaccggtaaaccctccctaacccaaactaaacccaaccaacggacccttaacgagttacggtaaggttacggacggacgtaccgtacggactacgttccgacggaaccgaaccgtaccgggtccgtacttaacgttaccgtggtacgacgacggacgtccccgacggtcgtccgggtagccgtacccgacggcaacggtccggttccgtttacgccgttcgtcgggggacccaggggccccg

SEQ ID NO: 395259 - DNA, 655 bp, Homo sapiens
  misc_feature: GZ8MTXP02F1XBS.17.25.C03.1.454.CMB.2.raw
  modified_base (253)..(253): a, c, t, g, unknown or other
  modified_base (336)..(336): a, c, t, g, unknown or other
  modified_base (420)..(420): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtgcgccaggccgctggacaacgacctgagtggatgggatcggggaccaaaccctaacacgtggtntcacgtagtcgtccttccacccatcccgtaccgggacagaccttaccataccgaccaacgaaacctccctaccaaataaaaccncaacgaccctaacaagtcggggaaattcggaagggacgcccgtaggaccattaccgtcgaaccgaaccgtaaccgggccccgttacttaaacgtttaccgttggtacggaccggaacgtacccgtaccccaacggtacttcccggggtagaaccgtcccgtaacggccgtaaacgggtcccgggtcccttttaggacccgtttccggtacgggggcccccaagggggtaccccgg

SEQ ID NO: 395260 - DNA, 637 bp, Homo sapiens
  misc_feature: GZ8MTXP02HVTNU.17.25.C03.1.454.CMB.2.raw
  modified_base (235)..(235): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgctcactcccaggtgcagctggtgcagtctggggctggaggtgaagagccgtggggcctcgagtgaagtctcctgcagcttnggattcctacgttacctctatagtatcaacgtgggtgccgcgaggccgcgtggaacaacgacctggagtggagttgggatcggggacctaaaccctaacgacgtgggtcgtacacgtagtcgttccttaccaccctatcccctacgcaaccacgtacctaccagtacgaaccaacgaccctccacccaaactaaaccgaccaagtaccctacgtagtagggtagttacggaacggacgtaccgtgaactacgtccgtacggaaccgaccgtaccggcctttactaattaccgtgtacgacgtacggtaaccgtcccgaaacggtacgtcccgggtaagcccgtacccgtacgggcgtaccggtccggttaccgttagtaccgtttcggggaccggggtccgg

SEQ ID NO: 395261 - DNA, 754 bp, Homo sapiens
  misc_feature: GZ8MTXP02I8DKD.17.25.C03.1.454.CMB.2.raw
  modified_base (287)..(287): a, c, t, g, unknown or other
  modified_base (327)..(327): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggactggaggtgaagaagccgtggggcctcgagtgaagtctctgcaaggcttcgtggtattctacgtttacctctatagtatcgagtggtgcgcaggccgntggacacgactggagtggagtggagtgggaccaaccctancgtggtagtcacgtagtcgtccttacaccctactcccggtcccgggaactacggtaccctttaaccgagttaccgaaccctaacggtaaaccccttcccgtaaacccgtaaaattaaaaccccacgtaaaccggtaccccttaaaaggtacgttaccgggggtaaggtttaacgggaacggaccgtacccgttaggaaaccttaccgttacggacgaaacccggtacggaaccccgggttaccccttagttaacgtttacggtacggtccgaacggtaacggtaccccgttaaccccgacgggtacgtttcccggggaagaaccccggttcccgtaaaccggggtccaagggttccccggttacgttttaacccgaccgggtttccgggggttaaccgggggaccggttaacgggggttaccccccg

SEQ ID NO: 395262 - DNA, 751 bp, Homo sapiens
  misc_feature: GZ8MTXP02IO8RQ.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggcctcagtgaaggtctcctgcaaggtcttctggtattctaccgtttacctctatagtatcacgtggcgcgcgaggccgctggaccacggacctggacgtggagtgggagtgggaccgaaccctactacgtggtcgtacactaggttccgttaccttacccacccgtacgttcccccgtaccggggaactacggtacctttaacccgaagttaccgaaccccgtaacgtaaaccttccctaaaccctaaacttaaaacccgaacaaccggtaacccgtaacctaacgggttgggtaaggtttacggaaagggacggtcccttaaggaactacgtaccgttacggaaccggaccgtacccggggtacccgttacgttaactttaccggtggttcggtaacgggtaccgaaaccggttccccgaaacggttccgtaaccggggttcggaaacccggcccgttaaccggggccgtccgggttaaccgggttccccgtttaagtccccggggtttagggtcccgggggacccggaacgggggtcccccg

SEQ ID NO: 395263 - DNA, 641 bp, Homo sapiens
  misc_feature: GZ8MTXP02GK1GX.17.25.C03.1.454.CMB.2.raw
  modified_base (209)..(209): a, c, t, g, unknown or other
  modified_base (247)..(247): a, c, t, g, unknown or other
  modified_base (276)..(276): a, c, t, g, unknown or other
  modified_base (316)..(316): a, c, t, g, unknown or other
  modified_base (420)..(420): a, c, t, g, unknown or other
tcagcgtagactagcacgaccggtgctcgatttagtagtgtagatttgggtttgggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctgggctnagtgaggtctctgcaaggcttctggattcacgtttacnctatagtatcaactggtgcgccaggccgntggacacgctgagtggagtgggatgggacaacccgtaacncgtggtgtcacgtgtctcttaccacctactcctccaggcaacgaccttaccagtaccgaccaaccgtaccttaccctaccaaactaaaccacaacgtaccctanagtcgggagttaggaacgcgtaccctaggactacgttcgtacggaaccggtacgacccgggtccgttacttaaagtttacgtcggtacgacggtaacgtaccggttaccccgaagtaccggttcccggggtaggaaccgtacccggtaacggaccggaacgggtccccggttacgttttcggacccgtttaccggggaccgggggtacccgtaaccggggg

SEQ ID NO: 395264 - DNA, 672 bp, Homo sapiens
  misc_feature: GZ8MTXP02GIA6X.17.25.C03.1.454.CMB.2.raw
  modified_base (276)..(276): a, c, t, g, unknown or other
  modified_base (288)..(288): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggtcttctggattctacgtttacctcctatagtatcaacgtgggtcncgccaggcccgntaggaccaacgacctggacgtggacgtggggatcggggaacgtaaaccctaagacgtggtctaccgacgtagtcgtccttaccaccctacgtcccgtaccggactacgtaccttacaagtccgacccaacgtaaccttccctaaccaaactaaaaccacgaaccgtacctaactagtacgggtagttacggaaacgcgtacccctaggaaacccttacgttacgacggaaaccgtaccggtaccggtacccttacgttacgttcgtacggtacgaccggtaacgtccgtaccgacgtaccggtacggacgtaaccgtaccggtacgggtcgaccggtccgttacgtttacggtaccggttcgggacgggtaccggacggggtcg

SEQ ID NO: 395265 - DNA, 636 bp, Homo sapiens
  misc_feature: GZ8MTXP02IA5VP.17.25.C03.1.454.CMB.2.raw
  modified_base (282)..(282): a, c, t, g, unknown or other
  modified_base (293)..(293): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtcgcagctggtgcagtcgtggggctgaggtgaagagctgggcctcgagtgaaggtctccgtgcgaaggcttcgtggtacttctacgtttacctcctaatagtatcaacgtggtcncgcacggccgngtcggaaccaacgaccgtggacgtggacgtgggagtacggggaccaacccgtaaactcgtggtactcgaacgtacgtcgtaccttccacccctacgtccgtaccggactacgtaccttacacgtacgtaaccgaccgtaaactaccctaccgaaataaaccacgactacctaacgagttcggtaagtcggacgactccgtagactacgtcgtagacgtacgaccgtcgttacttactacgtgttacgacgtacgtaccctacgacgtaccgttcggacgacgtccgacggtcgaacggtcccgtcgtttacggactttaccggcgggaccgacggggtacccg

SEQ ID NO: 395266 - DNA, 763 bp, Homo sapiens
  misc_feature: GZ8MTXP02GJYOX.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctcagtgaaggtctcctgcaaggtcttctggattctacgtttacctcctatagtatcaacgtgggtgccgccgaggccgcgtaggaaccaacggacctggacgtggagtggggagtggggacctaaacccgtaacgcgttgggtcgtaccaacgtaggttccgttccttccaacccctacgtccccggtaccggggaactacggtaacccttaacccagtaccgaacccctaacgtaaaccttcccctaaccaaattaaaacccactaacgacccttaaacgagttacggggtaagttacggaacgggtacgtacccttaggaacctacgttccggtacggaacccgaaccggtacccggtccccgtttaacttacgtttaccgttggaccggaccgggtaaacgtacccggttacccccgaaacgggtacggttaccccgggggtacggtacccggtacccccggtaacggggccccgtaacggggtccccggttcccgttttacggtaccgggtttcccgggaacgggggtccccgtaacgggggtcccccgg

SEQ ID NO: 395267 - DNA, 680 bp, Homo sapiens
  misc_feature: GZ8MTXP02F2H8O.17.25.C03.1.454.CMB.2.raw
  modified_base (443)..(443): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagcgtggtgcagtctggggctgaggtgaagaagctggggctcagtgaagtctcctgcgaaggtcttactggtacttccgaccgttttaccctccgtaatagtataccaacgtggtcgccgccgtaggcccgcgtaggaccaacgacctggagtggagtaggggatcgggaccgaaccctaaacgcgtcgtgtcacgtagtcgttccttccacctactccgtcccggacacgtaccttaccagttacgaccaacgtaacctccctaaccctaaanaaaccacaacgtacctaagtagtcggtacgttaggacggacgtaccgtagtaaccgtacgtacgacgaaccgaccgtaccggtccgttaacgttacgtttacgtcggtacggaccgtacggtacccgtaccgaacggtaccggtacccggtacggaaccggtacccgtacggccgtaccgggtcccggttaccgtttacggtaccggttcgggaccggggaaccggtacggtcccgg

SEQ ID NO: 395268 - DNA, 835 bp, Homo sapiens
  misc_feature: GZ8MTXP02F8N9O.17.25.C03.1.454.CMB.2.raw
  modified_base (168)..(168): a, c, t, g, unknown or other
  modified_base (245)..(245): a, c, t, g, unknown or other
  modified_base (264)..(264): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtncagctggtgcagtctggggctaggaggtgaagaagccgtggggcctcgagtgaaggtctccgtgactaaggcttcgnggacttctaccgtttaccncctatagtactacaacgtaggtcgccgccgacggcccgcgtacggaaccgaaaccggaccgtaggagtacgggaagttcggggaagttacggggacccgaaaaaccccgttaacgtaccggttaggttacgtaccgtaaacggttacggttcggtttacccttaccccgaaccctaaccgttccccggtacccggggaactaccggtaacctttaacccgaacgttacccgaaaccccgtaaacgtaaaccccttcccctaaacccgtaaaacttaaaaacccacgaaccgtacccttaaacgtaaccggtggggtaacgttagggaaaccgacgttacccgtaaggaactaactttccggacggaaacccgtaccggaaacccggtttccccgttaattaacggtttaccaacggtcggaaccgtaaaccgtacccgtacccgtaaaacggtcggttccccggaggaaacggtaccccctaacgggggacctaaaccgggggtcccgtttaccttttacgggaacccgttcccgggggtccgggggaaccctaacgggggttacccccgg

SEQ ID NO: 395269 - DNA, 558 bp, Homo sapiens
  misc_feature: GZ8MTXP02F10VM.17.25.C03.1.454.CMB.2.raw
  modified_base (286)..(286): a, c, t, g, unknown or other
  modified_base (324)..(324): a, c, t, g, unknown or other
  modified_base (369)..(369): a, c, t, g, unknown or other
  modified_base (407)..(407): a, c, t, g, unknown or other
  modified_base (431)..(431): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaactgggtgcgccaggccgntggacaacgcctgagtggatggatgggacaaaccctanacgtggtcgacactagtcgtcttccacccactcccgtaccggacncgtactaccatcgaccacgaacctcctacaataaaccncacgcctacagtcggatgaggacnctgactatctagacgacgacggccgtacttaattacgtggtcgacggtagacgtaccccgaggtacctccgggtagacgtccgtacggcacggcgtacttcgacgttcggcggggaccagggtaccg

SEQ ID NO: 395270 - DNA, 689 bp, Homo sapiens
  misc_feature: GZ8MTXP02FWY5M.17.25.C03.1.454.CMB.2.raw
  modified_base (213)..(213): a, c, t, g, unknown or other
  modified_base (256)..(256): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctnagtgaaggtctcctgcaaggtcttcgtgattctacgtttaccncctaatagtatcaacgtggtcgccgtccaggccgctgggaaccaacgcctggagttggagtgggagtcgggacctaaaacccctacgacgttcgggtcaccgacgtagttccgtaccttaccaccctactcccgtacccgggaatacgtaccttaaccgagtacgaccctaacgaacctccctaccgaaataaaccacgaacgaccctaacgatacgggtagtttacggaggtaaccgccgtaaggaacctacgtcgtaacgaaccgtaacccgaccggtacccgttacttaaagttcccgtaggtagaccggagtaacccgccccgtaaaaggccgttaccgggaggaccgtacccgtaacgggccgtaaccggtccggtttaccgtttacggtaccgtttcgggtacggggtacccgaacggggtccccgg

SEQ ID NO: 395271 - DNA, 654 bp, Homo sapiens
  misc_feature: GZ8MTXP02FM8NN.17.25.C03.1.454.CMB.2.raw
  modified_base (329)..(329): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcaccgtttacctcctatagtatcaactgggtgcgccaggccgcgtggaccaacgcctgagtggatgggatgggccaaaccctaacncgtggtcgtcactagtcgttccttccaccctacgtcccgtaccggggaacacgtaccttaaccagtcgaaaccctacgaaaccttccctaccaaataaaaccactacggaccctaacgagtagggtaagttagggaggacgtccttaggacaagtccgtaggaacccgaacgaaccggtcccgttattaactttaccgtgtcggacgtagaccgtacccccgaagtaccgtccgggtagacggtacccgtaacggggctaaacgggtcccggttcccgtttacggtaccgtttccggacggggggtaccccgaggggtaccccgg

SEQ ID NO: 395272 - DNA, 654 bp, Homo sapiens
  misc_feature: GZ8MTXP02G14RO.17.25.C03.1.454.CMB.2.raw
  modified_base (285)..(285): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagacgccgtgggcctcgagtgaacggtctcgtgcgaggtcttcgtggtattccgtacgtttacctcttatagtatcgaagtggtcncgccgacggccgacgtcggaaccaacggtcctggacggtggaggtacggggagtaccggggaccctaaaaccccgtaacgacggttcggtagtacctaacgtacggtcccgttcctaccaccctacgtcccggtacggaactacgtactacactaccgaccacgtactcccaacaataaaccgacacgtacctagagttaggcgtagggacgactaccgtagactacgtcgtacgaccgtacgaccgtccttaagtacgtcgtcgtcggacgtacgaccgtacgacgttcggtccggtagacccgtaccgcggtacgccggtaacgttcgttaccggtacgttccggggtacggaccggtacgccccgg

SEQ ID NO: 395273 - DNA, 583 bp, Homo sapiens
  misc_feature: GZ8MTXP02IRVE4.17.25.C03.1.454.CMB.2.raw
  modified_base (273)..(273): a, c, t, g, unknown or other
  modified_base (326)..(326): a, c, t, g, unknown or other
  modified_base (445)..(445): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattctaccgtttacctcttatagtatcaactgggtncgcaggccgctggacacgacctgagtggatgggatcggggacaaacccctaanacgtggtgtcacgtagtcgtccttccacccctatcccgtccgggacacgtacttacccatcgacccaacgaacctccctaccaaataaaccacacgcctaacagtggtagttgaaggancctagactagtctagacctacgaccggccgttactattcgtgtggacgagaccgtcccgagtacgtcggtagaccgtaccgtaccggcacggtccggtccgtttacgccgtttcggacggggaccgacgggtacccgg

SEQ ID NO: 395274 - DNA, 593 bp, Homo sapiens
  misc_feature: GZ8MTXP02JSG08.17.25.C03.1.454.CMB.2.raw
  modified_base (210)..(210): a, c, t, g, unknown or other
  modified_base (272)..(272): a, c, t, g, unknown or other
  modified_base (284)..(284): a, c, t, g, unknown or other
  modified_base (324)..(324): a, c, t, g, unknown or other
  modified_base (331)..(331): a, c, t, g, unknown or other
  modified_base (446)..(446): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctggggcctnagtgaaggtctcctgcaaggcttctggattcgacgtttacctcctatagtatcaactgggtncgccaggcccgnacgacacgactgagtggagtggagtacggaacaaacctanacgtgtntacagtagtctctaccacctctccgaccggaactacgtacctaacgactacgaacctaacgtaacctcccaacaaactaaacacgtacacctaagagtggagtagaggcacctanacatacgtacgaccgaccgaccggtaccgttacgttacttacgtagtacgtacgacgtaccgtacccgtaccgacggtaccggtacggtacgtaccgtacggacgcggtccggtcgttacgtacgtacggtacgggacggacggcgg

SEQ ID NO: 395275 - DNA, 618 bp, Homo sapiens
  misc_feature: GZ8MTXP02ISFPY.17.25.C03.1.454.CMB.2.raw
  modified_base (209)..(209): a, c, t, g, unknown or other
  modified_base (335)..(335): a, c, t, g, unknown or other
  modified_base (439)..(439): a, c, t, g, unknown or other
  modified_base (510)..(510): a, c, t, g, unknown or other
  modified_base (516)..(516): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctgggctnagtgaagtctctgcaaggcttctggattctacgtttacctcctatagtatcaacgtgggtgcgccgaggccgctggaaccaacggacctggagtggagtcgggagtcgggaccgaaacccctaacncgtggtcgtcactaggtcgtccttcacccctactcccgtaccgggacacgtaccttaaccagtaccgaaccaacgaaacctccctaccaaaataaaccacgacncctaacagtggtaagtcggaaggacgctagactagtcgtagacgtaccgacggtacccttgtaaacttcgnggtacncgggaactaccgtaccacgttaggtcccggtagacccggtccgtaacggccaacggtccgttcgtttaacggcctttcggccggggaccgtacgggggtccc

SEQ ID NO: 395276 - DNA, 715 bp, Homo sapiens
  misc_feature: GZ8MTXP02FOO69.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctccttatagtatctaacgtgggtcgcgccgaggccgcgtcggacaacgtacctgagtggatggggagtcggggacgtaaacccctaacgacgtggtacgtcacgtagtcgttccgttccaaccccgtacgtccccgtacccggggaactaccggtaaccctttaaccacgttaccgaaaccctaaccgtaaaacccttaccctaaactaaaccttaaaaccgaccctaaaccggtaccgttaccctaaaggtacggtaacgggttagggttaacgggaacggtacccgtacgtaccgtaacttcgtaccgtaccggaaccgaccggtacccggtcttattacgtacgtcgtacgacggtacgtaacccgtcccggaacgttaccgggtccggaacgtcccggaaccgtcgacgaacccgggttccttcggttacgtcggttacggggaccggacggtacccggg

SEQ ID NO: 395277 - DNA, 711 bp, Homo sapiens
  misc_feature: GZ8MTXP02IG8EU.17.25.C03.1.454.CMB.2.raw
  modified_base (600)..(600): a, c, t, g, unknown or other
tcagcgtagactagcacgaccggtgctcgatttagtagtgtagattttgggtttggggaaccacatctgtcctctagagaaaaccctgtgagcacagctcctcaccatggactggacctggaggatcctcttcttggtggcagcagctacaagtcgcccactcccaggtgcagcgtggtgcaggtcgtggggctggagggtagaaggaagccgtgggcctcgagtaggacggtctccgtgcgaaggcttgtggtacttctaaccgttttaccctaccgtaattagtatacgaacgtcgggtcgccgccgacggccgtcgtacggaaccaaccggccgtaggaggtggagtaggggacgtcggggacctaaaaccccgtaagtacgtggtacgtacacgtaggttccgtacccgtttacccaaccctaccgttcccggtaccggggactacgtacccttacgacgtacgtaaccccacgtaaacctccctaaacctaaactaaaccaacgtacgtaacctaactaaggtacggtaacgttggaacgggactccgaagactacgtcgtagaaccgtaccgacggtccctaattacgtttcgnggtacgacgtacggtacccttaccgacggtcggtaccgttacggaccgcgtaaccggtcgccggccgtttaccgtttcgaccgtttcgggaccggggaccgtacgggcccg

SEQ ID NO: 395278 - DNA, 592 bp, Homo sapiens
  misc_feature: GZ8MTXP02F62HY.17.25.C03.1.454.CMB.2.raw
  modified_base (223)..(223): a, c, t, g, unknown or other
tcagcgtagactagcacgaccggtgctcgatttagtagtgtagatttggggtttgggggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcacatcactgccganagtcacggtacttaaaactatttaaatggtatcagcaagaaacctaggaaacgccccagaccctctagactctctggtcacactccactcgtaggacgaggtcggccctaccagtcggtaggttcaggtggactaggtggatcggtggggaactagtatttacactctacacctataccacctactctcgactaacgtggaagtgttgacgtactaattcctaactcgttagaacaacgtagttaccgtaccgtaccgttccccgtgtacttacggtttacggaccgtaacggggtaacctaaaggttccggaaatacgtaaaccgaaacgtagttggaacgtactgaccctaatcgttctcgtttacc

SEQ ID NO: 395279 - DNA, 680 bp, Homo sapiens
  misc_feature: GZ8MTXP02HN348.17.25.C03.1.454.CMB.2.raw
  modified_base (275)..(275): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcaccgtttacctcctatagtatcaactgggtncgccaggccgctggacaacgacctgagtggatgggatgggccgaaaccctaagactggagtcactagtccgtcttaccaccctagtccctaccggggaactcggtaaccttaacccagttacgaaccctaacggaaaaccttccctaacctaaataaaacccacgaacgtccctaaaccaggttacggaagtttcgaaagggtagacccgttaggaaccattcccttaagggaaccgaacccgaaggggtcccccgtttacttaacgttaccgtggtacgacggtaacgtaccgtaccccgtaggtaccggttaccgggacgtaccggtacccgtacggacccgtacgggttccgttccgtttacggtcccgttacggggccgggggtaccgtacgggggtcccg

SEQ ID NO: 395280 - DNA, 809 bp, Homo sapiens
  misc_feature: GZ8MTXP02F1NX8.17.25.C03.1.454.CMB.2.raw
  modified_base (228)..(228): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccatcctccctgtctcgcctcgtggtggggtcagagtccaccatcacttgaccgganagcaacggtacttaaaactatttaaatgtatcagacaagaaacctaggaaaaccgccccaagaccctctagactctcgtggtcactactcccacttcgtagacggtaacggtccgggtacccgtaccccgtagttaccgggtaaggtttacccgagggttcgggacgtaggggttacggacgttaccgggtagggggtaacctaaggttaaacttttaccgaaacctttccctacctaaaaccctaaccttaacccaaaccccctaacttaccgtaccgtaacccgtaaacccggtagggtaaacggttaagtttcggtaacgtaccgttaaaaccttaccttaaaaccttaaccgttaacggtaaaaccctaaaacggttaaacgttaaacccgtttaacccgttaccccgtttacccccgttaccgttacccgtttaaccgggttttacccgggaacccgggttaaaacgggggtaaaacccgtaaaacgggtttaacggaaaccgtaaacgttaaccgaaaaacggttccgtaggtaacgtacgtaccgtacctaacctacttaccgttacgtttacc

SEQ ID NO: 395281 - DNA, 741 bp, Homo sapiens
  misc_feature: GZ8MTXP02JCVE0.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtgggctcgagtgaaggtctccgtgcgaaggtcttcgtggtacttctaccgtttacctctaatagtatacgacgttgggtgccgaccgacggccgcgtacggaaccaacggccgtggaggtggagtggggagtcggggaacctaaaccctaacgtcgttcggtcgtaccaacgtaggttccgtaccttcccaaccccgtacgttcccccggaaccggggtaacctacgggtaccccttaaaccgtaacgtacccgaacccctaaacgtaaaccccttccctaaacccaaaacttaaaacccgacctaaaccggtaccctaagtaaggttcgggtaaaggttacgggaacggtacgtcccgttaagaaccgtaaattccggtacgaaaccgtaccggaaccgggtttcctactttaacgtacgttggaccgacggtacgacccgttcccgaagtacgggttccgaagtacgtacccgtacggaccgtcggtccgtccgtttacggaccgttcgggacgggtaccggagggtaccccgg

SEQ ID NO: 395282 - DNA, 762 bp, Homo sapiens
  misc_feature: GZ8MTXP02HT9V5.17.25.C03.1.454.CMB.2.raw
  modified_base (251)..(251): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtagaagacgccgtggggcctgaggtagaaggtcctccgtgacgaaggtcttcgnggtacttccgtaccgtttaccctcctatagtactcaacgtgggtcgccgccgaggccgagtacggaaccaacggacctggaggtaggaggtaggggacgtacggggaccctaaaacccgtaacgacgttggtcgtaccgacgtagttcccgttccttacccgaaccccgtacgttccccggtaaccggggactaccgtaaccttaacacgtaccgaaaccctaaccgtaacctcccaacctaaactaaaaccgaccacgtacctaacgagttacgggtaagttcgggaaacgggtacgtcccgtaaagacctacgtaccgtacgaaaccgacccggtaccgggtccttaacgttacgttaacggtcggttacgaccggtaacgtaccccggttacccgaaacggtcccggttccgggaacggtaccccggtaccgtacggaccgtaccgggtccggtttaccgttacggtaccggtttcgggacccggggacggtaaccggggtcccccgg

SEQ ID NO: 395283 - DNA, 755 bp, Homo sapiens
  misc_feature: GZ8MTXP02JKIH4.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagcgtggtgcaggtcgtggggctggaggtagaagacgccgtgggcctgagtgaacggtctccgtgacgaaggtcttcgtggtacttcgtacgtttacctactagtagtatcaagtggtcgccgccgacggtccgcgtacggaaccaacgtacgtggtagtaggagtgggagtacgggacctaaaccctacgcgttggtctacgaacgtagttcccgtaccttacccacccgtacgtccccggtaaccggaactaccgtaccttaaccgacgtaccgaacccgaccgtaaaccctaccctaaaccctaaaactaaaacccgcgaaccgtacccgttaaagacgttacgggtaaagttacgggaacgggtacctccgtaagacttaaacgtcggtaaccgaaaccggtacccggacccggttaccttacgttaacgtttaccgtaggtccggaacgtacgtaaccccgttacccgaacggtaaccgggttccgggtagaaccccggttccgaaaccggtcgaccgggttccggtttaccgttaccggtacggttccggggacgggggaccccgtaacggggtccccgg

SEQ ID NO: 395284 - DNA, 588 bp, Homo sapiens
  misc_feature: GZ8MTXP02IBZLX.17.25.C03.1.454.CMB.2.raw
  modified_base (225)..(225): a, c, t, g, unknown or other
  modified_base (259)..(259): a, c, t, g, unknown or other
  modified_base (278)..(278): a, c, t, g, unknown or other
  modified_base (298)..(298): a, c, t, g, unknown or other
  modified_base (304)..(304): a, c, t, g, unknown or other
  modified_base (318)..(318): a, c, t, g, unknown or other
  modified_base (493)..(493): a, c, t, g, unknown or other
  modified_base (558)..(558): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtccaccatctacttgccgganaagtcacggtacttaaaacctatttaattgtatnagcaagaaactaggaaacnccccagaccctctgactctntggtcnctactcccactcgngaccgaagttcggccgtacccagtcggtaggttcccaggtgcgtaggtcggatcgtggggactagtatttacattctacactactcaccctacgtctgaccctaacgtggtaggtacttgacgtactaacttacctactactcgtaacaactagtacttacgtaccgtttccccncgtacttacgttacggaccgtaacggggacctaaagtcgaactacgtacgaaaacgtcttcgggngtactcggacctactacgtttctacgttcc

SEQ ID NO: 395285 - DNA, 633 bp, Homo sapiens
  misc_feature: GZ8MTXP02FPDH4.17.25.C03.1.454.CMB.2.raw
  modified_base (203)..(203): a, c, t, g, unknown or other
  modified_base (211)..(211): a, c, t, g, unknown or other
  modified_base (223)..(223): a, c, t, g, unknown or other
  modified_base (237)..(237): a, c, t, g, unknown or other
  modified_base (250)..(250): a, c, t, g, unknown or other
  modified_base (266)..(266): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccnggggcctnagtgaagtctcngcaagcagtgatanatctcactaaatntggtatgaattgggtncgacacggcccccgagaaggctggaggtggggtggggtggtcaggcggtcgtttggacgggtaaggcacgagtagtcgacgacgaaagtagtaggaagggccaggacgtcaaacgtaactttacccgaaaccgggacccacccccgaaacgaaaccacgacgtactaaccgattagacctaaacgtcgaacgagcccgtagagagcgtacgaccgacgaccggtccccgtagtacttaccgtaggtccgacggtaagtaaagtttcggtttttaccgacgtttactaacgttaacgttaacgttaacgttacggtaacgttaacggtactttaacgtacgttacggtacgtacgggttacgttcggg

SEQ ID NO: 395286 - DNA, 696 bp, Homo sapiens
  misc_feature: GZ8MTXP02JXO18.17.25.C03.1.454.CMB.2.raw
  modified_base (338)..(338): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgtccactcccaggtgcagctggtgcagtcgtggggctgaggtgaagagcctggggcctcagtgaaggtctcctgcaaggtcttcgtggattcgacgtttacctcctatagtatcaacgtgggtcgcgccaggccgcgtggaaccaacgtacctggagtggatgggatggggaccgaaaccctaanacgtggtgtacacgtagtcgtcttccaccctatcccgtaccgggacaggtaccttaacacgtacgacctaaccgaacttccctacaaactaaaaccacgtaacgccctaaagacgtgggaagttacggaagggtaccgtaccttcggaaactacgtaccgtaggaaccgtaacccggaaccggtcccgttaacgtttaaacgttaccgtggttacggaccgtaaagggtaccgtaacccgtaaaacggttccggtacccgggttaggacccggtaccgttaaccgggcctaacggggcccggttaacccttttcgggaaccgttttcggaccgggggtacccgtacggggtaccccgg

SEQ ID NO: 395287 - DNA, 686 bp, Homo sapiens
  misc_feature: GZ8MTXP02JKQN5.17.25.C03.1.454.CMB.2.raw
  modified_base (275)..(275): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtcgtggggctggaggtgaagaagccgtggggcctcagtgaaggtctcctgcaaggcttctggattcacgtttcctctatagtatcacgtgggtncgacgacggccgcgtcggaaccaacgtaccgtggaggtggaagtggggagtcggggaccaaacccgtaagacgtgggtcgtacacgtagttccgttaccttccgacccctacgttcccgtaccggggaactaccgtaaccttaaccgacgtaccgaacccgaactaaaccctccctaaacctaaactaaaacccaccacgtaccctaagtacgtagggacggtttagagggaccgaccgttgaaacctgttcgtaaccggacgtaacccggtaccggtccgtaatttaacgttcgtggtaccggacgtacgacccggtacccaaaggttccgtccggggttgaaccggtccgtaacgggcacgggtccgttcgtttacggacgttcgggacggggacccgtacggggcccg

SEQ ID NO: 395288 - DNA, 782 bp, Homo sapiens
  misc_feature: GZ8MTXP02F1X6S.17.25.C03.1.454.CMB.2.raw
  modified_base (258)..(258): a, c, t, g, unknown or other
  modified_base (338)..(338): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcagtgaaggtctcctgcaaggtcttcgtggtattcacgttttaccncctaatagtatcaactgggtcgcgccaggccgcgtggaacaacgacctggagtggagtgggatggggaccaaaccctaanacgttggtacgtccaacgtaggttccgttaccttacccgaaccccgtacgtaccccggttacccggggaactacgggtaaccctttaaacccgaagttaccgaaccccctaacggtaaaaccctcccctaaccgaaacttaaaacccactaacgacccttaacgaaagtcggggtaacgtttagggaacgggacgacccgttacggaaactacgttaccgtacggaaacccggaaccggtacccgggtacccccgtttacttaaacgtttaacggtcggttaccggtaaccgggacgttaaccggttacccccggaaacgttaccgtccccggggttagaccgggtacccgtaaccgggcctaaccggggtcccggtttacccgtttaacgggttacccgtttccggggtaccgggggtaccccggggtaaggggtacccccgg

SEQ ID NO: 395289 - DNA, 660 bp, Homo sapiens
  misc_feature: GZ8MTXP02GI8D5.17.25.C03.1.454.CMB.2.raw
  modified_base (283)..(283): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctcctgcaaggtcttcgtggtacttctacgtttacctccttaatgtatcaacgtgggtnccgccaggccgctggaccaacgcctgaagtggagtgggagtacggggacctaaaaccctaacgaccgttgggtcgtacaacgtagtccgttaccttccacccgtacttcccccgtaccggggaactacggaaccctttaaccgataccggacccaacggtaacctccctaccaaattaaacccgacaacgcctaactagtggtagttagacgacgccctaaggctaaagttcctggaacccgaacgtaccggtcccgttactaagtttccggcgtacgacggtacgaccgtccgaacggtcggtccggtacgaccgtccgtaccggccgtacggtccgttacgttacgacggttcgggaccggtacggtacggtccg

SEQ ID NO: 395290 - DNA, 815 bp, Homo sapiens
  misc_feature: GZ8MTXP02JBKMX.17.25.C03.1.454.CMB.2.raw
  modified_base (287)..(287): a, c, t, g, unknown or other
  modified_base (301)..(301): a, c, t, g, unknown or other
  modified_base (373)..(373): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccgaggtgcagctggtgcaggtcgtggggctggaggtgaagagccgtgggcctcgagtgacggtctccgtgacgaaggtcttcgtggtacttcgtacgttacctctaatagtatacacgtggtcnccgccgacggccgngtacggaaccaacggaccgtggaggtcggagtagggtacgtcgggaacccgtaaaccctaagacgttggtanacctaagtgttccgttcctaccaccacgttcccgacgggactacgtacctaccagttaccaaccgaaccgtaaaccctccctaaaccctaaactaaaacccaccgtaaccgtaccctaaaacgtacgttacggggtaagtttagggaaaccggtacgtaccgttaaaggaccccttacggtacccgtaccggtaaacccggtaacccgggtaccccgttaccggtttaccctttaaacgggttaccgttcgggttacggaaccggggtaaaacgtccccgggtaaaccccgtttaaggggacccggtttaacccggggtagtaccccggaccccgggtttaaccgggccccgttaacggggttaaccccggtttccgtttaaccggttacccgggtttccggggaaccgggggttacccggaccggggtttaacccccgggg

SEQ ID NO: 395291 - DNA, 628 bp, Homo sapiens
  misc_feature: GZ8MTXP02GWLPA.17.25.C03.1.454.CMB.2.raw
  modified_base (281)..(281): a, c, t, g, unknown or other
  modified_base (291)..(291): a, c, t, g, unknown or other
  modified_base (395)..(395): a, c, t, g, unknown or other
  modified_base (484)..(484): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcaaggtcttcgtggtattctacgtttacctctatagtatcaactgggtncgcaggccgngtggaccacgacctggaggtggagtgggatcggggaccaaaccctaacgacgttggcgtacacgtagtaccgtccttacacccctacgtcccgtaccgggaacncgtaccttaccactacgaccctaacgaaccttccgaccaaataaaccgacacgtccctaagacgtggtagttaggagtacgctagactntcgagaccacgaccggtccttatacgttagcgtgacgtacgtaccgtcccgaacggtcgtcccggtagaccggtcccgacgggccgtaacggtccggttaccttacggtaccgttcggtaccgggggtaccgacggggtccccg

SEQ ID NO: 395292 - DNA, 829 bp, Homo sapiens
  misc_feature: GZ8MTXP02G7GWK.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagacgccgtggggcctgagtgaaggtctccgtgcaaggtcttcgtggtacttcctaaccgttttacctaccttaatagtactacgtaacgttggggtacgccggtccgaacgggcccggtacgtagggaaacccgtaaaccggtacccgtgggtaagggtgggtaacgtacgggggaaggtaccggggaccccggtaaaaaccccttaaccgacgttcggggtactaccgaaccggtaggttccccggttacccttacccaacccgtaccgttccccggtaccggggaacctaccggtacctttaacccgaacgttacccgaaaccctaaccggtaaacccctacccttaaacccaaaacttaaaacccacgtaacccgtaacccgtaaccgtaaaggttaccggggaaagtttacggggaaagaccgtaccgttaacgactaacgttccgtaacggacccggtaaaccggtacccggtacccgttacgtaaagtttccgaggttacgacggtacgtacccgacccgtaacgtccggtccggacgtaccggtcccgaaacgggcctaccgggtcgtttaccgttacggtacccggtttcggggaccgggtaccggaacgggttcccccgg

SEQ ID NO: 395293 - DNA, 700 bp, Homo sapiens
  misc_feature: GZ8MTXP02JRD9O.17.25.C03.1.454.CMB.2.raw
  modified_base (215)..(215): a, c, t, g, unknown or other
  modified_base (283)..(283): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctnagtgaaggtctccgtgcaaggtcttcgtggtattcctacgtttacctcctatagtatcaacgtgggtnccgccgaggccgctggacaacgtcctgagtggagtgggatcgggacctaaccctaacgacgtggtcgtacacgtagtccgtcctaccgacccctacgtcccgaccgggactacggtaccttaaccacgttaccgaacccgtaacgtaaaccctccctaaccaaactaaaacccacgaacgtaccctaacgagttacggggaagtttacggaaacgggtacgtacccgtagtacccgtagttacccggtaacgaacccggtaccggtaaccccggtcccgtttacttaacggtttaccgtgggtaccggtacgacggtacccgttacccgacggtaccgtccgggtagtacccgaccggtacgcgtacggtccgttacgttacggtaccgttcgggacggggtaccgacggggtcccg

SEQ ID NO: 395294 - DNA, 630 bp, Homo sapiens
  misc_feature: GZ8MTXP02IBIWX.17.25.C03.1.454.CMB.2.raw
  modified_base (342)..(342): a, c, t, g, unknown or other
  modified_base (488)..(488): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaacggtctcctgcaaggcttcgtggtattctacgtttacctctatagtatcaacgtggtcgcgccgacggccgcgtaggaccaacgacctggagtggagtgggagtcggggaccaacccgtaacngtggtgtacacgtgtcgttccttaccacctacgtccgtaccgggactacggtaccttaccaagttaccgaaccacgtaacctcccacctaaataaaccaccagaccctaacgtagtaggtagttaggacgacgacctaggacctancgtagacccgacgtacccgggtcctacgtacttacgtggttcgacgagtaccgtacccgacgtacgttaccgaatcgaccgtaccgtacggaccgtaacggtccgggttacttggtaaccgtttcggcgggtaccgaccggg

SEQ ID NO: 395295 - DNA, 748 bp, Homo sapiens
  misc_feature: GZ8MTXP02JYWR2.17.25.C03.1.454.CMB.2.raw
  modified_base (516)..(516): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccgaggtgcagctggtgcagtcgtggggctggaggtgaagagccgtggggcctcagtgaggtctcctgcaagcttcgtgtattctacgtttacctctatagtatcgacgtgggtcgcgccgacggccgcgtacggaacaacgacctggaggtggagtgggacgtcgggaccaaacccgtaacacgtggtcgtacacgtagtccgtcctccacctactcccgtaccggacacgtaccttaaccacgtacgaaccctaacgaacctacccctaacctaaaactaaacccacgtaacccgacccttaaagtagttggggtaaacgtttacggaaggacccgtccgttaacgaaccgtnttaaccggaccggaaacccggacccggtaaacccggtcgtttaaccctttaaggtacccgttgggaaccggacccggtaaaacgtacccggttacccccggaaggttacccggtttacccgggggaaatccccggggttacccgaaccggggtctaaccgggggttccccgttacccgtttttcggacccggttccgggggttccgggggacccgttaacgggggtcccccg

SEQ ID NO: 395296 - DNA, 669 bp, Homo sapiens
  misc_feature: GZ8MTXP02GT8D4.17.25.C03.1.454.CMB.2.raw
  modified_base (224)..(224): a, c, t, g, unknown or other
  modified_base (242)..(242): a, c, t, g, unknown or other
  modified_base (252)..(252): a, c, t, g, unknown or other
  modified_base (269)..(269): a, c, t, g, unknown or other
  modified_base (298)..(298): a, c, t, g, unknown or other
  modified_base (429)..(429): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtctccatccctccctgtctgcctcgtggtgggggtcagagtcacatcacttgccganagtcacggacttaaactnttaatgtatnagcagaaactggaaacncccagtacctctagacttctcgtgggtcnctactcccactcgtaggacgtaaggtcggaccgtacctagtccggtaggttcccaggtcggtacgtagggtggaacttcgggtaggggtactagttactttacgaaactccgtacaccaattccaaacccncgtcacgtaccaacgtggtacggtatttcggactactaaacttccttaaaactcgtagttaaaccaacggtaactacgtttaaccgtacccggtttcccctacggttaacccgtttaggtttaccgggaaccggtaaaccgggggttaaaaccttaaagggttacgaaaccggttaaactaaaccgtaaaacgtacgtcggtaacggtacctacgacctactacgtttcgtacgtttacc

SEQ ID NO: 395297 - DNA, 747 bp, Homo sapiens
  misc_feature: GZ8MTXP02ILQIV.17.25.C03.1.454.CMB.2.raw
  modified_base (271)..(271): a, c, t, g, unknown or other
  modified_base (292)..(292): a, c, t, g, unknown or other
  modified_base (465)..(465): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtctggggctggaggtgaagaagccgtggggcctcagtgaaggtctcctgacctaaggcttactggtattctacgtttacctctatagtancactgggtgcgccgaggccgntaggaccaaccgctgaggtggagtgggagtcggggactaaaccccgtaacacgtggtcgtcaacgtagttcgttcccttccgaacccccttagtcccccgttaccggggaccacgtaacctttacccaaagtaccgaacccaacgtaaaccctcctacccaaataaaaacccncaacgtacctaagtacggtaggtaaggttaggaacgggtacgtaccgtacggtaacctacgttaccgaccggaaacccggtacccggtaccccggttacccgttacgttaacgtttcggtacggtcggaacggtaacgtacccggtaacccggtaacggtaccggttacccggggtaacggtacccggtacccggtaacccgggccgtacggttaacccccggttccggttttaccggtaccggtttacccggggaccgggggtaccggtaccggggtccgg

SEQ ID NO: 395298 - DNA, 646 bp, Homo sapiens
  misc_feature: GZ8MTXP02INFTI.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtcgtggggctgaggtgaagagccgtgggcctgagtgaggtctctgacaggtcttcgtggtattctacgtttacctctatagtatcaacgtggtcgccgcgacggccgcgtacggaacaaccgacctggaggtggagtggggagtcggggacctaaacccgtaacgcgtggtacgtcaacgtagttccgtacctacccgacccctacgttccccgtacccgggaactacgtaaccttaccactaccgaacccctaacgaaccctccctaaccaaactaaacccacaacgacctaacgagtaggaagttacgacggacgctacgaactactcgtagaaccgtaccggaccggttccgtacttaattacgtagtcggcgtagtaccgtacccgacggtacgtccggtacgaccgtccgacgcgacggtccgttcgttcggtaccgtggtaccgggcggtacggcccgg

SEQ ID NO: 395299 - DNA, 688 bp, Homo sapiens
  misc_feature: GZ8MTXP02F9STH.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtagaggtctcctgcgagtcttcgtggtacttctaccgtttacctctatagtactacacgtggtcgccgccgaggccgcgtacggaaccaaccgtacctaggaggtgggaagtgggaggtacggggacccgtaaaacccgtaacgtacggtggtacgtacgacgtaggtccttcctaccgaccctacgtcccgtccggaacacgtaacctaccacgttaccacctaacgaaccctccacctaaacaaaccacgaaccgacccttaaagacggtagggttacgttaggacgggtaactccgtagaacctagttccgaacgtaaccgacgtaccggtccgttacttagttacgtgtacggtacgtacgtaccgtaccccgaggttacgtaccggacgaccgtacccggtacgccgtacggtccggtttacccgttacgacggtttccggggtaccgggcccggtaacgggtcccg

SEQ ID NO: 395300 - DNA, 659 bp, Homo sapiens
  misc_feature: GZ8MTXP02IORWS.17.25.C03.1.454.CMB.2.raw
  modified_base (525)..(525): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctgaggtgaagagcgtgggcctcgagtgaggtctcctgcaggtcttctggtattctaccgtttacctctatagttatcaagtggtcgcgccgaggcccgcgtcggaaccaaccgaccgtggaggttacggagttcggggaagtcggggaccccgtaaaaccccgtaacgaccgttgggtacgtaccgaaactcggttccgttacccttacccgaccccgtaccttcccggtacccgggaactacggtacctttaaccacgtaccgaaccctaacgtaaacctccctaaccaaataaaccgacgaacacccttaacagttaggacgttgaaggtacncgtagactatcgtacgaccgagacccgtcgtacttaattcgtaggtgacgagtaccgtccgaacgtcgttcgagcggtccgacggccacggtccgtaccgttcggtcgttacggccgggtacgaacgggtcccg

SEQ ID NO: 395301 - DNA, 627 bp, Homo sapiens
  misc_feature: GZ8MTXP02IGI1Q.17.25.C03.1.454.CMB.2.raw
  modified_base (229)..(229): a, c, t, g, unknown or other
  modified_base (258)..(258): a, c, t, g, unknown or other
  modified_base (303)..(303): a, c, t, g, unknown or other
  modified_base (366)..(366): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatcgacccagtcctccatccctccctgtctcgcctcgtggtgggggtcagacgtcaccatcacttgccgaanagtcacggtactaaactattaatgtatcngacacgaaactggaaacgccccagacctctgacttctcgtggtcncactacccgatcgtgacgtaaggtcgcgtacccagtcggtacgttcaggtggactaggtagtntcggtggggacctattacgtttacaacttctacaaccctactaccgacctacgtcgtacgaccctaaacgtggtaagtacttaggtactactaattccgttaaacctcgttaacgaaccctaagtacgtaccgttaaacctccgttccccgtacgttcgttacgtttcggaaacccggtaagggttaaccgtaaagttcgaaagtaaccgtaacgaaaacggtctacggtaacggactacgactacctcgttctactttcc

SEQ ID NO: 395302 - DNA, 799 bp, Homo sapiens
  misc_feature: GZ8MTXP02IUM79.17.25.C03.1.454.CMB.2.raw
  modified_base (212)..(212): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtgggcctnagtgaacggtctcgtgacaaggtcttcgtggtacttcgtacgtttacctctatagtatcacgtggacgcgccacggccgcgtcggaaccaacgacctggtacggtggagtggggacgtcggggaccgtaaacccgtaaacgtcggttggtacgttcaacgtagttcgttaccgttaccacccgtacgtcccggtacccgggaacacggttacctttaacgacgttacccgaacccgtaaccgtaaacccttccctaaccctaaaactaaacccgaaccgtaaccgtacccttaaccgtaaacggtttagggggtaaccggtttaggggaaaccggccggttccgttaaacgggaacttacggtacccgttaaacgggacccggtaaccggtacccggttccgttaactttaacggttaacggtcggttacgacgggtaaacgtacccggttaccccgaacggttaccggtacccgggttcggaacccggtacccggttaccggaccgttaaccggggttaacccgttacggttttccggtaccggggtttaccgggttccggggaccggtaccgggggtaaccccgg

SEQ ID NO: 395303 - DNA, 611 bp, Homo sapiens
  misc_feature: GZ8MTXP02GVHD2.17.25.C03.1.454.CMB.2.raw
  modified_base (280)..(280): a, c, t, g, unknown or other
  modified_base (347)..(347): a, c, t, g, unknown or other
  modified_base (354)..(354): a, c, t, g, unknown or other
  modified_base (361)..(361): a, c, t, g, unknown or other
  modified_base (373)..(373): a, c, t, g, unknown or other
  modified_base (384)..(384): a, c, t, g, unknown or other
  modified_base (496)..(496): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaaagaagccgtggggcctcgagtgaaggtctctgcaaggcttctggtattctacgtttacctctatagtatcaacgtgggtacnccgaccaggtcccgctaggaaccaacgacctaggaggtggatggggagtcggggaccaaccctaacncgtggtntacgagntcgtctcacccntcccgcggacncgaccttacatcgaccacgaacctcctacaaataaaccacacgacctacagtcggtagttcgagacgcgtagacatctacggacaccgacggtaccttattacttacgtcgngtacgacgtaccgtacccgagtaccgtaccggttacgaacgttacccggaacggcctaacggtccggttaccgttttacgacccgtttgggacccgggacggtaacggggccccg

SEQ ID NO: 395304 - DNA, 703 bp, Homo sapiens
  misc_feature: GZ8MTXP02FJBYD.17.25.C03.1.454.CMB.2.raw
  modified_base (281)..(281): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtacccactcccaggtgcagctggtgcagtcgtggggctggaggtgaagaagccgtggggcctcagtgaaggtctccgtgcgaaggtcttcgtgtattctacgtttacctctaatagtatcaacgtgggngcgccgacggccgcgtacggacaacgaccgtgaggtggagtgggatcgggaccaaacccaactcgtggtcgtcacgtagttcgtccctacccaccctacgtccccggtaccgggaacaacgtacctaccgataccgaacccgacgtaaccctaccctacaaaactaaaccaccacgtaccctaagaagttacgggtaggttaggaaccggggtactccgtaacgtaacctagttaccgacggaaccggaacccgtaaccggggttacccgttaccttaaagtttccggtaggttcggacgtaaaccggtacccgtaccccgaacggtaccggtcgggttacggaccgacccgtacgggaccgtcggtccggttcccgttaggtacccgttcggggaccggggaccgaggggcccgtacccgg

SEQ ID NO: 395305 - DNA, 620 bp, Homo sapiens
  misc_feature: GZ8MTXP02HBNFS.17.25.C03.1.454.CMB.2.raw
  modified_base (250)..(250): a, c, t, g, unknown or other
  modified_base (382)..(382): a, c, t, g, unknown or other
  modified_base (498)..(498): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagagctggggcctgagtgaaggtctcctgcaaggcttctggatttcacgtttacncctatagtatcgaactgggtcacgccaggccgctcggaacaacggacctggagtggactgggatggggacctaaaccctaactacgtggtcgtctacgagttccgtacttcacccctatccgtaccgggacncggtaccttcgatacgacccaacgtaaacctcctacaataaaccgacaggacctacgatcggtaagtcgagacgcctagaccattcgagacacgaccgtccgtctaactttacggngtacgacgtacgtacgacccgtacggtacgtaccggtacgaccgtacgtacccggacgtaaccggtccggttacccgtttacgggacccgttacgggtccgggtaaccgtacggggtacccg

SEQ ID NO: 395306 - DNA, 714 bp, Homo sapiens
  misc_feature: GZ8MTXP02HN1CJ.17.25.C03.1.454.CMB.2.raw
  modified_base (281)..(281): a, c, t, g, unknown or other
  modified_base (469)..(469): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcaggtctggggctggaggtgaagagccgtggggcctgagtgaggtctccgtgacaaggcttgtggtattccgtacgtttacctctatagtatcaacgtgggtcnccgccgaggccgtcgtaggaaccaacgcctggacggtggagtggggagtcgggacctaaaccctaacgacgtgggtatacacgtagtccgtacctccacccacgtcccgtaccgggaactacgtaccttaccagtaccgaaccctacgaaacctccctaaccaaataaacccgactaccgaccctaanacggtacggtaagttcggaaacggtaccgaccgttagtaaacctacgtaccgttacgaacccggtaccggtaacccggtcccgttaccgttaacgtttacccgtcggtacgggaccgtacggtaacccgtaccccgaacggtaccggtcccgggtagacccggttaccggaccggtcggtaccggtccggtttacccgttacggtaccggtccgggtaccgggggaccgtaacggggtaccccgg

SEQ ID NO: 395307 - DNA, 938 bp, Homo sapiens
  misc_feature: GZ8MTXP02HSK5I.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtgggcctgagtgaggtctcctgcgaggtcttcgtggtattctacgtttacctcttatagtactcgaacgtgggtacgcgaccgacggcccgtacgtacggaaccaaccggtaccgtgggacggtaggtaaggtacgggggacgttaccgggggaaccccgtaaaaccccgttaaacgaccggttagggtacgttacccgaaaccgttacggttcccggtttacccccttaaccccgtaaccccctacggttacccccgggtaccccggggaaacttaccggggtaaacccctttaaacgaaacggttacccgaaaaccccgaacccgttaaacccttaccccctaaaccctaaaacgttaaaaccccaactaacccgggtacccttaaaacggtacggttaaccggggttaagggttaacgggaccggggttaaacccgtacccggtaaacgtaaccgttacggttaaccggtaaaccgggtaacccggaacccgggttaacccggttacccgtttaaccgtttaacggtttacggttacgggtaaccggtaccgggtaaaccggtaaccccgtaacccggtaaccggttaccggggttaaccgggtaaccggtaaccccgggtaccgggtaacccggtccgggtacccgggttaacccgggttttacccgtttacggggtacccgggtttccggggtaacccgggggtacccgggtacccggggtaccccgg

SEQ ID NO: 395308 - DNA, 746 bp, Homo sapiens
  misc_feature: GZ8MTXP02FMKCC.17.25.C03.1.454.CMB.2.raw
  modified_base (341)..(341): a, c, t, g, unknown or other
  modified_base (412)..(412): a, c, t, g, unknown or other
  modified_base (446)..(446): a, c, t, g, unknown or other
tcagcgtagactagcacgaccggtgctcgatttagtagtgtagatttgggtttgggggagtcagtctcagtcaggacacagcatggacatgacgggtccccgctcagctccgtggggctcctgctactctggctccgagctgccagatgtgacatccagatcgaccctagtcctaccacttccctccctgtctcgccttcgtgggtcggggtacagtacgtccaacctattccgtacgttcggacccggaaactaacggtaccgtaaaccgggtaacctttaaaaaacctttattttaaacgtggtaatacgaagaccaaacgaaaccgtaggaaaacccnccccaacgtaccctccgtagtactccgttagtcggtacacgtatccccgattcgacgacgtagcggtaccncagtcggtactgacgtggactggtagacttcggnggaactagttacttaccaacttccaactaccctaagtccctaaacccgtacttaccgaagtaacccgtaaaacgtcggtaaacgggtatttaccggaaccttacggaaacttttaccaaacggtttaacccttaagggaaacctaaaagggtaacgttacccttaacgtccccggtttaacccgacgttccgtttaaccgtaggggaccctaaaagggggtaacttacgggtataaacggactaaaccgtaaaagtcgtacggggtcacggttacaccacgttactccggtaacctttac

SEQ ID NO: 395309 - DNA, 684 bp, Homo sapiens
  misc_feature: GZ8MTXP02IU32P.17.25.C03.1.454.CMB.2.raw
  modified_base (279)..(279): a, c, t, g, unknown or other
  modified_base (289)..(289): a, c, t, g, unknown or other
  modified_base (332)..(332): a, c, t, g, unknown or other
  modified_base (340)..(340): a, c, t, g, unknown or other
  modified_base (421)..(421): a, c, t, g, unknown or other
tcagcgtagactagcacgaccggtgctcgatttagtagtgtagatttgggtttggggaaccacatctgtcctctagagaaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttctggtattctacgtttacctcctatagtatcaactgggtncgccaggccncgtgacaacgctgagtggatgggatgggacctaaacccgtacncgtgggtntcaagagttcgtcctccaccctatcccgtaccggacagtaccttacataccgaccacgaaccttcccaacgaataaaaccncaacgccttaaacagtggtaacgttggaacgggactcctagacctataccgttacggaaacccgtaccgtacccgggtacccctttacgttaacgtttaccgtacgggttcggacccgggtaaacgtacccggttacccccgacgggttaaaccggtttcccggggtacggaaccggttaccccggtaacgggcccgttaacggcccgggttacccgtttttcggaccgttttcggacccgggggtacgacgggggtcccccg

SEQ ID NO: 395310 - DNA, 631 bp, Homo sapiens
  misc_feature: GZ8MTXP02J0DWQ.17.25.C03.1.454.CMB.2.raw
  modified_base (238)..(238): a, c, t, g, unknown or other
  modified_base (337)..(337): a, c, t, g, unknown or other
  modified_base (345)..(345): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctgagtgaaggtctctgcaaggtcttntggtattctacgtttacctctatagtatcaacgtgggtcgcgccgacggccgcgtcggacaacgcctggagtggagtggagtcgggaccaaccctaacncgtggtcncacgtgtcgtccttccgaccctactccgtccggacacgtacctaaccatacgacccaacgtaacctccctaacctaaacaaaccaccaacgtaccctaacgtagtaggtaaggttacggacggtcgtaccgtagaccgtactcgtacggaacccgacccgggtaccgggtacccttcgttaacgttaccgtgtacgacgtaacgaccgtaccgacgtacgtaccggacgtacgtcccgacgcgacggtccgtacgtttcgacgttccggacgggtcgacggtaccg

SEQ ID NO: 395311 - DNA, 721 bp, Homo sapiens
  misc_feature: GZ8MTXP02FIPF5.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctctttcttggtggcagcagctacaagtgcccactcccaggtgcagctggtgcagtcgtggggctggaggtgaagagccgtggggcctcgaggtgaaggtctacctgacgaaggtcttcgtggtatttccgtaccgttttaccctccttaatacgttactcaaacgttgggtcgccgcccgaggcccgacgtggaaccaacgcctgaggtggagtgggagtcggggaccaaaccctaacgcgtggtcgtcacgtaggtcctcttccacctacgtcccgaccgggactacggtaccttaccgataccgaacccaacgtaaccctccctaccaaataaaaccacgactacctaacgtacgtaggtaagttaggacgggacgtacccgtaggtaacctaacgttaccgacggaacccgtaacggacccgggtaccccgttattaacgtttacgttcggacggaccggtaacgacccggtacccgtaaacggtcgttaccggggtacggtaaccgtaccggtaccgggacgtaccgggtaaccgttccgttttacggtaacccgttcgggttaccggggaccggacgggggtaccccgg

SEQ ID NO: 395312 - DNA, 764 bp, Homo sapiens
  misc_feature: GZ8MTXP02I3HE5.17.25.C03.1.454.CMB.2.raw
  modified_base (168)..(168): a, c, t, g, unknown or other
  modified_base (281)..(281): a, c, t, g, unknown or other
  modified_base (556)..(556): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtncagctggtgcagtctggggctgaggtgaagagcgtggggcctcgagtgaaggtctccgtgcaaggcttcgtggtattcgtaccgtttacctctatacgtatcaacgtgggtcnccgccaggtccgcgtggaaccaacgcctggacggtggagtcggggatcgggaccgaaaacccgtaacgacggttgggtacgttccgaaacgtaggttaccgttaccgtttaccgaaccccgtaagttccccggtaaccggggaactacgggtaacctttaaccgaacgttacgaacccgaacgtaaaccttcccgtaacaaaattaaacccgactaacgacccttacgaagtcggtaaagttacggacgggtaaactcccgtaaaggtaaacctntttaccgtacgggtaacccgaaaccggtaccggggtaccctttacggtaaacttttaccggtacggtacggtaaccggacggttaacccggtaccggtacggttaaccggtaccgggtacggtaccggtacccgtacgggaccggtaaccggtcccggttacgtttaccggaccgttccggggaccggggtaccgtaaccggggtccg

SEQ ID NO: 395313 - DNA, 739 bp, Homo sapiens
  misc_feature: GZ8MTXP02INEBJ.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagcgtgggctcagtgagtctctgcaggcttctggtattctacgttacctctatagtatcaacgtggtgcgccgacggccgctggaccacgcctggagtggagtggagtcgggacctaaaccctacgacgtggtctacacgtagttccgtaccttccaacccgtacgttccccgtaccggggactacggtacctttaaccgacgttaccgaaccccgtacgtaaaccttcccgtaaaccctaaataaaacccaaccgtacgtaaccctaaacgtacgttacggggtaagtttacgggaaacgggtaccgccgtaggtaaacctacgttaccgttacggaacccgaccggaccgggtaccccgttattaaccgtttacggtcggtacggtaccggtaaacgtacccgttaaccccgacggtaaccctaccgggtaaagtaccgggaccggtacccggtaaccgggtaccgtaaccggggtcccggtttaccggttttaccggaccggtttcggggacccgggggacccggtaaaccggggg

SEQ ID NO: 395314 - DNA, 585 bp, Homo sapiens
  misc_feature: GZ8MTXP02HFW8R.17.25.C03.1.454.CMB.2.raw
  modified_base (210)..(210): a, c, t, g, unknown or other
  modified_base (268)..(268): a, c, t, g, unknown or other
  modified_base (279)..(279): a, c, t, g, unknown or other
  modified_base (283)..(283): a, c, t, g, unknown or other
  modified_base (313)..(313): a, c, t, g, unknown or other
  modified_base (319)..(319): a, c, t, g, unknown or other
tcagcgtagactagcacgaccggtgctcgatttagtagtgtagatttgggtttggggaaccacatctgtcctctagagaaaccctgtgagcacagctcctcaccatggactggacctggaggatcctcttcttggtggcagcagctacaagtgcccactcccaggtgcagctggtgcagtctggggctgaggtgaagagcctggggcctnagtgaaggtctactgcaaggcttctggattcacgtttacctctatagtatcaactggngcgccaggccntganacgactgagtgatggatgggctaacccaanactgtncactagtcgtctacacccagtccgtccggatcgacttacaagtacgacgacgaactacctaccaactaaacaacacgacctaactagtaggtagtaggtagggacgtacgtacgacgtaacgtacgtacgaccgaaccgaccggtaccgtacgttacgttacgttcgtacggtacgtacggtacgtaccgaccggtacgtacggtacggtacgtacgtacggacgacggtcggtcgttacgtacgtacgtacggtacggacggacg

SEQ ID NO: 395315 - DNA, 760 bp, Homo sapiens
  misc_feature: GZ8MTXP02HWX6K.17.25.C03.1.454.CMB.2.raw
  modified_base (266)..(266): a, c, t, g, unknown or other
  modified_base (278)..(278): a, c, t, g, unknown or other
  modified_base (290)..(290): a, c, t, g, unknown or other
  modified_base (367)..(367): a, c, t, g, unknown or other
tcagcgtagactagcacgaccggtgctcgatttagtagtgtagatttgggtttgggggaaccacatctgtcctctagagaaaaccctgtgagcacagctcctcaccatggactggacctggaggatcctcttcttggttgcagcagctacaagtgcccactcccaggtgcagctggtgcagtcgtggggctgaggtgaagagccgtgggcctcagtgaggtctctgcgagtcttcgtggtattccgtacgtttacctctatagtanacacgtgggtcncgccgaggccgngtacggaacaaccggtacctagggagtggagtcggggaagtcgggggaaccctaaaacccgtaacgacggttcgggngttacccgacgtacggttccgtttccttaccccgaacccgtacttccccggttaccggggactaccgttacctttaacccgattaccccgggaacctaaccgtaaccttacccctacctaaaacgtaaacccggaacctacggtacccctaaacgttaggtacgggttacggttacgggaaacgggtaccgtcccgtaaggtacctaagttacccggtacggacccgaacgggtaccccggttacgtactttaaacgtttccgaggttccggaacgtaccggtaccgtacccggaggttaccgtcgggacgtaaccggcccggttaacggcctacgggtcccggtttccgttcgtaccggtcggggtaccgggacggtaaccggggtccccgg

SEQ ID NO: 395316 - DNA, 699 bp, Homo sapiens
  misc_feature: GZ8MTXP02JOU9E.17.25.C03.1.454.CMB.2.raw
  modified_base (293)..(293): a, c, t, g, unknown or other
  modified_base (319)..(319): a, c, t, g, unknown or other
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtcctccacttccctccctgtcctcgccctcgtgggtgggggtcaggacgtccaaccatctacgttcggacccggaactaacgtcgtagtacggtaaccgttaaaaccttatttaaagttggtatacngacaaagtaaacctagggaaaacccncccacgtcctcgtgtactcgtcgtggtcactactcctacgtcgtacggacggtacggtccggtaccctccgtaggtacggtacgtacgtacggtcggacgtaggtcggtagtcgggtacggatagttacttactactctacctaacctactaccctacctcgtactaccgtacgtacgtaggtacgtagttcgtaactacttaacctacttaactacgtagtaaccgtaagtacgttaccttaccccgttaccgttccccgtacgttaccggtttaccgtacggggtaaaccggtaacggtaaacgtacggtagaaaccgtaaccgtaaaccgtaaccggtgtaacggtctaccgaccgacgttaccttaccgtacgttc

SEQ ID NO: 395317 - DNA, 715 bp, Homo sapiens
  misc_feature: GZ8MTXP02HVDV3.17.25.C03.1.454.CMB.2.raw
  modified_base (375)..(375): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggctgagtgaagtctcctgcaagtcttctggattcacgtttacctctatagtatcaacgtgggtgcgaccaggccgctggacaacgacctgagtggatgggatcggggcaaaccctaacacgtggtgtaccacgtagtccgtccttaccacccagtccgtaccggggacncggtaacctttaaccataccgaaccgtaccggtaaaccttccccgtaaccaaacttaaaaccactaacgtaccctaaactagtacgggtaagtttacgggaacgggtacgaccgtaggtaaccgtaaactcggttaacggaacccggtaaccgaacccggggtacccgttctaaagtttaccgtacggttcggaccggtaacgacccggttaccccaacgggttaccgttacccggggaacggtaccggtacccggttaacggaccgaacgggtcccggttaaccgtttcggttaacccggttcgggtaccgggggtaccccgaaaagggggtcccccgg

SEQ ID NO: 395318 - DNA, 655 bp, Homo sapiens
  misc_feature: GZ8MTXP02I374T.17.25.C03.1.454.CMB.2.raw
  modified_base (284)..(284): a, c, t, g, unknown or other
  modified_base (361)..(361): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccgaggtgcagctggtgcagtcgtggggctggaggtgaaagagccgtggggcctcagtgaaggtctcctgctaggtcttctggtacttctaccgtttacctctatacgtactcaacgtgggtnccgccgaggtccgattacggaaccaccggtccgtggagtaggagtgggatcggggaacctaaaccctagcgttggtntaccgtagtacggttccgttaccttcccaccctacgtcccgtaccgggaactcggtaccttaaccgcgtaccgaacccaacgtaacccttcccctaaactaaactaaaccactaaccgacctaacgaacgtggtaagttggaacggacgcccgttagaccctatacgtacgacccgagacccgtacgttacttaagtttcgaggtcgacgtacgccgtacccgagtccgtcggtacgtcgtaccggacgcgacggtccgttcgttacgtacgtcggtccgggctaacggtcccg

SEQ ID NO: 395319 - DNA, 691 bp, Homo sapiens
  misc_feature: GZ8MTXP02I0HIX.17.25.C03.1.454.CMB.2.raw
  modified_base (479)..(479): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcgagtgaaggtctcctgcaaggtcttcgtggtacttccgtaccgtttaccctctaatacgtatcgaacgtgggtcgccgccgaggcccgcgtcgggaaccaacggtcctaggacggtggagtggggacgtacggggacctaaacccgtaagtacgttggtacgtaccgtacgtagttccgttaccttccgaccctacgtcccggtaccgggactacgtacccttacgacgttacgaacctacgacctccctacaactaaacacgacnccaacgtagtaggagttacggaggaccgtaccgtacggactacgttaccgtacgaccggaccgtaccggtccgttacttaacgttcgacggtcggtaccggagtacccgttacccgacgtaccggtcggtacgaccggtacccgtacggaccggtacggtcccggttaccgtttcgtaccgtttaccgggcgggacccggtacgggtcccgg

SEQ ID NO: 395320 - DNA, 752 bp, Homo sapiens
  misc_feature: GZ8MTXP02H587I.17.25.C03.1.454.CMB.2.raw
  modified_base (236)..(236): a, c, t, g, unknown or other
  modified_base (665)..(665): a, c, t, g, unknown or other
  modified_base (673)..(673): a, c, t, g, unknown or other
  modified_base (727)..(727): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtcgcccactcccaggtgcagctggtgcaggtcgtggggctggaggtagaagaagccgtggggcctcgaggtggaaggtctccgngcgaggtcttcgtggtacttctaccgtttacctctaatagtactacgaacgttcgggcgtaccgccgacggtccgtcggtaggaccctaaacggaccgtaggtaggtagggagttagggggacggtacggggaacccgtaaaccccgtaaacgtacggtttgggtacgttaccgtacgtacggtttcccgttccctttaccccgaaccccgtaccgttcccccggggtaaccggggtaaccttaccgggtaaaccctttaaccctacgtaccgaaacccccgtaaccgaaacccttaccctaacccgtaaactaaaacccacgaaccgtccctaaacgtagttaccgggtaggttaggaacggcgtcaagtaccagttccgtaacggaaccgaccggtaccggtccttacttaacgttcgtgtaccggngtaaaccnccgaccgacgtccggtaccggcgaccgtccgaccgtagcgtccggtacgtttcncggttcggccgggcgtacgggtccg

SEQ ID NO: 395321 - DNA, 608 bp, Homo sapiens
  misc_feature: GZ8MTXP02FJTV1.17.25.C03.1.454.CMB.2.raw
  modified_base (214)..(214): a, c, t, g, unknown or other
  modified_base (351)..(351): a, c, t, g, unknown or other
  modified_base (408)..(408): a, c, t, g, unknown or other
  modified_base (428)..(428): a, c, t, g, unknown or other
  modified_base (433)..(433): a, c, t, g, unknown or other
  modified_base (436)..(436): a, c, t, g, unknown or other
  modified_base (441)..(441): a, c, t, g, unknown or other
  modified_base (443)..(443): a, c, t, g, unknown or other
  modified_base (454)..(454): a, c, t, g, unknown or other
  modified_base (491)..(491): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggcctnagtgaaggtctccgtgacgaagtcttcgtggtattcgtaccgttttacctccttatgttaatctaacgtgggtgccgccgacggccgcgtaggaacaaccgactggagtggagtaggagtggggaccaaaaccctanacgttggtcgtcactagtcgtcctaccaccacgtccgaccggactacgacctaacgntacgaccacgactccacaanaaacncanactanangtagtgagacnctagacatctagaccacgacgcccgttatacgttacngtgacgtacgaccgtaccgacggtcgtaccgggacgtaacggcccgttaaaccggcgtaacggtccggttaccctttacggtacgttccggtacggggacccggaacggtaccccgg

SEQ ID NO: 395322 - DNA, 879 bp, Homo sapiens
  misc_feature: GZ8MTXP02IU6Q1.17.25.C03.1.454.CMB.2.raw
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtgggcctcgagtgaaggtctcctgcgaagtcttcgtggtacttctacgtttacctctatagttatcgtaacgttgggtcgccgccgacggcccgtacgttacggaacccaaaccgtaccgtaggtacggtggtaagtaggggaagtacggggtaaccgtaaaccccgtaacgacgttcgggttacgtacgaacgtaggtttcccgttcccttaccaccccgtacgttccccgtacccggggaacaccggttaccttaaccgaacgttacccgaaaccccctaaaccggaaacctttccccctaaaccgtaaacctaaaaccctacgaaaccgtacccttaaacgtaacgttcggggtaaacgtttacccgggaaaagggtaccgtacccgttaaacggaaaacttcggtaacgttaaccggtaacccgggaaaccggttaccccggggtaaccgtttaccgtttaaaccgtttacgggttaaccggttacggtaacccggtaacgtttaaaaccccggggtaccccggaaaccggttaaccggggttacccggggttaccgggaaaccgtaccccgggtaccgggtaccgaaccggggttccggtttacccggttttacggtacccggtttacggggttacccgggggaacccggtacgggggttaacccccgg

SEQ ID NO: 395323 - DNA, 685 bp, Homo sapiens
  misc_feature: GZ8MTXP02I64NI.17.25.C03.1.454.CMB.2.raw
  modified_base (229)..(229): a, c, t, g, unknown or other
  modified_base (233)..(233): a, c, t, g, unknown or other
tcagcgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagcgtggggctcagtgagtctctgacagtnttcngtgttctaccgttactctatagtatcaacgtggtgccgcgacggcccgagtacggaaccaacggtacctggacggtacggagtaggggagtaccggggaccgaaacccctacgtacgttggtacgtaccacgtacgttcgtacccttaccaccctactcccggttaccggacgtacgtaaccttaacacgtaccgaacccgaacctaaccctacctaccgaaactaaaaccgaccgaactaccctaagtaggtacggacggttaaggaacggtacgaccttaggaacctactaccgttacgaaccggacgtaacccggtccgtacgttaacttcggtacggtacgagacgtaccggttacccgaggtacccggttcggtaacgacgtacccgtacggccgtaacggccggttaccgtttacggtcggttcggccggggacggacggtcccgg

SEQ ID NO: 395324 - DNA, 505 bp, Homo sapiens
  misc_feature: GZ8MTXP01EQHI5.21.85.H08.1.454.CMB.2.raw
  modified_base (357)..(357): a, c, t, g, unknown or other
  modified_base (438)..(438): a, c, t, g, unknown or other
  modified_base (446)..(446): a, c, t, g, unknown or other
  modified_base (470)..(470): a, c, t, g, unknown or other
  modified_base (477)..(477): a, c, t, g, unknown or other
tcagtcgtcgctcgcacgaccggtgctcgatttagtatcactcagtcgcggggagctctgggagaggagcccagccctgagattcccacgtgtttccattcagtgatcagcactgaacacagaggactcgccatggagtttgggctgagctgggtttccttgttgctatttaaaggtgtccagtgtgaggtgcagctggtgcagtctgggggagctgtggtacggcctgggggtccctgagactctcctgtgaagcctctggatcacttgatgattatggcatggcctgggtccgcaagctccgaggggaaggggctggagtgggtctcgtggtactaaattacaatggaggtcacncagcttatagagactctgtgaggggccattcaccatctccagagacagcgacaaagactccctgtatctgcaaatgaaacngtctgagngccgaggacacggcttatattacngttgcgngtgagtggggttgggtcttccgttttcg

SEQ ID NO: 395325 - DNA, 508 bp, Homo sapiens
  misc_feature: GZ8MTXP01A2XOD.21.85.H08.1.454.CMB.2.raw
  modified_base (211)..(211): a, c, t, g, unknown or other
  modified_base (362)..(362): a, c, t, g, unknown or other
  modified_base (379)..(379): a, c, t, g, unknown or other
  modified_base (399)..(399): a, c, t, g, unknown or other
  modified_base (429)..(429): a, c, t, g, unknown or other
  modified_base (444)..(444): a, c, t, g, unknown or other
  modified_base (479)..(479): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcgtggtttctgtgctatttaaagtgtcagtgtgaggtgcagctggtgcagtcgtgggggancgtggtggtacggccgtggggggtccctgagactctcctgtgaagcctctggatcactttgatgattatggcatggcctgggtccgccaagctccgaggggaagggctgggagtgggtctcgtggtaataaattacaagtgggaggtcacncagtcttatagagactntgtgagggccatcacatccncagagacagcgactaagactccctgtatcngacaataagacagtntagagagcgacgacgacgcgtatattagttgttgngtgtgtggtgggttgggtcgttccgttcg

SEQ ID NO: 395326 - DNA, 583 bp, Homo sapiens
  misc_feature: GZ8MTXP01CDZTZ.21.85.H08.1.454.CMB.2.raw
  modified_base (264)..(264): a, c, t, g, unknown or other
  modified_base (502)..(502): a, c, t, g, unknown or other
  modified_base (506)..(506): a, c, t, g, unknown or other
  modified_base (512)..(512): a, c, t, g, unknown or other
  modified_base (535)..(535): a, c, t, g, unknown or other
  modified_base (541)..(541): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaaggtgtccagtgtgaggtgcagctggtgcagtcgtgggggagctgtggtacggccgtggggggtccctgagactctcctgtgagcctntggatcacctttgatgattatggcatggcctgggtccgccaagctccgaggggaagggcgtggagtggtctcgtaggtaactaaattacaagtggaggtacaacgaacagtcttaagtagacgtactcgtgggtaggacgggggccctaattccgaacctagttcccgtacccgaaggacgaaccacggcccaccgaaaggtaaccctcccgtggtaactcgtagacaaagtgaaacngtcngaacgngcggtagacacggttccttaatnttacgngttcgcgtcgtgaggttggggttcggtcgttcccgttttcgg

SEQ ID NO: 395327 - DNA, 530 bp, Homo sapiens
  misc_feature: GZ8MTXP01ED6QJ.21.85.H08.1.454.CMB.2.raw
  modified_base (284)..(284): a, c, t, g, unknown or other
  modified_base (301)..(301): a, c, t, g, unknown or other
  modified_base (359)..(359): a, c, t, g, unknown or other
  modified_base (446)..(446): a, c, t, g, unknown or other
  modified_base (455)..(455): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttatttaaaaggtgtccagtgtgaggtgcagctggtgcaggtcgtgggggagctgtggtacggccgtgggggtccctgagactctcctgtgagcctctggatcacttgatgattanggcatggcctgggtccncaagctcgagggagggctgggagtggtctcgtggtataaattacaagtggagtacacncagcttaagagagtactcgtgtgaggggccattcaccatctcagagacagcaccaagaacctccctagtatctagacaaatgaaacngtcagacgngaaccggaggacaccggttcttaaagtattacgttgttagcgtgtggtagtggggttggttcgttcccgttttcg

SEQ ID NO: 395328 - DNA, 604 bp, Homo sapiens
  misc_feature: GZ8MTXP01CKR3V.21.85.H08.1.454.CMB.2.raw
  modified_base (258)..(258): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaaggtgtccagtgtgaggtgcagctggtgcagtcgtgggggagctggtggtacggccgtggggggtccctgagactctcctgngagcctctggatcacttgatgattagtggcagtggccgtgggtccgcaagctccgagggggagggcgtgggagttgggtctcgtaggtaactaaatacaagtggagtacacaacagtacttagtagagactcgtggtgaggggtcctagttcacctatctaccgagacgacgacgaccgtaccaaagtacctcccgttagtaactcgtagaacaaagtcgaaacctaggtccaggacgaccgggaacggaacggaccgtaccgggttcctttaaagtattaaccgttggttacgcggtcggttaagggtaggttgggggttccgggttcgttccccggtttttccg

SEQ ID NO: 395329 - DNA, 604 bp, Homo sapiens
  misc_feature: GZ8MTXP01DMO1R.21.85.H08.1.454.CMB.2.raw
  modified_base (365)..(365): a, c, t, g, unknown or other
  modified_base (374)..(374): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaaggtgtccagtgtgaggtgcagctggtgcagtcgtgggggagctgtggtacggccgtggggggtccctgagactctcctgtgagctctggatcacttgatgattatggcatggcctgggtccgccaagctccgaggggaggggctgggagtgggtctcgtaggtaataaattacaagtggaggtcaacncagtcttanagagactcgtgtaggaggggcctattcgacatctccagagacagcgaccaagaactcccgtagtactccgtagacctaaagtcgaaaactgttcctagaaacggacggaaccccggaagggacccgtaaaccgggttcccttttaaagttacttttaacccgttgggttcggcggtcggttaagggtacggttggggggtttcggggttcgtttcccccgttttttccgg

SEQ ID NO: 395330 - DNA, 556 bp, Homo sapiens
  misc_feature: GZ8MTXP01DR11O.21.85.H08.1.454.CMB.2.raw
  modified_base (263)..(263): a, c, t, g, unknown or other
  modified_base (369)..(369): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaggtgtccagtgtgaggtgcagctggtgcagtcgtgggggagcgtgtggtacggccgtgggggtccctgagactctcctgtgagcctntggatcactttgatgattatggcatggccctgggtcccgccaagcgtccgagggggaaggggctgggagtgggtctcgtggtaataaattacaagtggaggtcacncagtcttatagagactctgtggaggggcctattccgacatcctaccgagagacagccgaccaaagaacctccctagtactctagcaaagtgaaactgtctaggacgaggaacccgagggacacgggttccttaaatgttaacttgttacgccgtgtgaggttggggttggtccgttcccgtttttgg

SEQ ID NO: 395331 - DNA, 773 bp, Homo sapiens
  misc_feature: GZ8MTXP01BMRO4.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaggtgtccagtgtgaggtgcagctggtgcaggtcgtgggggagcgtgtggtacggccgtggggggtccctgagactctcctgtgaagcctctggatcacctttgatgtattagtggcagtcggccgtcggggtcccgccaaaggccgtaccggagggggaaggggcgtgggaggtgggtctcgtaggtaataaattacaagtggaggtaacaacgaacgagtacttaagtaggtagtacgttacgtggttgggaacgggggtcccgtaacgtttaccgaacccgtattacccgtacccgaaaggaacggaaccgaacggacccgaacccgtaaaacgggtaaaccccttacccccgttaaggttaaaccttaccgttaacggaaacctaaaaacgttaggaaaaaccccgtaggtttacccggtaagggtaacgggaaccgggtaacccgggtaaacgggaacccggtaaaccccggggttaccccttttaaagttaacgttttaaacccggttgggttaccggtaacccgggtcgggttaaggtaacgggtttggggggtttacggggttcccggttttcccccggttttttccggg

SEQ ID NO: 395332 - DNA, 602 bp, Homo sapiens
  misc_feature: GZ8MTXP01DDOBF.21.85.H08.1.454.CMB.2.raw
  modified_base (383)..(383): a, c, t, g, unknown or other
  modified_base (490)..(490): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttatttaaaaggtgtccagtgtgaggtgcagctggtgcagtcgtgggggagctggtggtacggccgtgggggtccctgagactctcctgtgagcctctggatcacttgatgattatggctagtcggccgtgggtccgaccgaagcgtccggagggggaagggggcgtgggaggttgggtctcgtaggttaactaaattacaagtgggagtacacncagtcttaatagagactcgtgtaggaggggcctagttccactacgtcaccagacgacacgcgaccaaacgacctcccgtagtacttctacgaacaaagttgaaaccngttactagaacggacggaacccggaaggaccgaaccggttccgttaaatacgttaacgttggttcgcggtcggtgtaggttggggtttcggggttccgttcccgtttttccg

SEQ ID NO: 395333 - DNA, 765 bp, Homo sapiens
  misc_feature: GZ8MTXP01DV0T3.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgcttaattttaaaaggtgtccagtgtgaggtgcagctggtgcagtcgtgggggagctggtggtacggccgtgggggtccctgagctctcctgtgagcctgtggatcactttgatgattagtggcagtcggccgtgggtcccgccgaaagccgtaccgggaagggggaacgggggtcgtagggggtaggttcgggggttctacgttaggggttaaattaaaacgtttaacgaaggttggggaacggttaacccaaacgaaccgtagggtaacctttaaagtaaggaacgtaacttcggttagggtacggggacgggggtaccctaagttcccaaaccctattacccgtaccggaaggtaaccgaaccgaacggacccgaaacccgtaaaaccggtaaacccttccccgttaggttaacctacgttacggaacctaaaagttacgaaaaccgttaggtccgtaaggacgaaccgggaaacccggacgggaaccgtacgggttacctttaaagttaacgtttaccgttggttacgggtaaccggtggttaagggttacggtttcggggggtttacggtttcccgttccccgttttttccgg

SEQ ID NO: 395334 - DNA, 683 bp, Homo sapiens
  misc_feature: GZ8MTXP01AV9BR.21.85.H08.1.454.CMB.2.raw
  modified_base (219)..(219): a, c, t, g, unknown or other
  modified_base (256)..(256): a, c, t, g, unknown or other
  modified_base (284)..(284): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgcttatttaaaggtgtccagtgtgaggtgcagctggtgcagtcgtgggggancgtgtggtacggcgtgggggtccctgagactctctgngaacgcctctggatcacttgatgattanggctatcggccgtcgggtcccgaccaaggccgtaccggaagggggaacggggtcgtgggacggttgggtctacgtagggttaaacttaaaagttacgaaagtaggggacggttaaccaacgtaacagtacttaaagtagaacgtacttcgtagggtaggacgggggtccctattccgaaccacgttacctcccgaagacgaaccagacccgaccgaaacgaccgttccccgtaggttaacctcgttacgaacctaaagttacgaaacctagtacctaggaacgacggaaccggaaggaccgtaccggttacctttaaagtaacgtttaccgttggcgtaacggtccggttaaggaacgggtttcgggggtttacgggttccgtttccccggtttttcgg

SEQ ID NO: 395335 - DNA, 616 bp, Homo sapiens
  misc_feature: GZ8MTXP01AR9KL.21.85.H08.1.454.CMB.2.raw
  modified_base (373)..(373): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttggctgagcgtggtttctgtgctatttaaagtgtcagtgtgaggtgcagcgtggtgcaggtcgtgggggagcgtggtggtaccggccgtgggggtccctgagctctctgtgagcctctggatcactttgatgattatggctagtcggccgtcgggtccaccgaagcgtccggagggggaacgggctgggagttcgggtctgtaggtaacttaaattacaagtggacgtacanaacagtcttaagagagtactgtagtcgggaacggggtccctattccaacctacgtacccgtacgaagacgacgacgaccgtaaccgaacgtaccttccgtagtactcgtacgaataagtacgtaacgtacgtacgtagacggacggaaccggaacggaccgtaccgttaccgttacgttaacgttacgttcgttcgtcggtcggtggttcgggttcgggttcgggttccgtttcccgtttccg

SEQ ID NO: 395336 - DNA, 695 bp, Homo sapiens
  misc_feature: GZ8MTXP01ARCWE.21.85.H08.1.454.CMB.2.raw
  modified_base (219)..(219): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttattttaaaggtgtccagtgtgaggtgcagctggtgcagtcgtggggganctgtggtacggcgtgggggtcctgagactctcctgtgacgctctggatcactttgatgattatggctagtggccgtgggtcccgccgaagcctaccggagggggaacggggcgtaggggaggttgggtcttcgtagggttaaacttaaaagttaacgaagtaggggaacggttaaccaacaacgtagtacttaagtagagtacttcgtggtagggacggggcctacttaccgaaccctattcccgtaccgaagacgaacgacgaccggaaccaaacggaaccctaccgttgtactaccgttaggaacctaaattcggaaactacggttaccgagggaaccggaacgggaacccgaaacgggaccgaacccgggttaccctttaaagttacgtttaaccggttggttcggtaacccgggttcgggttggttacgggtttcggggggtttcgggttcccgtttccccggtttttccgg

SEQ ID NO: 395337 - DNA, 596 bp, Homo sapiens
  misc_feature: GZ8MTXP01DDQRN.21.85.H08.1.454.CMB.2.raw
  modified_base (215)..(215): a, c, t, g, unknown or other
  modified_base (504)..(504): a, c, t, g, unknown or other
  modified_base (547)..(547): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttggctgagctgggttttccttgttgcttatttaaaggtgtcagtgtgagtgcagctggtgcagtcgtgggggancgtgtggtacggccgtggggggtccctgagactctcctgtgacgctctggtatcacctttgatgattatggcagtcggcctgggtccccgaccaacggcctaccggaagggggaacgggggtctggggtaggttgggtctacgttaggttaaattaaagtttacgaagttgggaaggtaccaacaacgagtacttaaagtagagtactcgtgaggacggggtccattcactatctacgagacgacacgcgaccaaagaccttcccgtgtactcgtgaacaaatgaaacngtcagacgacgccgaaggaccacggttcctttatactttacgnggttacgcgtacggtaaggtcgttgggggttcgttcgttccccgttttg

SEQ ID NO: 395338 - DNA, 633 bp, Homo sapiens
  misc_feature: GZ8MTXP01BNRXF.21.85.H08.1.454.CMB.2.raw
  modified_base (224)..(224): a, c, t, g, unknown or other
  modified_base (303)..(303): a, c, t, g, unknown or other
  modified_base (589)..(589): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagtcttgggttttccttgttgcttaattttaaaaggtgtccagtgtgaggtgcagctggtgcgagtcgtgggggancgtggtggtaccggccggtgggggtccctgacgtctctccgtgtgaacgcctcgtggtactctactttgatgtattagnggctagtcggccgtcggtcccgaccgaaggccgtaccggagggggaacgggtcgtgggtaggttcgggtctacggtaggtaaacttaaacgttacgaagtggtacggtaacaacgtaacgtagtacttaagtacgtagtacgtcgtggtagggacggggtcctattccaccgtataccgtacgagacgacgacgccaaccaacgtacctccgttagactcgtagaaccaaagtcgaactagtgagacggcgaaccggtacgacgtacggttcttaatacgttacgngttcggaacgtgtggtcggtggggttccgtcgtttcccgtttcg

SEQ ID NO: 395339 - DNA, 633 bp, Homo sapiens
  misc_feature: GZ8MTXP01AS06V.21.85.H08.1.454.CMB.2.raw
  modified_base (222)..(222): a, c, t, g, unknown or other
  modified_base (300)..(300): a, c, t, g, unknown or other
  modified_base (602)..(602): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgcttaattttaaaaggtgtccagtgtgaggtgcagctggtgcagtcgtgggggancgtggtgggtaccggccggtcgggggtccctggacgtctctccgtgagacgcctgtggactcactttgatgtattagnggctagtcggccgtcgggtcccgaccgagccgtaccggagggggaagggcgtgggaggttggtctcgtaggtaataaatagaagtggagtacaactcagtcttaagagagtactcgtgtacgggacggggtcctaattcccgaacctatacccgtacgaagaacgaccgacgcccgaaccaaacgtaacccgttcccgtagtaacttccgagaaccaaagtcgaaacctgtccgtagacgacggaaccgaagaccgtacgttaccgtttaataacgttcgttggcgtaaccggtggttaagngggttggggttcggttccgtttccgttttcg

SEQ ID NO: 395340 - DNA, 546 bp, Homo sapiens
  misc_feature: GZ8MTXP01DMYKN.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggtttccttgttgctatttaaaaggtgtccagtgtgaggtgcagctggtgcagtctgggggagctgtggtacggcgtggggggtccctgagactctcctgtgaagcctctggatcactttgatgattatggcagtggcctggtccgccaagctccgaggggaagggctgggagtgggtctcgtggtaataaattacaagtggaggtcaacaacagtacttaagtagagactcgtaggtgaggggccattcaccatccgtaccagacgaacacgcaccgaaagaacctccctgtatcgtgaacaaatgaaactgtctagagacgaaccgagggacacgggttcttaagtattacttgttagcgcgtgagtggggttcggtcgttccccgttttg

SEQ ID NO: 395341 - DNA, 551 bp, Homo sapiens
  misc_feature: GZ8MTXP01BDLZ1.21.85.H08.1.454.CMB.2.raw
  modified_base (287)..(287): a, c, t, g, unknown or other
  modified_base (368)..(368): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggagctgtggtacggccgtggggggtccctgagactctcctgtgaagcctctggatcacctttgatgattanggcagtggcctgggtccgccaagctccgaggggaaggggctggagtgggtctcgtggtaataaatacaagtggaggtcacncagcttatagagactgtgtagaggggccgattcaccatcctccaagacgacagccgacaagaacctccctgactcctagcaaattcgaaactgtctagagacggccgaaggacacgggttaccttaatacgttacgttgttggcgacggttgagttgggggttcggttcgttcccgtttttcg

SEQ ID NO: 395342 - DNA, 659 bp, Homo sapiens
  misc_feature: GZ8MTXP01ELTT5.21.85.H08.1.454.CMB.2.raw
  modified_base (224)..(224): a, c, t, g, unknown or other
  modified_base (554)..(554): a, c, t, g, unknown or other
  modified_base (559)..(559): a, c, t, g, unknown or other
tcagtcgtcgctcgcacgaccggtgctcgatttagtatcactcagtcgcgggggagctctgggagaggagccccagccctgagattcccacgtgtttccattcagtgatcagcactgaacacagaggactcgccatggagtttgggctgagcttgggttttccttgttgcttaattttaaaaggtgtccagtgtgaggtgcagctggtgcaggtcgtggggganctggtggtacggcgtgggggtccctgagctctcctgtgaacgcctctggtatcactttgatgtattagtggctagtcgggccgttcggggtccccgacccgaaagtccgtacccgggaaggggggtaacgggggtcgtgggggaggttcgggggttccttcgttagggttaaacttaaaagttacaaagtgggaggtaaccaactaacgaggtacttaagtagacgtacgtcgttagggtagggacgggggcctattccgacctattcctaccgaagacgaacacggccgaaccaaacgtaacctcccttagtacttctagaacaaagtnaaacngttcaggacgacgaaccggtaaggacacggttcttaaagttattacgttggttcgtcgtaggtggtaggttgggggttcggttccgtttccccgttttgg

SEQ ID NO: 395343 - DNA, 596 bp, Homo sapiens
  misc_feature: GZ8MTXP01AQZ7K.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaggtgtccagtgtgaggtgcagctggtgcagtcgtgggggagctggtggtacggccgtgggggtccctggagtctctcctgtgaacgtcctctggtatcaccttgatgtattatggcagtcggccgtggtccgaccagcgtaccgaggggagggcgtgggacgttgggtctcgtaggtaactaaagttacgaagtgggagtaaccacgaactagtcttagacgagtactgtggcggaggggtccagttccaccataccgcaagacgacacgccgacaacgaccgtcctagtactcgtagaccaaagtcgaactcgtcgtaggacgaccggaaccggaacggacgtaccggttccttaataacgttagttggttcgcggtcgtcggtagttcgggggttcgtttccgttcccggtttttccg

SEQ ID NO: 395344 - DNA, 553 bp, Homo sapiens
  misc_feature: GZ8MTXP01B1N18.21.85.H08.1.454.CMB.2.raw
  modified_base (268)..(268): a, c, t, g, unknown or other
  modified_base (288)..(288): a, c, t, g, unknown or other
  modified_base (365)..(365): a, c, t, g, unknown or other
  modified_base (463)..(463): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcaggtcgtgggggagcgtggtggtacggccgtggggggtccctgagctctcctgtgaagcctntggatcactttgatgattanggcatggcctggtccgcaagctccgagggagggctggagtgggtctcgtggtaataaattacaagtggaggtcaacncagcttatagagactcgtgtggaggggcctattcaccatctcagagacagcgaccaagactccctagtactctagacaaatgaaacagtcctagacgnggaacccggaggaccacgggttccttaagtacttacgttggttcggcgtcggtggaggttgggggttcggttcgttccccgtttttcggg

SEQ ID NO: 395345 - DNA, 605 bp, Homo sapiens
  misc_feature: GZ8MTXP01EP62X.21.85.H08.1.454.CMB.2.raw
  modified_base (414)..(414): a, c, t, g, unknown or other
  modified_base (424)..(424): a, c, t, g, unknown or other
  modified_base (452)..(452): a, c, t, g, unknown or other
  modified_base (455)..(455): a, c, t, g, unknown or other
  modified_base (575)..(575): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgcttattttaaaaggtgtccagtgtgaggtgcagcgtggtgcgaggtcggtgggggacgtcgtggtcgggtacggtccggtcggggggtccctggacgtactcctccgtgtagaacgtcctcgtggtacttcctaccgtttgatgtattagtggcagtcggccgtcgggtcccgccaacgccgtaccggagggggaacgggcgtgggaggttgggtctcgtaggtaataaattacagtggagtacancagtcttaanagagactgtgtggagggcctatccacgntcncgagacgacacgccgacaaacgtaacccttccgtagtactcgtacgaactaaagtcgaaaactgtacgtaggacgacggaacgacggttacgacggttcttaagtacttacgttgcgcgngtgaggttggggttgtccgttccgttttcg

SEQ ID NO: 395346 - DNA, 681 bp, Homo sapiens
  misc_feature: GZ8MTXP01C8H96.21.85.H08.1.454.CMB.2.raw
  modified_base (256)..(256): a, c, t, g, unknown or other
  modified_base (281)..(281): a, c, t, g, unknown or other
  modified_base (623)..(623): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttatttaaaggtgtccagtgtgaggtgcagctggtgcagtcgtggggagcgtgtggtacggccgtgggggtccctgagactctcctgngagctctggatcacttgatgattanggcagtcggccgtgggtccgaccgaaagtccgtaccggaagggggtaacggggtcgtgggtacggttcgggttactcgttaagggttaaacttaaaagtttacgaagttacgggaagttacccgaaactaacgtagtacctttaaagtacggaacgtccgttacggtggttacggggacggggtacccgtattccgaacctagtaccctaccgaagacgaaccgagaccgaaccgaaacgtacccttaccccgtagtactaccgtgaaacctaaagttagaaacgtgtaccgtaagacgacgaaccggaggaccctacggttaccttaagtaaacgtttcgnggttcgtaaccggtggttgtagggttcggggtttggttccgttaaccccgtttttcgg

SEQ ID NO: 395347 - DNA, 594 bp, Homo sapiens
  misc_feature: GZ8MTXP01APFVM.21.85.H08.1.454.CMB.2.raw
  modified_base (265)..(265): a, c, t, g, unknown or other
  modified_base (284)..(284): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaggtgtccagtgtgaggtgcagctggtgcagtcgtgggggagctggtggtacggccgtggggggtccctgagactctcctgtgagcctntggatcacttgatgattanggcagtggcccgtgggtccgccaagctccgaggggagggcgtgggagtgggtctcgtaggtaactaaagttacaagtggaggtacacgcagtacttatagagtactcgtggtacgacggggacccagttaccactactcctaccgaggacgacacggaccgaccaaaggtaacccttccctggtaactccgtagacctaaagtcggaaactagttcaggagacgcccggaaggacgaccgggttccttaagtaccttagttgttacggtctgggttgagggtttcggggttcggtcgttccccgttttgg

SEQ ID NO: 395348 - DNA, 603 bp, Homo sapiens
  misc_feature: GZ8MTXP01AMDMP.21.85.H08.1.454.CMB.2.raw
  modified_base (307)..(307): a, c, t, g, unknown or other
  modified_base (413)..(413): a, c, t, g, unknown or other
  modified_base (509)..(509): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttattttaaaggtgtccagtgtgaggtgcagctggtgcagtcgtgggggagcgtggtgggtaccggtccggtggggggtccctggacgtacctcgtcctggtgaacgtccctcgtggatcctacctttgatgtattagnggcagtgggccctggggtcccaccgaagccgtccgagggggaaggggctgggagttgggtctcgtaggtaattaaatacgaaagtgggagtacaacgcagtcttanagagactcgtggtggacggggcctattccacctatcctaccgagacgacacgccgtaccaagtaaccctcctagtactctagactaaagtcgaacngtcaggaacgcggccgaaggacgtacggttacctttaagtaacttcgttgacgtccggtgttggaggttggggttcggttcgttccccgttttg

SEQ ID NO: 395349 - DNA, 744 bp, Homo sapiens
  misc_feature: GZ8MTXP01A2AVI.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgcttaattttaaaaggtgtccagtgtgaggtgcagctggtgcagtcgtgggggagcgtggtggtacggccgtgggggtccctggagactctcctgtgagcctgtggatcacctttgatgtattagtggctagtcggccgtcggtcccgccgaagccgtaccggagggggaacggggctggggaggttcgggtcgtcgtaggtaacttaaagttacgaagttagggagttaaccaacgctaagtacctttaagtaagtagtaccgttcgttgggtaacgggacgggggacccttaagttacccaacccgtaactttacccgtacccgaaaggaaccggaaccgaacggttacccgaaacccgtaaacggtaaaccctttccccgttaggtaaacctttaccctaaggaaaccctaaaagttaccggaaaacgttcggtaccgtaagggaccgaacggggaaccccggtaaagggttaccgtaacccgggttctttaaagttaccgttaacggttggccggtccgtagggttggtaacggtttgggggttacgggttcccgtttcccggtttttaaccg

SEQ ID NO: 395350 - DNA, 570 bp, Homo sapiens
  misc_feature: GZ8MTXP01CMNFP.21.85.H08.1.454.CMB.2.raw
  modified_base (287)..(287): a, c, t, g, unknown or other
  modified_base (367)..(367): a, c, t, g, unknown or other
  modified_base (379)..(379): a, c, t, g, unknown or other
  modified_base (505)..(505): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaaggtgtccagtgtgaggtgcagctggtgcagtcgtgggggagctggtggtacggccgtggggggtccctgagactctcctgtgaagcctctggatcacctttgatgattanggcatggcctgggtccgccaagctccgaggggaaggggctgggagtggtctcgtggtataaattacaagtggagtacacncagtcttatagngactctgtgaggggccgattccgacccatcctccgagacgacagcgaccaaagaaccttccctagtactctgaccaaagtgaaacagtctagagcgaaccggtaaggacgtacggcctttaaagtntttaccgttgttacggccggtggtggaggtttcgggggttaggggtccgttccccgtttttccgg

SEQ ID NO: 395351 - DNA, 546 bp, Homo sapiens
  misc_feature: GZ8MTXP01DF76P.21.85.H08.1.454.CMB.2.raw
  modified_base (218)..(218): a, c, t, g, unknown or other
  modified_base (265)..(265): a, c, t, g, unknown or other
  modified_base (371)..(371): a, c, t, g, unknown or other
  modified_base (381)..(381): a, c, t, g, unknown or other
  modified_base (458)..(458): a, c, t, g, unknown or other
  modified_base (490)..(490): a, c, t, g, unknown or other
  modified_base (496)..(496): a, c, t, g, unknown or other
  modified_base (506)..(506): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttatttaaaggtgtccagtgtgaggtgcagctggtgcagtcgtgggggancgtggtggtacggccgtgggggtccctgagactctcctgtgagcctntggatcacttgatgattatggcatcggccgtggtccgccaagctaccgagggggaagggctgggagttgggtctcgtaggtaataaattacaagtggaggtacacncgagtcttanagagctcgtgtggacggggcattcacagtctcagagacagcgacaacgactccctgtactctagacaaatcgaaacngtcagagacgccgagacgacggttccttaatnttacgngttacgccgnggtgtacggttgggggtttcggtccgttcccgtttttcgg

SEQ ID NO: 395352 - DNA, 838 bp, Homo sapiens
  misc_feature: GZ8MTXP01BOMIM.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgcttaattttaaaaggtgtccagtgtgaggtgcagctggtgcaggtcgtgggggagcgtggtggtacgggccggtggggggtccctggacgtactctcctgtgaacgcctcgtggtatctacttgatgtattagtggctagtcgggccgtcggggtccccgaccgtaaacggtccgtaccggggaaggggggtaaacggggggtcgttgggggtagggttcggggttaccttacggtttaaggggttaaaactttaaaaacggtttaaacgtaaaggttacgggggtaacggttaaacccaaaccgaacgtaacgggttaacctttaaaggtaacgggtaacggttaccgttacgggttagggtacgggggtaaccggggggtaccccttaacgtttacccgaaacccttaacgttaccccggtaacccgaaagggaaccggaaacccgacggaccccgaaaccgtaaacccggttaaaccccttccccgttaaggttaaccttacccgtaaggaaactaaaacgtacggaaaaccgtcggttaccgtagggaaacggaccgggaacccggaacgggaccgtaaccggttactttaacgttacgttaccgttggttcggaacgttcggtaaggtacggttgggggtttcgggttccgtttcccgttttcgg

SEQ ID NO: 395353 - DNA, 687 bp, Homo sapiens
  misc_feature: GZ8MTXP01CFI9C.21.85.H08.1.454.CMB.2.raw
  modified_base (261)..(261): a, c, t, g, unknown or other
  modified_base (273)..(273): a, c, t, g, unknown or other
  modified_base (390)..(390): a, c, t, g, unknown or other
  modified_base (436)..(436): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgcttattttaaaaggtgtccagtgtgaggtgcagctggtgcagtcgtgggggagcgtggtggtacggccgtgggggtccctgagtctctcctgngacgcctgtgtntctacttgatgattatggcagtcggccgtcgggtcccaccgaacggccgtaccggagggggacgggtcgtgggtaggtcgggtctcgtaggtaactaagtagagtggagtacacaanagtactagtagagtactcgtggtacggacgggtcctagtcaacctntaccgtaccaggacgacgacgaccgaaccctaaacgtaacccttccgtagtacgttacctagaacctaaagtacgtaaacctggttaccaggaaccgaaccgggtaaccggaaacggttaaccggtaccggttaccctttaaagttaccggttaccggttggttaccgggtccgggtacgggtttggggttaacgggggttttccggggggtttccgggtttccccggttttccccggtttttttccgggg

SEQ ID NO: 395354 - DNA, 645 bp, Homo sapiens
  misc_feature: GZ8MTXP01B4DU3.21.85.H08.1.454.CMB.2.raw
  modified_base (258)..(258): a, c, t, g, unknown or other
  modified_base (283)..(283): a, c, t, g, unknown or other
  modified_base (519)..(519): a, c, t, g, unknown or other
  modified_base (560)..(560): a, c, t, g, unknown or other
  modified_base (596)..(596): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttattttaaaggtgtccagtgtgaggtgcagctggtgcagtcgtgggggagcgtggtggtacggccgtggggggtcctgagctctcctgngagcctgtgatcacttgatgattanggcagtcggccgtcgggtccgccgaagcgtaccggagggggaaggggcgtggggtaggttgggtctacggttaggttaaattaaacgttacgaaagtcgggaacggtaaccaacaacgtagtactttaagtaggacgtacgttcgtagggtacgggacggggtccctattcccgacctatccctacgaaggacgacgacgcccgaacaaacggtaacccttcccgtaggttaaccncggttacaaacctaaagttcgaaaactgtacgtaggaacgnggaacccggagaccgtaccgttcttaactgttacgngttcggcgtgttggtgggttccggggttggttcccgtttcccgttttgg

SEQ ID NO: 395355 - DNA, 652 bp, Homo sapiens
  misc_feature: GZ8MTXP01DSAK6.21.85.H08.1.454.CMB.2.raw
  modified_base (222)..(222): a, c, t, g, unknown or other
  modified_base (261)..(261): a, c, t, g, unknown or other
tcagtcgtcgctcgcacgaccggtgctcgatttagtatcactcagtcgcgggggagctctgggagaggagccccagccctgagattcccacgtgtttccattcagtgatcagcactgaacacagaggactcgccatggagtttgggctgagcttgggttttccttgttgcttattttaaaaggtgtccagtgtgaggtgcagctggtgcagtcgtgggggancgtggtggtacggcgtgggggtccctgagtctctcctgngagcctcgtggatcacttgatgtatatggctagtggccgtcgggtcccaccgaaagtcctaccggagggggacgggcgtgggaggttgggtctcgtaggtaataaattacgaagtggaggtaacacaacgaggtcttaagagacgtactcgtagggtcgaacgggggtctacgttccacctagtacctaccgaagaacgtacgacgtaccggaccctaaaacggtacctaccccgttagtacccttagacggaaacctaaagttacggaaaacccgtgttaaccgaggaaacgcccggaacggaacggaaacctcgggttaaccttaaaggttacttaccggttggacgtccggtggtgtagggttgggttccgggtctttcccgttttcg

SEQ ID NO: 395356 - DNA, 771 bp, Homo sapiens
  misc_feature: GZ8MTXP01D231E.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttaattttaaaaggtgtccagtgtgaggtgcagctggtgcaggtcgtgggggagcgtgtgggtacggccgtgggggtccctgagactctccgtgtgaacgtcctgtggtatcacctttgatgtattatggacagtcggccgtcgggtcccgaccgaaacgccgtccggaagggggaacggggtcgtgggtacggttggggttctcgttaagggttaaacttaaaacgttacgaaagtacgggaacggttaacccaaccgtaacgtaagtaccgtttaaagaggtacgtaaccgttcgtagggtacggggaacgggggtcctaacttcgaacttcgtaaactttcccgaccaaggaacggaaaccgacggaacccgtaacccgtaaaacggggtaaccccctttacccggttaggttaactaccgttaacgggaaactaaaacggttaacgaaaccggttaagttaccggtaggaaacgggaacccggcgggttaaaccggggaaaccttaccgggttaaccttttaaagttaacgttaccttgggcgtaccggtcggtttagggtcgggtttcggggggttttcgttcccgtttttccccggg

SEQ ID NO: 395357 - DNA, 632 bp, Homo sapiens
  misc_feature: GZ8MTXP01BLXJI.21.85.H08.1.454.CMB.2.raw
  modified_base (393)..(393): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttattttaaaaggtgtccagtgtgaggtgcagctggtgcaggtcgtgggggagctgtggtacggccgtgggggtccctgagactctcctgtgaacgctctggtatcaccttgatgattatggcagtcggccgtcgggtccgccaagctccggagggggaacgggcgtgggaggttgggtctcgtggtaataaattacgaagtggaggtacaacaacagtacttanagagtactcgtggtggacggggccgtacttccaccgactaccgtaccaagacgaccagccgaccaacggaacctcccgtaggtacctcgtacgactaaacgtcgaaacgagtaccgtagaaggcgaaccgggaacggaccgaacccggttacctttaacgttaactttaccgttggttccggtcggtacggttggtacggtttcgggggttcggtttcgtttccccgttttttcccggg

SEQ ID NO: 395358 - DNA, 782 bp, Homo sapiens
  misc_feature: GZ8MTXP01CQRUA.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcaggtcgtgggggagcgtggtggtacggccgtgggggtccctgagactctccgtgtgaacgcctctggtactctacctttgacttgtattagtggctagtcggccgtcgggtcccgaccgaagccgtaccgaagggggaacggggtcgtgggtaggttgggtcctagtaggtaacttaaaagttacgaagttagggagtaaccgaacgtaacgaagtacttaagtaggacgtaacttcgtgggtacgggtacgggggccttaacgttcaaacccgtacgttacccttacccgaaggtacgaaaccacgggacccgtaaccccgaaacgtaaacccgtttcccccgttaggtaaccttaccgttacggtaaaccaaaacggtttcgaaaacccgttaggttacgaacgggaaacggaccggaaccccgggtaaacgggaacccggttaacccggacccgttttttaaaagtacgttttaacccggttgggtttacgggaaccccggttgggtttaacgggttaaccggggttttggggggtttcccgggttcccgtttttccccccggttttttcggg

SEQ ID NO: 395359 - DNA, 623 bp, Homo sapiens
  misc_feature: GZ8MTXP01B0KF9.21.85.H08.1.454.CMB.2.raw
  modified_base (290)..(290): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggagctggtggtacggccgtggggggtccctggagactctccgtgtgaagcctctggatcacgtttgatgattanggcagtcggctggtccgcaagctccgaggggaagggcgtgggagtgggtctcgtggtaataaattacgaagtggaggtacacaacagtcttatagagtactcgtggtagacgggggcctaagttccaaccgattccgtacccgaagaacgaccgagaccgaccaaaacgtacctaccccgttgtaacctccttaggacctaaaagttacggaaactacgttcgtaggaacgaccggaacccggaagggttacccaaacgggttcccttaaagtctttaaccgttgttcggtccgtagtcggtaggttggggttcggtcgttccccgttttcgg

SEQ ID NO: 395360 - DNA, 618 bp, Homo sapiens
  misc_feature: GZ8MTXP01BWF5V.21.85.H08.1.454.CMB.2.raw
  modified_base (275)..(275): a, c, t, g, unknown or other
  modified_base (345)..(345): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaggtgtccagtgtgaggtgcagctggtgcaggtcgtgggggagcgtggtggtacggccgtggggggtccctgagactctcctgtgaagcctctggatcncttgatgattatggcagtggccgtgggtccgccgaagctccgagggggaagggggctgggaggtcgggtntcgtaggtaataaattacgaagtggacgtaacacaagagtcttaataggagactcgtggtggacgggccgaattcaaccgatccgtaccaagacgacacgccgaccgaaacgaacctccccgttaggtactacgtgaaccaaagtacgaaacctagtcctaggacggacgcccggaagggttaccgacggttaccctttaaagtcgtttaaccgttggttacggccggtcggtaaggacggtttgggggttcgggtcgttccccgtttttcgg

SEQ ID NO: 395361 - DNA, 697 bp, Homo sapiens
  misc_feature: GZ8MTXP01AI4J2.21.85.H08.1.454.CMB.2.raw
  modified_base (257)..(257): a, c, t, g, unknown or other
  modified_base (265)..(265): a, c, t, g, unknown or other
  modified_base (268)..(268): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttattttaaaaggtgtccagtgtgaggtgcagctggtgcagtcgtgggggagctgtggtacggccgtggggggtccctgagctctctgngacgctgngtntctacttgatgtattagtggctagtcggtccgtcgggtccccgaccgaacgtccgtaccgggaagggggtaacgggggtcgtagggggtaggttcggggtccttacgttaggttaaacttaaagttacgaagtgggacgtacaacgtaacagtcgttaagtagacgtacgtcgtagggtagggacgggggtcctaacttccgaacctagttaccctacgaagggacaaccgacggcccgaaccgtaaaccggtaaccttcccgttagttaaacctcgtacgaaacctaaagtacgtaaacgtacggtacgtacgggaagaccgggaacccggaagttaaacccgacggtttaaccttaaagttacgtttacggcgttcggccggttgtaagtcgggttggggttcgggttcctttcccggtttttccgg

SEQ ID NO: 395362 - DNA, 753 bp, Homo sapiens
  misc_feature: GZ8MTXP01EV1XK.21.85.H08.1.454.CMB.2.raw
  modified_base (220)..(220): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttggctgagctgggttttccttgttgcttattttaaaaggtgtccagtgtgaggtgcagctggtgcaggtcgtgggggancgtggtggtacgggccgtggggggtccctggacgactctcctggtgaacgcctcgtggtactcctaacctttgatgtattagtggctagtcggaccgttcgggtaccccgacccgtaaaggcccgttacccgggaaggggggtaaacgggggtccgttaggggggtacggtttcgggggtttaccttaccggttaagggggtttaaaactttaaaaacggtttaacgaaaggttacggggtaacggggttaaaccctaaacgaaccgtaagtaccgtttaaagtacgggtaacgtaacgtttcgtagggttacgggacgggggtaccctaatttcccgaacctattacccgtaccgaaggacgaacgacgccgtaaccgaacgtaaaccttccccgttaggtaactaccgtagaaacctaaagtcgaaacctagccgtagacggcgaaccggaagttaccgacggttaccttaagtacttagttggacgtccggtgtggtacgggttggggttcggtccgtttcccgttttcg

SEQ ID NO: 395363 - DNA, 670 bp, Homo sapiens
  misc_feature: GZ8MTXP01AOS0I.21.85.H08.1.454.CMB.2.raw
  modified_base (332)..(332): a, c, t, g, unknown or other
  modified_base (485)..(485): a, c, t, g, unknown or other
  modified_base (530)..(530): a, c, t, g, unknown or other
  modified_base (537)..(537): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttggctgagcttgggttttccttgttgcttagttttaaaaggtgtccagtgtgaggtgcgagcgtggtgcgaggtcggtgggggagtcgtggtcggtaccggtccggtcgggggtccctggagtactctcctgcgacgtcctgtggtatctacttgatgtattagtggactagtcggccgttcgggtacccnccgaacgccgtaccggagggggacgggtcgtgggagttcgggtactacgttaggtaacttaaagtacgaagtcggacgtaacaaccgaagtacgtacgttaagacgtaacgtactcgtagggtacgggacggggtacctacttaccaaccgtntacccgtaccgaagacgaacgacgccgaactaacgaaccttccgngttaacncgtagaactaagtacaacgtcgttgacgagtaacggccgaaaggttacccgtacggttacttaagttacgttacgttcggttcgaaccggtggttaaggtagggttcgggttacgttccgtttcccgttttcg

SEQ ID NO: 395364 - DNA, 571 bp, Homo sapiens
  misc_feature: GZ8MTXP02HFBWM.21.85.H08.1.454.CMB.2.raw
  modified_base (370)..(370): a, c, t, g, unknown or other
  modified_base (383)..(383): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcgtggtttctgttgctatttaaaggtgtccagtgtgaggtgcagctggtgcagtctgggggagctgtggtacggccgtggggggtccctgagactctcctgtgaagcctctggattcacctttgatgattatggcatgctggtccgcaagctccgaggggaagggctgggagtggggtctcgtggtataaaattacaaagtggaggtacacacagcttanagagactctgggnggagggccatcacatcacagagacagccgaccaaagtacctcctagtactcgtagacaaatagaacgacgtacgtacgagacggaccggacggacggtaccggtaccgttaacgttaacgttacgttacggtacggtcggtcggtacggtacggttaggggtttcggggttacggtttcccgtttccg

SEQ ID NO: 395365 - DNA, 542 bp, Homo sapiens
  misc_feature: GZ8MTXP02JEDGQ.21.85.H08.1.454.CMB.2.raw
  modified_base (511)..(511): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaaggtgtccagtgtgaggtgcagctggtgcagtctgggggagctggtggtacggccgtggggggtccctggagactctcctgtgaagcctctggattcaccttgatgattatggcatggcctgggtccgccaagctccgagggaggggctggagtgggtctcgtggtaataaattacaagtggaggtcacacgagtcttatagagactcgtgtgaggggccattcgaccatctccagacgacagcgaccaaagaactccctagtactctagacaaagtcgaaacagtctagagacggaccgaggacacggtaccttaagtacttacgtgtagccgngtagtagtggggttcggtcgtcccgttttcg

SEQ ID NO: 395366 - DNA, 534 bp, Homo sapiens
  misc_feature: GZ8MTXP02HPI4N.21.85.H08.1.454.CMB.2.raw
  modified_base (284)..(284): a, c, t, g, unknown or other
  modified_base (407)..(407): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaggtgtcagtgtgagtgcagctggtgcagtcgtgggggagctgtggtacggccgtggggggtccctggagactctcctgtgaagcctctggattcaccttgatgattanggcatggcctgggtccgccaagctccgagggaaggggctgggagtggggtctcgtggtaataaaagttacaagtggaggtcaacacagtcttaatagagactctgtgaggggccatcacatcnccagagacagcgaccaagactccctgtactcctagacaaatagaaactagtctagagacgaccgaggaccacggccttaatacttactggtgcgtcgtggtagtggggttggtcgttcccgtttcgg

SEQ ID NO: 395367 - DNA, 573 bp, Homo sapiens
  misc_feature: GZ8MTXP02GAQ7U.21.85.H08.1.454.CMB.2.raw
  modified_base (370)..(370): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggagctggtggtacggccgtggggggtccctgagactctcctgtgaagcctctggattcacctttgatgattatggcatggcctgggtccgccaagctccgaggggaagggctggagtgggtctcgtggtataaagttacaagtggaggtcaacncagcttaatagagactcgtggtgagggggcccgagttccaacctaacttccacccgaagacgacagccgaccaaacgacctccctgtactctcgacaaatcgaaactagtcctaggagacggaccggaaggaccgacggtaccttaattacgttactggtgccggtgtaggtagttcggggttcgggtcgttcccgttttcgg

SEQ ID NO: 395368 - DNA, 548 bp, Homo sapiens
  misc_feature: GZ8MTXP02JTPA0.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtctgggggagctgtggtacggccgtggggggtccctgagactctcctgtgaagcctctggattcacctttgatgattatggcatggcctgggtccgccaagctccgaggggaaggggctggagtgggtctcgtggtataaattacaatggaggtcacacagcttatagagactctgtgaggggccgattccgaccatctaccagaagacagcgaccaaagaacctccctagtactcctagacctaaaatcgaaacagtctaggacgacgccggaggacgaccggtacttaacgtattacgtgtcgcgtcgtgtagtggggttcggtcgtcccgttttacg

SEQ ID NO: 395369 - DNA, 561 bp, Homo sapiens
  misc_feature: GZ8MTXP02IFF9M.21.85.H08.1.454.CMB.2.raw
  modified_base (392)..(392): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaggtgtccagtgtgaggtgcagctggtgcagtctgggggagctgtggtacggccgtgggggtccctgagactctcctgtgaagcctctggattcacctttgatgattatggcagtggcctgggtcccgccgaagcctccgaggggaaggggctgggagtgggtctcgtaggtaataaattacagtggaggtcacacagtcttatagagactctggngaggggccagttcacctatctaccagacgacagcgaccaaacgaacctcccgttagtactcgtagacaaagtagaactagttcagaagacgaccggaggaccacggtaccttaatacttacgtgtgaacgtcggtaggtacgttggggtttcggtcgttcccgttttcg

SEQ ID NO: 395370 - DNA, 671 bp, Homo sapiens
  misc_feature: GZ8MTXP02I8T4K.21.85.H08.1.454.CMB.2.raw
  modified_base (266)..(266): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaggtgtccagtgtgaggtgcagctggtgcagtcgtgggggagcgtggtggtacggccgtggggggtccctggagactctctgtgagcctcnggattcaccttgatgattagtggcagtggccgtgggtcccgccaagcctaccgaggggaacggggctgggaggtgggtctcgtggtaataaattacgaagtggaggtacacacagtcttagtagagtactgtggtaggacgggggcctagttccaaccgtattacccgtaccgaaggacgaacgacggccgaacccaaaaggaacccttccccgtaggtaacttccgtaagaaacctaaaagtacggaaaactacggttaccgtaagggaaacgaacgggaccccgggaaagggtaaacccgtaaccggggttaccctttaaagttaacgtttaaccgttggtccggaacgtccggttaggtaacgggtttgggggtttcgggttcccgttcccgtttttcccgg

SEQ ID NO: 395371 - DNA, 523 bp, Homo sapiens
  misc_feature: GZ8MTXP02I1RU8.21.85.H08.1.454.CMB.2.raw
  modified_base (282)..(282): a, c, t, g, unknown or other
  modified_base (354)..(354): a, c, t, g, unknown or other
  modified_base (363)..(363): a, c, t, g, unknown or other
  modified_base (392)..(392): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggtttccttgttgctatttaaaggtgtccagtgtgaggtgcagctggtgcagtcgtgggggagctggtggtacggccgtgggggtccctgagctctcctgtgagcctctggattcaccttgatgattanggcagtggcctggtccgcaagctccgagggagggctggagtgggtctcgtggtataatacagtggagtcacncagtcttanagagtactcgtgtgaggggccagttcacntctcagacgacagcgaccaagactccctagtactctgaccaaatcgaacagtcagagacgcgaggaccacggtaccttagtactacgtgtacgcgtcgtagtaggttgggttcggtcgttcccgttttcgg

SEQ ID NO: 395372 - DNA, 559 bp, Homo sapiens
  misc_feature: GZ8MTXP02J1LJI.21.85.H08.1.454.CMB.2.raw
  modified_base (378)..(378): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtctgggggagctgtggtacggcctggggggtccctgagactctcctgtgaagcctctggattcacctttgatgattatggcagtggcctgggtcccgccaagctccgagggaggggctggagtgggtctcgtggtaataaattacaaagtggaggtcacacagactttanagagactctgtgaggggcagttcaccatctccagagacagcgaccaaagaacctcccgtagtactctagacaaaagtacgaaacgtagtcagaacgacggacccggaggaacgaccggtaccttattacttaccgtgtcgcgtcgtggacggttgggggttcggttcgtcccgtttttcgg

SEQ ID NO: 395373 - DNA, 572 bp, Homo sapiens
  misc_feature: GZ8MTXP02H65QR.21.85.H08.1.454.CMB.2.raw
  modified_base (218)..(218): a, c, t, g, unknown or other
  modified_base (304)..(304): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaggtgtccagtgtgaggtgcagctggtgcagtcgtggggganctgtggtacggccgtgggggtcctgagactctccgtgtgaagcctctggattcacctttgatgattatggctatggcctgggtccnccaagctcgagggagggctggagtgggtctcgtggtactaaagttacgaaagtgggaggtacaacgacagtcttaagtagagtactcgtaggtggaggggcccgtaattccgaacctaattcctaccaagacgaacagccgaccaaaggtaaacctcccctagtaactctagaccaaaagtgaaacagtcaggagacgccggaaggacacggtccttatacttacgtgtgaacgcgtagacggttggggttcggtcgtcccgttttcg

SEQ ID NO: 395374 - DNA, 752 bp, Homo sapiens
  misc_feature: GZ8MTXP02HPO8D.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgcttaattttaaaaggtgtccagtgtgaggtgcagctggtgcaggtcgtgggggagcgtggtgggtacggccggtggggggtccctggagactctccgtgtgaagccctcgtggacttctacctttgatgtaattagtggcagtcggccgtcggggtcccaccgaaaggccgtaccggaaggggaaggggtcgtagggaggtggggtcctcgtaggtaacttaaaagttacgaaagtgggaaggtacaacgacgagtacttaagagtagtacgttcgtggtacggggaacgggggacccgtaatttacccgaaccctagttacccgtacccgaaaggaacggaaaccgaacggacccggaaacccgtaaaacggtaaacccgtttcccccgttaggttaaaccttaccggtacgaaacctaaaaagttacggaaaaccgtacggttacctaagggaaacgggaacggaccccggaaaagggaacccgtaaaccggtacctttaaagttaacgtttaccgtgggtacgccggtacggttaggtacgggtttcgggggtttacggttcccgtttccccgtttttcgg

SEQ ID NO: 395375 - DNA, 593 bp, Homo sapiens
  misc_feature: GZ8MTXP02JRGX9.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggagcgtgtggtacggccgtgggggtccctgagactctcctgtgagcctctggattcaccttgatgattagtggcagtggccgtgggtccgccaagctccgaggggaggggctggagtgggtctcgtggtaataaattacaagtgggagtacacacgagtcttagtagacgactcgtggtgagggggccctaagttccaacctatcctaccgagacgacagccgaccaaagtacctccctagtactccgtagaacctaaatacgaacagtaccgtagaggaacggcccgaaggaccgaacggtaccctttaaagtacgttaccgtgtcggcggtcggttaggtacgttgggggtttcggtccggtccccgtttttcgg

SEQ ID NO: 395376 - DNA, 531 bp, Homo sapiens
  misc_feature: GZ8MTXP02GKLWL.21.85.H08.1.454.CMB.2.raw
  modified_base (366)..(366): a, c, t, g, unknown or other
  modified_base (378)..(378): a, c, t, g, unknown or other
  modified_base (383)..(383): a, c, t, g, unknown or other
  modified_base (404)..(404): a, c, t, g, unknown or other
  modified_base (491)..(491): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtctgggggagctgtggtacggcctggggggtccttgagactctcctgtgaagcctctggattcacctttgatgattatggcatggcctgggtccgccaagctccgagggaaggggctgggagtggggtctcgtggtataaattacaatggaggtcacncagcttataganactcngtgaggggccgattcacatcnccagagacagcaccaaagaacctccctgtatctagaccaaaatgaaacagtctagaagagccgaggacacgggccttaatacttacngtcgcgtcgtgagttgggggttcggtcgtcccgttttcgg

SEQ ID NO: 395377 - DNA, 647 bp, Homo sapiens
  misc_feature: GZ8MTXP02H5ZG8.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttattttaaaaggtgtccagtgtgaggtgcagctggtgcagtcgtgggggagcgtgtggtacggccgtgggggtccctgagtactctcctgtgaagcctcgtgacttcacctttgatgtattagtggcagtcggccgtcgggtccgaccgaagcctaccggaaggggaacggggcgtagggtaggtcggggtctcggtaggtaacttaaaagttacgaaagtacgggtaacggtaccaacgacgtaacgttacttaaagtagagtacgtcttagggtcggacggggaccgtacgttccgacctaatcgtacccgagaacgacacgaccgaccgaaacgtaccttcccgtagtaactcgtagaacctaaagtacgaacgagttacgagaacgacggacggaacggtaccgaccggtaccttaagttaccgttacgtggtacgcgtcgtagtcggttgggttcggtcgtttcccgttttcg

SEQ ID NO: 395378 - DNA, 685 bp, Homo sapiens
  misc_feature: GZ8MTXP02JM19P.21.85.H08.1.454.CMB.2.raw
  modified_base (549)..(549): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaggtgtccagtgtgaggtgcagctggtgcaggtcgtgggggagcgtggtgggtacggccgtggggggtccctggagactcgtcctgtgaagcctcgtggattcacctttgatgtattagtggcagtcggccgtcgggtcccgaccgaagtccgtaccggagggggaacggggtcgtaggggaggttaggggtcctacggttaggtaaattaaaattacgaaagtgggtaacggtacaacgacgtagtacttaaagtagaacgtacttcgtaggtacgggacgggggtaccctattacccaaccgtactacctacccgaaggtacgaacgacgaccgaaaccaacgtaaacccttcccgtagtactaccgtaanaaactaaagtacgaactacgtacgaggacgacggacggaacggacgtaccggttacttaacgttacgttacgtggcgtaacggtacggtagggtacgggtttcggggttacggtttcccggtttacccgttttcgg

SEQ ID NO: 395379 - DNA, 662 bp, Homo sapiens
  misc_feature: GZ8MTXP02H4MOV.21.85.H08.1.454.CMB.2.raw
  modified_base (267)..(267): a, c, t, g, unknown or other
  modified_base (290)..(290): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttattttaaaggtgtcagtgtgaggtgcagctggtgcaggtcgtgggggagcgtgtggtacggccgtggggggtccctggagactctctgtgaagcctntggacttcacctttgatgattanggcagtcggccgtgggtcccgaccaagccgtaccggaaggggaaggggctgggaggtcgggtctcgtggtaataaagttacgaagtgggtagtcaacacgagtacttaagtagaacgactcgtggtaggaacgggggcctattaccgaaccgtattaccacgaacggaacgaaccgacgacccgaaacccgaaagtaaaccccttcccgttagtaacttcccgtaagaacctaaaagtacgaaaacccgtaggtttaccgaagggaacgaaccggacccggaaaacgggtacccgaaccggttacctttaatacgtttacgtggtacgccggtgtaggtgggttcggggtttcggtcgtttcccgttttcgg

SEQ ID NO: 395380 - DNA, 562 bp, Homo sapiens
  misc_feature: GZ8MTXP02JYL4Q.21.85.H08.1.454.CMB.2.raw
  modified_base (219)..(219): a, c, t, g, unknown or other
  modified_base (269)..(269): a, c, t, g, unknown or other
  modified_base (374)..(374): a, c, t, g, unknown or other
  modified_base (383)..(383): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggancgtgtgggtacggccgtggggggtccctgagactctccgtgtgacgcctntggattcacctttgatgattatggcagtcggccgtgggtcccgcaagctccgaggggagggctgggagtgggtctcgtaggtaactaaatacaagtggagtcacncagtactanagagactacgtggtaggaggggcccattccgacctatcaccgagacgacagccgacaagacctcccgtagtactcgtagacaaagtcgaaacagtcagacgacgacggagacacggtacttagtactaccgtgtcgccgtggtcgtaggttcggggtttcggtcctccgtttttaccgg

SEQ ID NO: 395381 - DNA, 549 bp, Homo sapiens
  misc_feature: GZ8MTXP02JTIS4.21.85.H08.1.454.CMB.2.raw
  modified_base (219)..(219): a, c, t, g, unknown or other
  modified_base (342)..(342): a, c, t, g, unknown or other
  modified_base (366)..(366): a, c, t, g, unknown or other
  modified_base (375)..(375): a, c, t, g, unknown or other
  modified_base (379)..(379): a, c, t, g, unknown or other
  modified_base (400)..(400): a, c, t, g, unknown or other
  modified_base (403)..(403): a, c, t, g, unknown or other
  modified_base (439)..(439): a, c, t, g, unknown or other
  modified_base (445)..(445): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggancgtggtggtacggccgtggggggtccctgagactctcctgtgaagccctctggattcaccttgatgattatggcatggccgtgggtccgccaagcctccgagggaagggctgggagtgggtcntggtataaatacaatggagtcacncgagcttanaganatctgtgaggggccattcacntcnccagacgacagcacgaacgactccctgacttcgaanacaaanacgaactagtacgaggacgacggaccggaggaccgaccggtacttatacgttacgtgtcgcgtcggtaggtacggttcggggttcggttccgtttcccgtttcg

SEQ ID NO: 395382 - DNA, 606 bp, Homo sapiens
  misc_feature: GZ8MTXP02HBLWI.21.85.H08.1.454.CMB.2.raw
  modified_base (367)..(367): a, c, t, g, unknown or other
  modified_base (377)..(377): a, c, t, g, unknown or other
  modified_base (390)..(390): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaggtgtccagtgtgaggtgcagctggtgcagtcgtgggggagctggtggtacggccgtgggggtccctggagactctcctgtgaagcctctggattcacctttgatgtattagtggcagtcggccgtgggtccgccaagctccgagggagggctggagtggtctcgtgtaataaatacaagtggagtcacncgagtcttanagagtactcgtgnggagggccgtattcgacatctaccagacgacagccgacaaacgaacctcccgtagtactctagaaccaaagtacgtaaacgagttccgtagaaacggacggaccggaacgggtaccaaccgggttaccttaaagttacgtttaaccgtggttacggccggtcggttaggtacgggtttgggggtttaccgggtttccgttaccccggttttttcgg

SEQ ID NO: 395383 - DNA, 535 bp, Homo sapiens
  misc_feature: GZ8MTXP02G7C8J.21.85.H08.1.454.CMB.2.raw
  modified_base (301)..(301): a, c, t, g, unknown or other
  modified_base (458)..(458): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaggtgtccagtgtgaggtgcagctggtgcagtctgggggagctgtggtacggccgtgggggtccctgagactctcctgtgaagcctctggattcacctttgatgattatggcatggcctgggtccnccaagctccgaggggaaggggctggagtgggtctcgtggtataaattacaagtggaggtcacacagcttatagagactctggtgacggggccattcaccatctaccagacgacagcgaccaaagacctccctagtactctagacaaaagtcgaaacngtctagagacgaccgaggacacggtccttaatacttactgtgcgtcgtagacgttggggttcggtcgtcccttttcg

SEQ ID NO: 395384 - DNA, 591 bp, Homo sapiens
  misc_feature: GZ8MTXP02G5YYI.21.85.H08.1.454.CMB.2.raw
  modified_base (267)..(267): a, c, t, g, unknown or other
  modified_base (553)..(553): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaggtgtccagtgtgaggtgcagctggtgcaggtcgtgggggagcgtggtggtacggccgtggggggtccctggagactctctgtgagcctcnggattcaccttgatgattatggcagtggccgtgggtccgccaagctccgaggggaagggctgggaggtgggtctcgtggtaataaatacaagtggagtcacgacagtcttaagagagactcgtggtaggacgggggccctattccgacctattcctaccgaagacgaccaggaccgaaccgaaacgaaaccttccccgtagtacctcgtacgaacctaaaagtcggaaacctagtcctaggaacgacgccggaagaccgaccggtaccttaagtacttacgtgcgngtcgtagaggttggggttcggtccgttcccgttttacg

SEQ ID NO: 395385 - DNA, 650 bp, Homo sapiens
  misc_feature: GZ8MTXP02FVUAW.21.85.H08.1.454.CMB.2.raw
  modified_base (216)..(216): a, c, t, g, unknown or other
  modified_base (373)..(373): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcgtggtttcctgttgctattttaaaaggtgtccagtgtgaggtgcagctggtgcagtctggggganctggtggtacggccgtggggggtccctgagactctcctgtgaagcctctggattcacctttgatgattagtggcatggccgtgggtcccgaccaagcctccgaggggaacggggctgggagtggtctcgtggtactaaagttcaagtggaggtcacncagcttaatagagtactcgtggtagacgggggtccattaccaccaattcccgacccgaaggacgaaccgacgtaccgacccgaaaacggtaacccttaccccctaggttaaacctccggttacgaacctaaaagttcggaaaacctggttaccgtaggaacgaacgggtaaccggacggaaaccgaacccgggttacctttaaagtaactttaaccgtggttacggccgtaggtcggtacgggttgggggtttcgggttccgttcccgtttttccgg

SEQ ID NO: 395386 - DNA, 609 bp, Homo sapiens
  misc_feature: GZ8MTXP02J1R04.21.85.H08.1.454.CMB.2.raw
  modified_base (218)..(218): a, c, t, g, unknown or other
  modified_base (266)..(266): a, c, t, g, unknown or other
  modified_base (288)..(288): a, c, t, g, unknown or other
  modified_base (306)..(306): a, c, t, g, unknown or other
  modified_base (370)..(370): a, c, t, g, unknown or other
  modified_base (379)..(379): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtctggggganctgtggtacggccgtggggggtccctgagactctcctgtgaagccctntggattcacctttgatgattanggcagtggcctgggtccncaagctccgaggggtaagggctgggagtggggtcctgtaggtactaaattacaatggagtcacncagcttaanagatctgtgtaggacgggcatccactatcacagagacacgaccgaaccaaacgtacctccgtagtactactagaacaaagtaacgaacgtaacgtacgtacgaacgaacggaccggaacggaaccgtaaccggttaaccgttaaacttaacgttaacgttacggtacggtaacggtacggtacggtacgggttacggggtttacggggtttccggtttcccgttttccgg

SEQ ID NO: 395387 - DNA, 567 bp, Homo sapiens
  misc_feature: GZ8MTXP02IM2RJ.21.85.H08.1.454.CMB.2.raw
  modified_base (536)..(536): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaggtgtccagtgtgaggtgcagctggtgcagtcgtgggggagcgtgtggtacggccgtgggggtcctgagactctcctgtgagcctctggattcaccttgtatgtattatggcagtcggccgtcgggtcccgccaacggcgtaccggaggggaaggggcgtggaggtgggtctcgtaggtaataaataacaagtaggtagtacaacacgatacttatagagtactcgtggtaggacgggggcctattccgaaccattcctaccgaagaacgacagaccgaccaaacgaacctccctagtactctagacaaatgaactgacctagagaacgtccggaagacacgtaccttatactactgtncgtcgagtacggtggtttcggcttcgtttcg

SEQ ID NO: 395388 - DNA, 666 bp, Homo sapiens
  misc_feature: GZ8MTXP02ICAF1.21.85.H08.1.454.CMB.2.raw
  modified_base (257)..(257): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaagtgtcagtgtgaggtgcagctggtgcagtcgtgggggagcgtgtggtacggcgtgggggtcctgagactctctgtgagctntggattcacttgatgtattagtggctagtcggtccgtcggggtcccgaccgaaggccgtaccggaaggggaaggggcgtggggaggtggggtcctcggtaggtaactaaaagttacgaagtgggaggtacacagagtacttaatagagtacttcgtggtgggacggggcctagttcccaactactccgtaccgaagaacgaccaggaccgaccgtaaagaacctccgtagtaacttccgtagaactaaaagtacgaacgtcggttacgacggaacggaaccgacccgggtaaacggacccgaaaccgggtttacccttaaagtttaacgttaccgttaggtcggaaccgggtcgttagggttacgggttgggggttttccggggtaccgttttcccccggtttttccgg

SEQ ID NO: 395389 - DNA, 902 bp, Homo sapiens
  misc_feature: GZ8MTXP02IWD1W.21.85.H08.1.454.CMB.2.raw
  modified_base (264)..(264): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggagcgtgtggtacggccgtgggggtccctgagactctctgtgagcctntggattcaccttgatgtattagtggcagtcggccgtggggtccccgaccaaaggtcccgtacccggaaagggggaaacgggggtccgttaggggtacgggttcgggggttaccgttaccggtttaggggttaaaactttaaaaacgtttaaaccgtaaaaggtttacgggggtaaacggttaccgaaaaccgtaccgtaacgggtttaacctttaaaaggttaacgggtaaacggttaaacccgttcggtttacgggggtaacgggggtaaccggggggttaccccgtaaacttttacccccgaaaacccctagtttacccccgttaccccggaaaaggtaaccggaaacccgaaccgggtcccgaaaacccccgtaaaaacgggttaaaaccccttccccccgtttaaggttaaaccttacccggttaacggaaaaccctaaaaaagttccggaaaaaacccgttggttaacccgttaagggaaaacgggaaccgggtaaccggaaacgggaccgtaaacccggggttacccttttaaaagttaccgtttaaacgttcgggttcggcccgggttacggttaggttacgggtttcggggggtttaccgggtttccgtttacccccgggtttttttcgg

SEQ ID NO: 395390 - DNA, 795 bp, Homo sapiens
  misc_feature: GZ8MTXP02HEMSM.21.85.H08.1.454.CMB.2.raw
  modified_base (218)..(218): a, c, t, g, unknown or other
  modified_base (266)..(266): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaaggtgtccagtgtgaggtgcagctggtgcagtcgtgggggancgtgtggtacggccgtgggggtccctggagactctcctgtgaagcctntggattctacttgatgtattagtggcagtcggccgtcggggtcccgccgaaacggccgtacccggaaggggaacgggggcctaggggtaggtcggggttcctacggttagggttaaattaaaacgttaaccgaaagttaggggaacggttaccaacgacgtaacggtacctttaacgtaagaacgtaacctttcgtagggtaggggtaacggggggtaccctaacgtttcccgaacccgtaatcccgtacccgaaggaaccggaaccgacggcccgaaaccgaaacggaaacccttccccgtagtaaccttcccgaagtacaaaacgttacggtaaaactacggttaccgaaggaacgaaccggaacccgggtaaagggaaaccccggaacccgggtttaaacccgtttaaactttaacgtttaaacccgtgggtttaaccggccggttaccgggtttaaaggggtaccgggtttttaggggggtttacggggtttccccggtttacccccggttttttttacccgggg

SEQ ID NO: 395391 - DNA, 679 bp, Homo sapiens
  misc_feature: GZ8MTXP02JT33T.21.85.H08.1.454.CMB.2.raw
  modified_base (265)..(265): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttcctgttgctatttaaaggtgtccagtgtgaggtgcagctggtgcagtcgtgggggagcgtgtggtacggccgtgggggtccctgagactctctgtgagcctgtggnttcaccttgatgattatggcagtcggccgtgggtcccgccgaagccgtccggaggggaaacggggcgtggggaggtcggggtctcgtggtaactaaagtacgaagtgggaggtacacacgagtacttaagtagagtacgtcgtggtagggacgggggtaccctaagtttaccgacccagttacccgtacccaaaggaacgaacccgacggacccgaacccaaacggtaacccttaccccgttaggtaaccttccgtaagaacccaaaagttacgaaaaccgtaggttaccgtaggaacggaacggacccggaagggaaccctacggggtacctttaacgtaacgtttaaccgtggtacggcggtacgttacgggtaggttgggggtttcgggttaccgttcccggtttttccgg

SEQ ID NO: 395392 - DNA, 571 bp, Homo sapiens
  misc_feature: GZ8MTXP02FYC0U.21.85.H08.1.454.CMB.2.raw
  modified_base (378)..(378): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgctattttaaaaggtgtccagtgtgaggtgcagctggtgcagtcgtgggggagctggtggtacggccgtgggggtccctgagactctccgtgtgaagcctctggattcacctttgatgattatggcagtggccgtgggtccgccgaagcctaccggaggggaagggcgtgggagtgggtctcgtaggtaataaatacgaagtggagtcacnagtcttagtagagtactcgtgtggacggggtccgtattccaacctattaccgtccgaaggaacgacgacgccgaaccaaacggtaaccctcccgtagtactcgtagaacaaagtcaacgtagtctagagacgacgagacacgtactagtactacgtgtcgcgtcgtgtagtcgggttaggtcgtccttttcgg

SEQ ID NO: 395393 - DNA, 602 bp, Homo sapiens
  misc_feature: GZ8MTXP02GEINV.21.85.H08.1.454.CMB.2.raw
  modified_base (218)..(218): a, c, t, g, unknown or other
  modified_base (302)..(302): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttattttaaaggtgtccagtgtgaggtgcagctggtgcagtcgtgggganctggtggtacggccgtgggggtccctggagctctcctgtgaagcctgtggattcaccttgatgattatggcatggctgggtccncaagctccgagggagggctggagtggtctcgtggtaataaattacaagtggacggtcacacagcttaagagagacctgtggtggacgggggcctagttccacccgtatacctccgaagagacgagccgaccaaacggaacctccccgtagtactacgtacgaacaaagttcgaaaacgtgtaccgtagagaacggaccggaacggtaccaaccggggttaccctttaaagtacgtttaaccgtggttagcccggtagtaggtacgggttggggtttcggttcgtaccccgttttttccgg

SEQ ID NO: 395394 - DNA, 663 bp, Homo sapiens
  misc_feature: GZ8MTXP02JTVPD.21.85.H08.1.454.CMB.2.raw
  modified_base (268)..(268): a, c, t, g, unknown or other
  modified_base (290)..(290): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttcctgttgctatttaaaggtgtccagtgtgaggtgcagctggtgcagtcgtgggggagctggtggtacggccgtgggggtccctgagactctcctgtgaagcctcgtggnttcacctttgatgattagtggnagtggccgtggggtcccgaccaacgcctaccggaggggaacggggcgtggaggtggggtctcgtaggtaataaagttacaagtggagtcaagacagcttagtagatactctaggtgggaacggggtccgtaattccgaacctattccaccgaaggaacgaccgaggcccaaaccgaaacggtaaacccttccccgttaggtaacttcgtacgaactaaaatacggaaacctagtaccgtagaaaacggccggaaccggaaggaccctaccggttacccgttaatttaaacgtaccgttgggtcgtcccggggtgtttaggggacgggttttggggggttcggtttcccgggtttcccccgttttttaacgggg

SEQ ID NO: 395395 - DNA, 754 bp, Homo sapiens
  misc_feature: GZ8MTXP02G3CJ9.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgctatttaaaggtgtccagtgtgaggtgcagcgtggtgcgagtcgtgggggatcgtggtggtacggccggtgggggtccctggagactctctgtgaagcctgtggtacttctaccttgatgtattagtggctagtcggccgttcgggccaccgaagccgtccggaaggggacgggcgtgggaggtgggtctagtaggtaactaaacgtacaagtcggacgtacaacgacgagtacttaagagtacgtactgtgggtacgggacgggtccctaattccgaacccttagttcccgaccgaaggaacgaccgacggacccgaaaccgtaaacttaaccccgtcccttaggttacctacgtacggaaaacctaaaagtcggtaaaaccgtcggttaccgaaggggaaacgtaaccgggtaccccgggaaaagggttaacccgtaacccgggtttacctttaaaagtttaccccggttttaaaccgggtcgggtaccgggtaacccgggttacggggtttaacggggtttacgggggttttacccgggggtttaccgggtttacccccgtttttaccccgggtttttaccgg

SEQ ID NO: 395396 - DNA, 609 bp, Homo sapiens
  misc_feature: GZ8MTXP02HVZ69.21.85.H08.1.454.CMB.2.raw
  modified_base (213)..(213): a, c, t, g, unknown or other
  modified_base (255)..(255): a, c, t, g, unknown or other
  modified_base (280)..(280): a, c, t, g, unknown or other
  modified_base (393)..(393): a, c, t, g, unknown or other
  modified_base (408)..(408): a, c, t, g, unknown or other
  modified_base (453)..(453): a, c, t, g, unknown or other
  modified_base (486)..(486): a, c, t, g, unknown or other
  modified_base (497)..(497): a, c, t, g, unknown or other
tcagtcgtcgctcgcacgaccggtgctcgatttagtatcactcagtcgcgggggagctctgggagaggagccccagccctgagattcccacgtgtttccattcagtgatcagcactgaacacagaggactcgccatggagtttgggctgagcgtggtttctgtgctatttaaaggtgtcagtgtgaggtgcagctggtgcagtcgtgggggancgtgtggtacggcgtggggggtccctgagactctctgtgacnctctggattcactttgatgattagnggcagtcggccgtggggtcccgaccaaaggcctaccggaagggggaacggggcttggggaggtggggtctcgtaggtaataaagttacaaagtggagtcaacgctagcttaanaggactactgtaggngggacggggacctattacccgacctaattccaccgaagaacgacncggacacccaaagtaacctcccgtatactccgngaacaaagtanaaacgtgttacgagagaccgacgggaacgtacgaaacggttccttaaagtactttaacggtgtacgtaacggtcggtacggtaggttgggttcgggttcggtttccgtttcg

SEQ ID NO: 395397 - DNA, 615 bp, Homo sapiens
  misc_feature: GZ8MTXP02GL6MN.21.85.H08.1.454.CMB.2.raw
  modified_base (213)..(213): a, c, t, g, unknown or other
  modified_base (284)..(284): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcgtggttttctgtgctatttaaaggtgtcagtgtgaggtgcagctggtgcagtcgtgggggancgtggtggtacggccgtgggggtccctgagactctcctgtgaacgctgtggattcacctttgatgtattanggctatcggccgtggtcccgacgaacgtcgtaccggaggggaaggggcgtagggtaggtcgggtctcggttaggtaaacttaaattacgaagtgggtaggtacaacaccgaagtacgttaagtagacgtacgttcgtggtacggggacggggtaccctattaccaccgtaactccgtacccgaaggaaccgacgaacggccgtaaacccgaaacgtaacccgtcctacgtactccgtagaaaccaaagtcgaaactagtccgagacgacgacgagacgacgtactatacgtactgtagcgtgtagtcggtggttcggtcttccgttttacg

SEQ ID NO: 395398 - DNA, 890 bp, Homo sapiens
  misc_feature: GZ8MTXP02JQC9D.21.85.H08.1.454.CMB.2.raw
  modified_base (291)..(291): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggagctggtggtacggccgtgggggtccctgagactctcctgtgaagcctcgtggtatctaccttgatgtattagnggctagtcggccgtcggggtcccgccgaaaggccgtaccggaggggaaacggggtccgtaggggtacggttcggggttctacggttaggtaaagttaaaagtttaaccgtaaaggttacggggtaacgggttacccaacgaccggtacgtacctttaaagtaacggaagtaccgtttacgttagggttacgggggaaccggggggtaccccgttaagtttccccaaaaccccggttaacttacccccgttaaccggaaaacgggtaaacccggaaaccgtaaacccggaccccgggaaaacccccgtaaaaccgggtaaaacccccttccccccgtttaagggttaaaccttacccgggttaacgaaaccctaaaaaacgtacgggtaaaacctaacggttaccgttaaggggaaaacggtacccgggtaacccgggaaaacgggtaacccggaaacccggggttacccttttaaaaggttaaccgttttaaacccgtaggggttacggtccccgggttacggggttaacggttaagggggttttccgggggtttacgggggtttacccggttttacccccggttttttttacccgggg

SEQ ID NO: 395399 - DNA, 605 bp, Homo sapiens
  misc_feature: GZ8MTXP02F6JLA.21.85.H08.1.454.CMB.2.raw
  modified_base (265)..(265): a, c, t, g, unknown or other
  modified_base (269)..(269): a, c, t, g, unknown or other
  modified_base (285)..(285): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggagcgtggtggtacggccgtgggggtccctgagactctcctgtgagctntggntcacttgatgattagngcagtcggccgtggtccgccaagcctccggaggggaggggctgggagtggtctcgtaggtataaagtacaagtggaggtacacacgacgtcttaagtagagtacgtcgtggtagggacggggccctattccgacctcgttacctacccgaaggaacgaccgacggaccgaaacccgtaaacggtaaacccttccccgtagtaacttcgtaacgaaacctaaagtcgaaacgtagttccgagagacgacgaacgacgacgtcttaagtacgttacgtgcggaaccgtgtaggtggtggggtttcggactttcccgttttcg

SEQ ID NO: 395400 - DNA, 607 bp, Homo sapiens
  misc_feature: GZ8MTXP02J08QQ.21.85.H08.1.454.CMB.2.raw
  modified_base (204)..(204): a, c, t, g, unknown or other
  modified_base (375)..(375): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctaattttaaaagtgtccagtgtgagtgcagctggtncagtcgtgggggagcgtggtggtacggccgtgggggtccctgagctctcctgtgagcctctggacttcacctttgatgattagtggcagtcggccgtgggtcccgccgaagcctccggagggagggctgggagtggtctcgtaggtaataaattacaagtcggagtcaacncagtacttagagacgtactcgtgggtggacggggtccagttcgaccctatcctaccgaagacgacacgccgaaccgaaagtaccctccttagtactcgtacgaacaaaagtcaaacgtagtaccgaggacgacgggaccggaaggacccgtaacggtacccttaattacgttaccgttggtccgtcgtcggttggtacggtttgggggttcggttccgttcccgtttttccg

SEQ ID NO: 395401 - DNA, 663 bp, Homo sapiens
  misc_feature: GZ8MTXP02JWB7U.21.85.H08.1.454.CMB.2.raw
  modified_base (265)..(265): a, c, t, g, unknown or other
  modified_base (423)..(423): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgtgggggagcgtgtggtacggccgtgggggtccctgagactctctgtgagcctcngattctacttgatgattagtgcagtcggccgtggtcccgcaagcgtccgaggggagggctggtagtgggtctcgtaggtaataaattacgaagtgggacgtacacacagtacttagtaagagtactcgtaggtcggacggggtcccattccgaacctntacccgtaccgaagaacgacagacccaacgtaaacgaaacctccccgttagtacgttacccagtaacctaaaacgtcggaaactacggtttaccgagggaaacgaccgggaaccccgggaagggaacccgtaacccggggttaccctttaagtaaaccgtttacccgtggtaccggtccgggtacgttaggggtaccgtttgggggtttacccgggtccgttttcccccggtttttaggg

SEQ ID NO: 395402 - DNA, 628 bp, Homo sapiens
  misc_feature: GZ8MTXP02GAIH3.21.85.H08.1.454.CMB.2.raw
  modified_base (212)..(212): a, c, t, g, unknown or other
  modified_base (219)..(219): a, c, t, g, unknown or other
  modified_base (264)..(264): a, c, t, g, unknown or other
  modified_base (286)..(286): a, c, t, g, unknown or other
  modified_base (429)..(429): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctattttaaaaggtgtccagtgtgaggtgcagctggtgcagtcgngggggancgtgtggtacggcgtgggggtccctgagctctcgtgtgaagctcnggtatcactttgatgtattagngcagtggccgttgggacccactaagcgaccggaaggggaagggtctgggaggttgggtctgtaggtaattaaacttacaagtggacgtcacgctagacttagtacgatacgtgtaggtaggacgggggacctattacaaaccngttaccaccaggaactacgaacgccgaacttaaacaacctcccgttatactacgacgaacgtaaagacgaacgtacgtacgacgacggacggaaccggaacggaaccgtaaccgttaaccgttaacgttaacgttacgttaggtacggtcggtcggttacggttacgggttgggtttcggtttaccgtttccgtttccg

SEQ ID NO: 395403 - DNA, 776 bp, Homo sapiens
  misc_feature: GZ8MTXP02F7S4P.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgctatttaaaggtgtccagtgtgaggtgcagctggtgcagtcgtgggggagcgtggtgggtacggccgtgggggtccctgagactctccgtgtgaagtcctgtggtacttctaccgttgattgacttagtggcagtcggaccgtgggtcccgaccgaagccgtaccggaagggggaacgggtcgtaggggtacggtaggtcgtacgtaggttaaactaaaagttaaccgaaaggtcggaacggttaccaacgtacgagtaccgtttaaagaacggtaacgtaacgtttccggtagggtaacgggggacggggtacccgtaaacgttacccgaacctactttacccgacccgaaggaacgaccgaacggaccaaaccgaaaacgtaaaccccttccgttagtaacctttacgtaacgaaaccctaaaaggtaccgtaaaaccgtaagttacgtaacgaaacgggaccggtaacccgggaacggaaccggtaaaccggtttacctttaaaacggtaactttaacccggttaaggtcgtaaccggggttaccggttacgggtaaagggtttccgggggtttaacgggtttccggtttaccccgtttttccggg

SEQ ID NO: 395404 - DNA, 634 bp, Homo sapiens
  misc_feature: GZ8MTXP02F0KPQ.21.85.H08.1.454.CMB.2.raw
  modified_base (185)..(185): a, c, t, g, unknown or other
  modified_base (450)..(450): a, c, t, g, unknown or other
  modified_base (536)..(536): a, c, t, g, unknown or other
  modified_base (596)..(596): a, c, t, g, unknown or other
  modified_base (603)..(603): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgtcttaattttaaaaggtntccagtgtgaggtgcagctggtgcaggtcggtgggggagcgtggtgggtaccgggccggtggggggtccctggacgtacctctccgtgtagacgcctgtggtacttctacctttgattgtaattagtcgctagttcggccgtcggggtcccacgaacgccgtaccggaggggaacggggtcgtagggtacggtgggtcctagtacggtaattaaaacgtacgaagtggaggtacaactacgacgttataagtacgagtacttagnggttacgggacgggaccctaattccaaactacttccgacgagaacgtacgagccctaaacaacgtacctcccgtaatctacggaanaccgtaaatccgaaatcgtcaaggacgacggaccgagaccgacgtacttaataacgttcngtacggngtagtgtacggtcggttcgtccgtttctttg

SEQ ID NO: 395405 - DNA, 747 bp, Homo sapiens
  misc_feature: GZ8MTXP02HSUEO.21.85.H08.1.454.CMB.2.raw
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagcttgggttttccttgttgcttaattttaaaaggtgtccagtgtgaggtgcagctggtgcagtcgtgggggagcgtggtgggtacggccggttcggggggtccctggacgtacttctccgtgtagaacgcctcgtggtacttcctacctttgattgtactttagtggactagtcggtccgttcgggtaccccgaccgaaacgtccgtaccgggaaagggggaaggggtccgttaggggtacggttcggggttccgtaggttaggggttaaacttaaaacgtttaacgaagttacggggaaggtcccaaacgtacgtacgtaacttaagtaaggtagtaacccgtttgtgggtacggggaaggggtccctaacgttaccgaacctacgttcccacgaaggacgaaccgagtacccgaaccgaaacgttaccttcccgtagtaccttacgtacgaaacaaaacgttcgaaaccgtagttccgaggaacgaccggaccggaacgtaacccggtacgtaccttttaaagtacgttacgtcggtacggaacgtcggttaggtacgggtttgggggttccggttccgttttacccgtttttcgg

SEQ ID NO: 395406 - DNA, 723 bp, Homo sapiens
  misc_feature: GZ8MTXP02IZAV4.21.85.H08.1.454.CMB.2.raw
  modified_base (295)..(295): a, c, t, g, unknown or other
tcagtcgtcgctcgcacgaccggtgctcgatttagtatcactcagtcgcggggagctctgggagaggagccccagccctgagattcccacgtgtttccattcagtgatcagcactgaacacagaggactcgccatggagtttgggctgagctgggttttccttgttgcttaattttaaaaggtgtccagtgtgaggtgcagctggtgcagtcgtgggggagcgtggtggtacgggccgtgggggtccctgacgactctccgtgtgacgtcctcgtggacttcacttgatgtatangcagtcggccgtcggccgccgaagtccgtcggaaggggacgggtcggtagggtaggtggggttctcgttagggttaaactttaaaacgtacgtaagtggggtaacggttacaacctacgacgttacgttaaagtacgagtacgtacgtggggttacggggacgggggtaccctagttacccgaaccctacgttaccctaccgaacggaacggtaacccgaggaccccggtaaacctaaaccggtaaaccccttccccttaggtacttaccgtaacgaaaccgtaaaagttaccgaaacgtaacggtttccaaagggacgtacggaaccggacggtaaaccgtacccggtaactttaagttacgttacgtggttcgccggttaggtcggtggtttcgggggttccgttccggtttacccgtttttacgg

SEQ ID NO: 395407 - DNA, 592 bp, Homo sapiens
  misc_feature: GZ8MTXP01BSE4E.2.71.G05.1.454.CMB.2.raw
  modified_base (219)..(219): a, c, t, g, unknown or other
  modified_base (460)..(460): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctcagaacctattatgcaagtggtaccagcagaagccaggacaggcccctgtaattgcatctatggaatctaataggtaaaaaccaaccggccctacgagggactcccagaccccgattctctcggctaccctactcaaggaaacacagtccttcttgacccattcacgtggggctacgaggacggaagatggaaggctaggacttatttagttaggtaaaggtacccgggggaanaaggaacggttaggtaaattacgaagtgggttaggttcgggacgggtaagggaccgaaggtccttaggacccgtcgttaacggttccacggaaccctaaggcctacggcccccttggtccttaaccgttccg

SEQ ID NO: 395408 - DNA, 644 bp, Homo sapiens
  misc_feature: GZ8MTXP01DBVU2.2.71.G05.1.454.CMB.2.raw
  modified_base (221)..(221): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaagganacagcctacaagaacctattatgacaagttggtaccagcagaacgccaggacacggcccctagtaattgtacatctatggaatctaatacggtaaaaaccaaccggcctacgaacgggactcccagaccccgattctcgtcgctaccctactcaaggaaacacagtcttacctgaccatcacgtcggggctcgagggacggaagagtggagactgtaacttagttagttaggtaacggtccgggaacaggtaaacgtggttaaattacgtagttgggttcggttacggggacggggtaacgggaacccgaaagggtcccgttacggtaaccccggttccgttaaccggttaccgaacccgggtccccgaaaacgggtcccgtaccccggcccccggttaccggtcccttaacccgtttccccg

SEQ ID NO: 395409 - DNA, 710 bp, Homo sapiens
  misc_feature: GZ8MTXP01A0C8R.2.71.G05.1.454.CMB.2.raw
  modified_base (246)..(246): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagccctacaagaacccttattangactaagttcggtaccagcagaacgccaggacacggcccctagtaattgtcatctatgaatctagtacggtaaaacaccggcctacgaacgggactacccgagaccccgtattctcgtcgcctaccctactcgaacggaaaccacacgtccttaccgtagaaccctatccgaacgtcgggggaccttacgaaggggtaccgaaggtacgtggaacggtctagtaacttaagtttaacgggttacggtaaacgggttacccggggaataaggtaaaggttaggttaaacttaacgtagttggggttacggttaccggggacggggtaaacggggaacccgttaaagggtccgttaccggtaaccccggttaccgttaaacccgggttccgaaaccgggaaccccgtaaacgggtccccgttacccggtcccccccgttcgggtaacccttaacccgtttccccgg

SEQ ID NO: 395410 - DNA, 560 bp, Homo sapiens
  misc_feature: GZ8MTXP01EYJSO.2.71.G05.1.454.CMB.2.raw
  modified_base (239)..(239): a, c, t, g, unknown or other
  modified_base (412)..(412): a, c, t, g, unknown or other
  modified_base (487)..(487): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattangcaagttgaccagcagagccagacaggccctgtaatgcatctatgaatctataggtaaaaaccaccggccctagagggactacccagaccccgtattctactggccctaaccgtactcaaacgggaaacacagtccttcctagacccatcacgtcgggctacgaggacgaagngtagaggctagactaattaggttagtaaaggtaccggggactaagaagtggttaaattacgagttggtagtcggnggaacgggacaaggcgttgaccgtcttacgttccagccccaaggcctcgcccccgttaggtccaacgttcccg

SEQ ID NO: 395411 - DNA, 586 bp, Homo sapiens
  misc_feature: GZ8MTXP01COJ7G.2.71.G05.1.454.CMB.2.raw
  modified_base (241)..(241): a, c, t, g, unknown or other
  modified_base (476)..(476): a, c, t, g, unknown or other
  modified_base (495)..(495): a, c, t, g, unknown or other
tcagacgctcgacacacgaccggtgctcgatttagtgtcgtcgcaagagagagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaagaacctattangcaagttggtaccagcagaagccaggacacggcccctagtaattgtcatctatggaatctaataggtaaaaaccaaccggcctacgaagggactacccgagaccccgtattcgtcgtcggtcctaccctactcaaggtaaaccacacgtccttcctagacccattcgaacgtggggctacgaggacggaagagtggaagctagaacttattaggttaggtaaacggtccgggaanaaggtaagtagtaattacngttgggtcgttacgggcgggaaggaaccgagtcttcggacccgtcttacgttcaccgccgacggtcctcgccccgttcgtcaaccgttccg

SEQ ID NO: 395412 - DNA, 666 bp, Homo sapiens
  misc_feature: GZ8MTXP01AJ1HF.2.71.G05.1.454.CMB.2.raw
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacaacgtaaaccttattatgactaaggttcggtaaccagacaagaacgccaaggacacggcccctagtaattgtacatctagtacggaatactaataacggtaaaaaccaacccggtaccctacgaagggtacctcccgaacgacccgtattctacgtcggctaaccctactaacgaaggtaaaccacgtacgtccttacctacgaccctattaccgacggttcggggacctacggagggacggaaagagtcggaagcctaggtacttaagttaggtttaaggtaacggggtaccgggaagtaaggtaaaggtacggttaaattacgtagttggggttacggttcggggagggtaacgggtaacgaggtcgttacgtaccgtccgttacgttcacgcccgtaagccgtccgccccgttcggtccttaacgtttccccg

SEQ ID NO: 395413 - DNA, 720 bp, Homo sapiens
  misc_feature: GZ8MTXP01DU4QP.2.71.G05.1.454.CMB.2.raw
  modified_base (220)..(220): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctacaagtaaccttattatgactaagttcggtaccagacaagaacgaccgaggacacggcccctagtaattgactatctaagtaggtaatactaagtaacggtaaaaacccaacccggtcccgtacgaacgggacctacccgaacgtaaccccgtacttctcgtacgtcccttaaccctaactaacgaaacggaaaccacgtaacgtccttaccgttagaaccctactacgtacggtcggggacctacggaacgggacggaaagtagtacgggacggtctaagtaacttaagtttaacggttacgggtaaacgggtacccggggaaataagggtaaaggttacggttaaacttaacggtagttggggttacggtcggggaacggggtaacgggaaccgttaggtccgttaccggtacccgttccgttaacggttccaccggtaacccgaacggtcccgtacccggtcccccgttacggtcccaaccgtttccccg

SEQ ID NO: 395414 - DNA, 842 bp, Homo sapiens
  misc_feature: GZ8MTXP01CCUWO.2.71.G05.1.454.CMB.2.raw
  modified_base (246)..(246): a, c, t, g, unknown or other
tcagacgctcgacacacgaccggtgctcgatttagtgtcgtcgcaagagagaggggggctcagaagcagatttctggggtgtctccaccatggcctggacccctctctggctcactctcctcactctttgcataggttctgtggtttcttctgagctgactcaggaccctgctgtgtctggtggccttgggacagacagtcaggatcacatgaccaaaggagacagcctacaacgtaacctattangactaagttggtaccagcaagaacgccgaggacacggcccctagtaattgtcatctagtaggaatacgtaataacggtaaaaaccaaccggaccctacgacgggactacccgaacgaccccgtacttactcgtcggcctaaccctacgtaaccgaaacggtaaaacctacgtacgtaccctttaccgttacgaaccctacgtaccgtaaccggtcggggtaccgtacgaacggggaaccggtaaacggtagttacgggacggtaccttaaggttaaacgttaaagttttaacggggtttaacggggtttaaaccggggttaacccgggggtaaacggttaaaacggtaaacgggtttaaagggtttaaaacgtttaaaccggtagggtttaacgggggtttacggggtttaacccgggggaacgggggtaaacggggtaaacccggttaaacggggtaccgttaaccgggtaaaccccgggttaccccgttaaaccgggttaccccggaaacccgggtaaccccggtaaacgggttccccgttccccgggtaccccccggttacccggttaacccgttaaccccgttttcccccgg

SEQ ID NO: 395415 - DNA, 538 bp, Homo sapiens
  misc_feature: GZ8MTXP01B6ESO.2.71.G05.1.454.CMB.2.raw
  modified_base (220)..(220): a, c, t, g, unknown or other
  modified_base (229)..(229): a, c, t, g, unknown or other
  modified_base (241)..(241): a, c, t, g, unknown or other
  modified_base (445)..(445): a, c, t, g, unknown or other
  modified_base (469)..(469): a, c, t, g, unknown or other
  modified_base (530)..(530): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggngacagcctnagaacctattangcaagttggtacagcagaagcaggacacggcccctgtaattgtcatctatggaatctatagtaaaacaaccggcctacgaggactcccgagaccccgtattctctcggcctacctactcaaggtaaaccacacgtcttacctgaccctatcacgtgggctcgaggtacggagactgagctgtactagttagtgtaggtcggganagagtgtaatacagtggtgtcggnggaagggacaggcttcgaccgtcgttacgttcgacgtccacggctccgaccccttggtccncgttcccg

SEQ ID NO: 395416 - DNA, 904 bp, Homo sapiens
  misc_feature: GZ8MTXP01CFILO.2.71.G05.1.454.CMB.2.raw
tcagacgctcgacacacgaccggtgctcgatttagtgtcgtcgcaagagagaggggggctcagaagcagatttctggggtgtctccaccatggcctggacccctctctggctcactctcctcactctttgcataggttctgtggtttcttctgagctgactcaggaccctgctgtgtctgtggccttgggacagacagtcaggatcacatcgaccgaaagggacgaacacgccctacgaacgtaaaccttattaatcgactaaggttcggtaaccagaccaaggaaacgaccgaaggaccgaacggtccccctaggtaaactttggtactattacctaagtagggtaaacttactaagttaacggtaaaaaaaacccgaacccggtaccccgtaccggaacgggtaacctaccccgaacggtaaccccccggttaactttccgttaccgtacgggtcccttaaaccccgttaacccgttaacgaaaaccggggtaaaaccctaaaccgtaacgttacccgttttaccccgttttacggaaacccccttaacgttacccgtaaaccgggttcggggggtacccgttaccggaacgggggaacccgggtaaaggtaacggttacgggaacgggttcgttaacggtaaccgtttaaacgttttaggtttaacggggtttaaaccggggttacccgggggtaaacgttaaacgggtaaacgggttaagggtttaaaccgtttaacggtaaggtttacggggttacgggtttacccgggggacgggggtaaacggggtaaccgttaaacgggtacccgttacggtaaccccggttccgttaaccgttccgaccgtaacccggaacggtcccgtcccgtcccccggttacgtccgttaaccgtttccccg

SEQ ID NO: 395417 - DNA, 558 bp, Homo sapiens
  misc_feature: GZ8MTXP01DPZ6L.2.71.G05.1.454.CMB.2.raw
  modified_base (228)..(228): a, c, t, g, unknown or other
  modified_base (431)..(431): a, c, t, g, unknown or other
  modified_base (472)..(472): a, c, t, g, unknown or other
  modified_base (488)..(488): a, c, t, g, unknown or other
  modified_base (500)..(500): a, c, t, g, unknown or other
  modified_base (514)..(514): a, c, t, g, unknown or other
  modified_base (554)..(554): a, c, t, g, unknown or other
tcagacgctcgacacacgaccggtgctcgatttagtgtcgtcgcaagagagaggggggctcagaagcagatttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctnagaaacctattaatgcaaagttggtaccagcagaaagccaaggacaggcccctgtaaattgcatctaatggaaatctaataggtaaaaaaacaaccggccctacagggatcccaagaaccccgattctactgcctaccctaactccaaagggaaaacacagtccttcttgaacccatcaacgtggggctcgaaggacggaaanatgaaggctagaacttattaagttgtaaagtccggggaaanaagaagtagtaaatanagtggtgtcggnggaaggaacaagcngaccgtcttacgcacgaaccgagctcgccccgttcgtccncgtc

SEQ ID NO: 395418 - DNA, 745 bp, Homo sapiens
  misc_feature: GZ8MTXP01DJCAK.2.71.G05.1.454.CMB.2.raw
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggacacacgcctacgaagtaaccttattatgactaaggttcggtaaccagacgaagaacgaccgaggaacgacggtcccctagtaattgtactatctagtaggtaaacttactaagtaacggtaaaaaaccgaacccggaccctacgaacggaacctccccgaagtacccccgtattctacgtcggccttaaccctactcgaaacgggaaaccacgtacgtccctttccttacgaaccctactacgacggttcgggggaccttacggacggggaccggaaaggtaacgtacgggacgtacgtaagtaaccgtttaaagtttaacgggttaggttaaacggggtacccggggtaaagtaacggtaaacggttaggttaaacgttaaccggtagttgggggttacggttaccgggggacgggtaaacgggtaaccgaaggtccgttacggtaacccggttcccttaacgggttccaaccgaaccgaacggtccgtacccgtccccgttacggtcccttaaccgttccccg

SEQ ID NO: 395419 - DNA, 684 bp, Homo sapiens
  misc_feature: GZ8MTXP01A6QQM.2.71.G05.1.454.CMB.2.raw
  modified_base (529)..(529): a, c, t, g, unknown or other
tcagacgctcgacacacgaccggtgctcgatttagtgtcgtcgcaagagagaggggggctcagaagcagatttctggggtgtctccaccatggcctggacccctctctggctcactctcctcactctttgcataggttctgtggtttcttctgagctgactcaggaccctgctgtgtctgtggccttgggacagacagtcaggatcacatcgaccaaaggagacagccctacaacgtaaccttattatgactaaggttggtaccagacaagaagaccaggacacggcccctagtatgtcatcatgaatctaatacgtaaaacaccggcctacgacggactaccgagaccccgtattctacgtgcctacctactcgaagaaacacactccttctacgacctactacgacggtgggctacggagggtaccggaaagtagtaggacgaccgttagtaactttaacgtttaggtttaacgggtaacgggttaccggggacgtaaagggtaaaggttaggttaaactttaacgngtttaggggttacggttacggggacggggtaacgggaacccgttaaggtccgttaccggaacccgttaaccgttccggttaccgacccggtaaccccgtaacggtcccgttaccccggcccccggttaccggtaaccgttaacccgtttcccccg

SEQ ID NO: 395420 - DNA, 706 bp, Homo sapiens
  misc_feature: GZ8MTXP01DGT5C.2.71.G05.1.454.CMB.2.raw
  modified_base (220)..(220): a, c, t, g, unknown or other
  modified_base (243)..(243): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactcttgcataggttctgtggtttcttctgagctgactcaggaccctgctgtgtctgtggccttgggacagacagtcaggatcacatgaccaaagganacagcctacaagaaccttattangactaagttggtaccagacagaacgcgaggacacggcccctagtaattgtacatactagtaggtaatactaagtaaggtaaaaacccgaacccggaccctacgacggactacccgaacgacccgtacttctcgtcggcctaaccctactcgaacgaaacacacgtccttacttacgaccactcgacgtcgggtactacgacgggtacggaagtacgtaggacggtaccgtagtaactttaagtttacgggtttaacggttaacggggtaccggggaaacgtaaggtaaacggttagggttaaactttaaccgtaggttacgggttcgggttaccggggacggggtaaacgggtaacccgaaggtcccgttaccggtaacccggttcccggttaaccgttccgacccgtcccggaaacggtcccgtacccggcccccgttacgggtcccttaaccgtttccccg

SEQ ID NO: 395421 - DNA, 586 bp, Homo sapiens
  misc_feature: GZ8MTXP02IES2R.2.71.G05.1.454.CMB.2.raw
  modified_base (227)..(227): a, c, t, g, unknown or other
  modified_base (239)..(239): a, c, t, g, unknown or other
  modified_base (339)..(339): a, c, t, g, unknown or other
tcagacgctcgacacacgaccggtgctcgatttagtgtcgtcgcaagagagagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctnagaacctattangcaagtggtaccagcagaagccaggacaggcccctgtaatgtcatctatggaatctaataggtaaaaacaccggcctacaggactccagaccccgattcnctgctcctactcaagaaacacagcttactgaccatcacgtgggctcgaggcgaagatgaggctagacttattattaggtaaggtacccgggaagaagtaagtaggtaaattacgtagttgggttacggttacgggacgggtaacggggacccgaaaggccgttacggaacccgttccgtaaccgtccgaaccggaacccgaaacggcccttaccggcccccccgttcgggtaccctaccgttccccg

SEQ ID NO: 395422 - DNA, 546 bp, Homo sapiens
  misc_feature: GZ8MTXP02F16M5.2.71.G05.1.454.CMB.2.raw
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaacctattatgcaagttggtaccagcaagaagccaggacaggcccctgtaatgtcatctatggaatctataggtaaaaacaccggcctacgaggatacccagaccccgattctctggctcctactcaacggaaacacagtcttactgaccatcacgtgggctcgaggacgaagatcgagctgacttattagttaggtaacgtccggggaactaggtaaagttggtaaattacgaagttggtagttcggacggacggaccaagctacggaccgtctacgtcacgcccgaaggcctccggacccctcggtccactccg

SEQ ID NO: 395423 - DNA, 687 bp, Homo sapiens
  misc_feature: GZ8MTXP02I2MUL.2.71.G05.1.454.CMB.2.raw
tcagacgctcgacacacgaccggtgctcgatttagtgtcgtcgcaagagagagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgcatctatggaatctataggtaaaaacaccggcctcagggactcccgagaccccgattcctctacggctacccgtactcgaagggaaaccacaacgtccttccttagaccctaatccgaacgtgggggcctacgaagggacggaagagtggacggtcgtacgtaacttaagtttaagttacggttaaaggtccccggggtaataaagggtaaaggttagggttaaaacttacgtaagttggggttacgttaccggggcgggtaaagggggaacccctaaagggtccgtaacggtaccccggttacccgttaaaacggtccgtaaccgggaacccccgtaaaacgggggtcccttacccgggtccccccccgttacggggttacccttaaccccggtttttcccccgg

SEQ ID NO: 395424 - DNA, 509 bp, Homo sapiens
  misc_feature: GZ8MTXP02GQVIH.2.71.G05.1.454.CMB.2.raw
  modified_base (390)..(390): a, c, t, g, unknown or other
  modified_base (496)..(496): a, c, t, g, unknown or other
tcagacgctcgacacacgaccggtgctcgatttagtgtcgtcgcaagagagagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaatgcatctatgaatctataggtaaaaacaccggcctcaggatcccagaccccgatctctgctcctactcaagaaacacagcttctgacccatcactggggctcgaggcgaagntcgagctagactattatgtaagtcgggaacagaagtgtaattacagtggtgtcggcggaacgggaccagctagaccgtctacgtcagcccgaaggcctcgaccccncggtccacgttcc

SEQ ID NO: 395425 - DNA, 704 bp, Homo sapiens
  misc_feature: GZ8MTXP02I2O3M.2.71.G05.1.454.CMB.2.raw
  modified_base (223)..(223): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaaggganacagcctacaagaaccttattatgactaaagttcggtaaccagcaagaagccaggacacggcccctagtaattgtcatctatggaatctatagtaaaaacaccgcctacgaggactaccgacgaccccgtaattcctcgtacggtcctacctaacgtcgaaacggaaaacacgtaacgtcctttaccttacgaaccctatcccaaacggtcgggggactacgaacggggacggaaagaagtggaacgggctaggtaacttaagtttaacgttacgggttaaagtacccgggggtaataaagggtaaaggttacggtaaattaacgtaggttacggggttacgggttcggggaacgggtaaacggggaaccgtaaacggtccggtacgggtaaccccgttaccgtaaaccggtccaaaccggaaccccgtaaacggtcccgttacccggccccccgtttacgggtcctacccgtttaccccg

SEQ ID NO: 395426 - DNA, 581 bp, Homo sapiens
  misc_feature: GZ8MTXP02GBJ1A.2.71.G05.1.454.CMB.2.raw
tcagacgctcgacacacgaccggtgctcgatttagtgtcgtcgcaagagagagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgcatctatggaatctataggtaaaaacaccggcctacagggactaccagaccccgattctctggctacctactcaacgaaacacagccttctgaccatcacgtggggctgaggacggaagacgtagaggctaggaaacttaattagttaggtaacggttcccggggaataaggtaaagtagggtaaattacgaagttgggtagttacgggacgggacggaaccgaaagtcgtacggacccgttcctaacggtccgaacgcccgaaaggcccttaccggccccccgtaggtccactttcccg

SEQ ID NO: 395427 - DNA, 577 bp, Homo sapiens
  misc_feature: GZ8MTXP02HQCG0.2.71.G05.1.454.CMB.2.raw
  modified_base (410)..(410): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctacagaacctattatgacaagttggtaccagcaagaagccaggacaggcccctagtaattgcatctatgaatctatagtaaaacaccggcctacagggactacccgagaccccgtattcctctcgtctcctactcaacggaaacacacgtcttctcgaccatcacgtgggctcgaggacggaagntgacgctagacttattagttagtaaggtccgggtaagaagaagtaggtaaattacgagttgggtacgtcgggacgggaacgggaccgaaaggcgtacggaacccgttccgtacggtccaacgaacccgaaggccgtccgacccccgttcggtaccctacgtttcccg

SEQ ID NO: 395428 - DNA, 598 bp, Homo sapiens
  misc_feature: GZ8MTXP02JG0MQ.2.71.G05.1.454.CMB.2.raw
  modified_base (241)..(241): a, c, t, g, unknown or other
  modified_base (467)..(467): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacagaacctattangacaagttggaccagcagaagcaggacaggcccctgtaattgtcatctatgaatctataggtaaaaacaccggcctacgagggactaccgacgaccccgtattcctctcggcctacctactcgaacgaaacacacgtccttacctacgacctatccacgtcggggactacgaggacgaagagtaggagactagtaacttaattagttaggtaacggaccgggtaanaaggtaagtaggtaaacttagaggttggtaggttcgggaacgggtacgggaccaaggtcgtacggacccgtaccgtacggcgaaccgaaccgaacggtcctcccgaccccgtcggtacctaccgttccccg

SEQ ID NO: 395429 - DNA, 514 bp, Homo sapiens
  misc_feature: GZ8MTXP02GK5ES.2.71.G05.1.454.CMB.2.raw
  modified_base (335)..(335): a, c, t, g, unknown or other
  modified_base (394)..(394): a, c, t, g, unknown or other
  modified_base (418)..(418): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaacctattatgcaagttggtaccagcagaagccaggacaggcccctgtaatgcatctatgaatctatagtaaaaacaccggcctacaggactccagacccgatcnctggctcctactcaagaaacacacgtccttctagaccatcacgtgggctcgagcgaagntgagctgactatatgtagtcgganagaagtggtaatacagtggtagttcggcggtagggaccaaggctaggaccgtctaacgtcaacgcccgaaagcctcgccccctggcctacgttccg

SEQ ID NO: 395430 - DNA, 546 bp, Homo sapiens
  misc_feature: GZ8MTXP02IVU83.2.71.G05.1.454.CMB.2.raw
  modified_base (221)..(221): a, c, t, g, unknown or other
  modified_base (241)..(241): a, c, t, g, unknown or other
  modified_base (381)..(381): a, c, t, g, unknown or other
tcagacgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaagganacagcctcagaacctattangacaagtggtaccagcagaagcaggacacggcccctagtaatgtcatctatgaatctatagtaaaacaccgcctacgaggactccagacccgatctctggctcctactcagaaacacagtctctagacatcacgtgggcncgagacggaagatgaggctgacttagttatagtaagtcgggaacagaagtagtaatacgagttggtagttcgggacgggtacgggaccgaaggtccgtacgaccggtcctaccggtacacggtaacccgaaggtccgtccgcccccgttacggtcctacttcccg

SEQ ID NO: 395431 - DNA, 696 bp, Homo sapiens
  misc_feature: GZ8MTXP02HFEKE.2.71.G05.1.454.CMB.2.raw
  modified_base (221)..(221): a, c, t, g, unknown or other
  modified_base (244)..(244): a, c, t, g, unknown or other
tcagacgctcgacacacgaccggtgctcgatttagtgtcgtcgcaagagagaggggggctcagaagcagagttctggggtgtctccaccatggcctggacccctctatggctcactctcctcactctttgcataggttctgtggtttcttctgagctgactcaggaccctgctgtgtctgtggccttgggacagacagtcaggatcacatgaccaaagganacagcctacaagtaacctattangactaagttcggtaccagcaagaacgccaggacacggcccctagtaattgtacatctagtaggaatctaagtaacggtaaaaaccacccggacctacgacggactacccgagaccccgtatctctcgtctacctactcgaacgaaacacgaacgtcctttacctacgaaccctacgtaccgtaccggtacggggacctacggaacggggaacgggaaagtagttacgggaacggtacgtacgtaaaccgttaagtttaacgttacgggttaaacgggtccggggaaacgtaagggtaaaggttacggttaaagttacgtaggttacgggttacgggtttacggggacggggtaacgggaaccgtacggtacgtaccggtacccgttacccgtaacggtccgaaccgaacccgaacggtccgtcccggtccccgtcggtacctactttccccg

SEQ ID NO: 395432 - DNA, 538 bp, Homo sapiens
  misc_feature: GZ8MTXP02GJVW1.2.71.G05.1.454.CMB.2.raw
  modified_base (228)..(228): a, c, t, g, unknown or other
  modified_base (240)..(240): a, c, t, g, unknown or other
  modified_base (394)..(394): a, c, t, g, unknown or other
  modified_base (436)..(436): a, c, t, g, unknown or other
tcagacgctcgacacacgaccggtgctcgatttagtgtcgtcgcaagagagaggggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaaggagacagcctnagaacctattangcaagttggtaccagcagaagccaggacaggcccctagtaattgtcatctatggaatctatacggtaaaaacaccggacctacagggactcccagacccgtatctctcgctcctatcagaaacacacgctctgaccatcacgtgggctgacggngaagctggagcgtagacttattagttagtaaggtaccggganaagaacgtaggtaattacaggtggtgttcgggacggtacggacgaagcgtcgaccgtctacgtcgacgccgaacggtctcgccccgtcggtccacgttcccg

SEQ ID NO: 395433 - DNA, 703 bp, Homo sapiens
  misc_feature: GZ8MTXP02IJVRG.2.71.G05.1.454.CMB.2.raw
  modified_base (246)..(246): a, c, t, g, unknown or other
tcagacgctcgacacacgaccggtgctcgatttagtgtcgtcgcaagagagaggggggctcagaagcagagttctggggtgtctccaccatggcctggacccctctctggctcactctacctcactctttgcataggttctgtggtttcttctgagctgactcaggaccctgctgtgtctgtggccttgggacagacagtcaggatcaacatgaccaaaggagacagcctacaagtaacctattangactaagttacgtaccagacagaacgcgagacacgccctagtaattgacagtctagtagaactactaagtaacggtaaaaaacccgacccggtaccctacggaacggtacctaccccgagaccccgtacttccgtacgtcggtacctacccttaacgtaccgtaaacggaaacctaacgaccgttacctttacgtacgaaacctacgtacctacggtcggacgtacgaggacggaagtagtacggacgtcgtaggtaacttaagttaagttacggtaaaccgggtccgggtaaacggtaaggtaaacggttaggttaaacttacgtaaggttgggttacgtacggggacggtaacgggaaaccggtaaggtccgttaaccggtaccgtaccgtacggtacgaaccggtaaccgtaacgccgttcccgacccgttaccggtacctaccgtttaccccg

SEQ ID NO: 395434 - DNA, 695 bp, Homo sapiens
  misc_feature: GZ8MTXP02JTD40.2.71.G05.1.454.CMB.2.raw
  modified_base (245)..(245): a, c, t, g, unknown or other
  modified_base (403)..(403): a, c, t, g, unknown or other
tcagacgctcgacacacgaccggtgctcgatttagtgtcgtcgcaagagagaggggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcaacatgaccaaaggagacagcctcaagtaacctattangacaagttggtaccagcaagaagccaaggacacggcccctagtaaattgtacatctatggaattctaagtaacggtaaaaaccacccggtccctacgacgggtactacccgagacccccgtattccgtcgtcggtcctacctactcgaaacggaaacnccgaacgtccttaccgttcgaaccctataccgaacgtcggggaccttacggagggaccggaagacgtaggaccggtacttaggtaacttaacgtttaagttcggttaaacgggttacccggggaaacgtaaggtaaacggttacggttaaacgttaagtaggttggttaacggtcggggaacggtaacgggaacccgtaggtaccgtacggtaacccgttaccgtaacggtccaaccggtaacccgaacggtccgttacccggacccccttgggtacccctacgtttccccg

SEQ ID NO: 395435 - DNA, 742 bp, Homo sapiens
  misc_feature: GZ8MTXP02G06P7.2.71.G05.1.454.CMB.2.raw
  modified_base (221)..(221): a, c, t, g, unknown or other
  modified_base (241)..(241): a, c, t, g, unknown or other
tcagacgctcgacacacgaccggtgctcgatttagtgtcgtcgcaagagagaggggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgaccaagganacagcctcagaacctattangcaagtgtaccagcagaagccaggacacggcccctgtaatgtcatctagtaggaatctaagtacggtaaaaaccaccggaccctacgaacgggactacccgagacccccgtattcctcgtcggcctacctactcgaacggaaaccacgacgtaccttcccgttagaacccattccaacggttcgggggacctcggaaggggtaccgggaaagagttacgggaacggtccgtaggtaaaccgtttaagttttaacggtttaacggggttaaaccggggtacccgggggtaaacctaaaggggttaaaacgggttaggtttaaaacgtttaacgtaaggttacggggttacgggtttacgggggacggggtaaacggggtaacccgaaaggcccgttacggaaccccgtttaccgttaccgtaaccgtaaccggaacccccggtaaaacgggtcccgttccccggtaccccccggtttccgggtaccctacccgtttcccccg

SEQ ID NO: 395436 - DNA, 611 bp, Homo sapiens
  misc_feature: GZ8MTXP02FVF3K.2.71.G05.1.454.CMB.2.raw
  modified_base (220)..(220): a, c, t, g, unknown or other
  modified_base (373)..(373): a, c, t, g, unknown or other
  modified_base (452)..(452): a, c, t, g, unknown or other
tcagacgctcgacacacgaccggtgctcgatttagtgtcgtcgcaagagagaggggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaagganacagcctcagaacctattatgcaagttggtaccagcagaagccaggacacggcccctagtaattgtcatctatgaatctaatacggtaaaacaccggcctacgaggactcccgagaccccgtattctctcggctccgtactcagaaacacacnccttctacgacctatcacgtgggctcgaggacgaagagtgagtctagtaacttattagtaggttaacggtaccgggaanaaggaaaggttaggttaaacttaacgaggttggtaggttacgggacgggaacgggtaacccgaaaggtccgtacggtacccgttacccgttaaccggccgaaccggaacccgaaacggtcccgtacccggtccccccgtaggtacccaccgtttccccg

SEQ ID NO: 395437 - DNA, 515 bp, Homo sapiens
  misc_feature: GZ8MTXP02F3P81.2.71.G05.1.454.CMB.2.raw
  modified_base (239)..(239): a, c, t, g, unknown or other
  modified_base (436)..(436): a, c, t, g, unknown or other
tcagacgctcgacacacgaccggtgctcgatttagtgtcgtcgcaagagagagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaacctattangcaagttggtaccagcagaagccagacaggcccctgtaaatgtacatctatgaatctaatacggtaaaaaacaccggcctacgaagggatccccaagaccccgattctctggctacctactcaggaaacacagcttacctgacccatcacgtggggctcgaggcgaagatggagctgactatattgaagtcgggaanagaagtgtaatagagtgtgtacggaggacgacagctacgaccgtactacgcacgccgaacgcctccgcccgtgcactcg

SEQ ID NO: 395438 - DNA, 741 bp, Homo sapiens
  misc_feature: GZ8MTXP02JXOKD.2.71.G05.1.454.CMB.2.raw
  modified_base (221)..(221): a, c, t, g, unknown or other
tcagacgctcgacacacgaccggtgctcgatttagtgtcgtcgcaagagagaggggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatcgacaagganacacgccctacaacgtaacctattagtacgactaaggttacggtaccagacgaagaacgaccgaacggaacgacggacccctagtaattcgtacatcgtaagtagtaatacgtaacgtaaacggtaaaaacccgacccggtacctacgaacggacctacccgaacgtaccccgtacttcgtcgtacgtctaccctactaccgaaacgaacacgacgtccttaccgtacgacctactcgtaggtacccccccccgggtagtaccgacgggacggaacgacgtaggacggtacgtacgtaacgttaagtttaagttacggttaacgggtaaccggggtaacggtaaaggtaacggttaaggttaaacgttaacggtaggttacgggttacgggtacggggtacggggtaacgggaaccggtaacggtacccggtacggtacccggtacccgtaccgtaccgaccgtaacccggaccggtacccgtcccggtacccccgtaccgtacccgtaccgttaccccg

SEQ ID NO: 395439 - DNA, 713 bp, Homo sapiens
  misc_feature: GZ8MTXP02FMHY5.2.71.G05.1.454.CMB.2.raw
tcagacgctcgacacacgaccggtgctcgatttagtgtcgtcgcaagagagaggggggctcagaagcagatttctggggtgtctccaccatggcctggacccctctctggctcactctcctcactctttgcataggttctgtggtttcttctgagctgactcaggaccctgctgtgtctgtggccttgggacagacagtcaaggatcacatgaccaaaggacacagcctacaacgaaccttattatagacgtaaaggttcggtaaccgagacgaacggaaacggccgaacggaccgtaccggtccccttagtaatttcgtactagtacttagtagtaactacgttaagtaaacggtaaaaacccgacccggtacctacggacgggtaccacccgtacgaccccgttacttaccgtcgtcggtaccctacctactccgaaaacgtaaacacgtacgtcccttaacgttacgaacctactaccgtaacgggtacgggtaccttacggaacgggtacgggaacggtagtaggacggtactacggtaattagttaacggttacgggaacggtaccgggtaaggtaaagtaaggttaacgttaaagacgtaaggttggtagggtccggtacgggacggtacgacgtcgtacggtaccgtaccgtacgcctaaccggccgacggtaccgacccgacccgttccgacgtcccgttacccg

SEQ ID NO: 395440 - DNA, 688 bp, Homo sapiens
  misc_feature: GZ8MTXP02FNJYZ.2.71.G05.1.454.CMB.2.raw
  modified_base (229)..(229): a, c, t, g, unknown or other
  modified_base (242)..(242): a, c, t, g, unknown or other
tcagacgctcgacacacgaccggtgctcgatttagtgtcgtcgcaagagagaggggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgaccaaggagacagcctnaagaacctattangactaagttgaccagcaagaagccaggacacggcccctagtaattcgcatctataggaatctaagtaaggtaaaaaccacccggacctacgaggactacccagaccctatctcgtacgtcctacctactcgaaacgaaacactacgtccttacctacgaacctactacgtaacgttcgggggacctacggaacgggacggaaagagtacggaacggtcgtagtaacgttaagttaaagttacgggtaaacgggtacccggggtaaacgtaaggtaaacgggttaaggttaaacttaacggtaacggttaggggttacgggtttcggggaaaacggggacggggtaaaccgtaacggtaccgtacggtaaccccgttaccgtaaccggtccgaaccgtaacccgaacggtcccgtaccggtcccccgtacggtcctaccgtttcccg

SEQ ID NO: 395441 - DNA, 558 bp, Homo sapiens
  misc_feature: GZ8MTXP02IN6RE.2.71.G05.1.454.CMB.2.raw
  modified_base (220)..(220): a, c, t, g, unknown or other
  modified_base (240)..(240): a, c, t, g, unknown or other
tcagacgctcgacacacgaccggtgctcgatttagtgtcgtcgcaagagagaggggggctcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaagganacagcctcagaacctattangacaagtgtaccagcagaagcagacagcccctgtaatgcatctatgaatctaatagtaaaaacaccgcctacaggatccagacccgacttctctgcctacctactcgaagaaacacacgtccttcctacgaccatcacgtgggctcgaggacgaagagtgaggctgacttattaagttagtaaacggtccggggtacaaggtaagtaggtaacttaacagttggtggttacggcggtaacgggaccaaaggcgtacgaccggtacctacgtcaacgaacccgaacggctcccgaccccgtcggtacctaacgttcccg

SEQ ID NO: 395442 - DNA, 478 bp, Homo sapiens
  misc_feature: GZ8MTXP01EIBVY.15.37.D04.1.454.CMB.2.raw
  modified_base (275)..(275): a, c, t, g, unknown or other
  modified_base (468)..(468): a, c, t, g, unknown or other
  modified_base (473)..(478): a, c, t, g, unknown or other
tcagtctacgtagccacgaccggtgctcgatttagtagcatactgttgggtttggggggaacaggaagactgatggtccccccaggaactcaggtgctgggcatgatgggcatggggaccatctatcctgctgactctgataccaaatacagcccgtccttccaaggccaggtctccttctcagccgacaggtccatctctaccgcctacctgcagtgggacagcctgaagacctcggacaccgccatgtattactgtgcgactacaggacgtcngagttacgtggggaccagggaaccccaggtcaccgtctcctcacgcctccaccgaagggccccactcccgtccttccccctggccgccctgcccctccgaggcgccaccctccgagcgcacgagccggccctgggctgccctggtcaaggctacctcgactacgtgactgacgcgggctgggccgaagggccnatagnnnnnn

SEQ ID NO: 395443 - DNA, 529 bp, Homo sapiens
  misc_feature: GZ8MTXP01BJNKT.15.37.D04.1.454.CMB.2.raw
  modified_base (274)..(274): a, c, t, g, unknown or other
  modified_base (282)..(282): a, c, t, g, unknown or other
  modified_base (299)..(299): a, c, t, g, unknown or other
  modified_base (362)..(362): a, c, t, g, unknown or other
  modified_base (379)..(379): a, c, t, g, unknown or other
  modified_base (411)..(411): a, c, t, g, unknown or other
  modified_base (506)..(506): a, c, t, g, unknown or other
  modified_base (511)..(529): a, c, t, g, unknown or other
tcagtctacgtagccacgaccggtgctcgatttagtagcatactgttgggtttggggggaacaggaagactgatggtccccccaggaactcaggtgctgggcatgatgggcagtgggggccatctatcctgctgactctgataccaaatacagcccgtccttccaaggccaggtctccttctcagccgacaggtccatctctaccgcctacctgcagtgggacagcctgaagacctcggacaccgccatgtattactgtgcgactacaggactngagtacgnggggccacgggaacccnggtcaccgtctccgtcacgcccctaccaccgaacggccctacgtcccgtccttccccgtgccnccctgccctccggagcnccaccgtaccgagcgcaacgcggccggtccgnggggcctcggcccgtaggtacccaaagggtacccttaccgttaccgacgttacgtaacgcgtacggcggcccgggtagcgggacggaaggcgtanagtgnnnnnnnnnnnnnnnnnnn

SEQ ID NO: 395444 - DNA, 532 bp, Homo sapiens
  misc_feature: GZ8MTXP01EL6B2.44.87.H10.1.454.CMB.2.raw
  modified_base (246)..(246): a, c, t, g, unknown or other
  modified_base (257)..(257): a, c, t, g, unknown or other
  modified_base (348)..(348): a, c, t, g, unknown or other
  modified_base (388)..(388): a, c, t, g, unknown or other
  modified_base (415)..(415): a, c, t, g, unknown or other
  modified_base (454)..(454): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtccacccctggacagccgcctccatctcctgcaagtccagtcagacgcccttcctacttggngataggaaacngctatttgactggtacctgcagaggcaggccagtcctcacggctacctaatgtatgaggtcttccgagtacgggtctcgtggagtcgaccngataggattcgaggtggctaggcgggtcggacagatcganactagaaatcgaaggccgggtggacgngtagggagtagtgttaggtagttagttagttagtatgtntagtgtagtggtcttcgtccgttcgtggtcgttggcgttacggaacgagtaagtaagtacgaacgtaacgttaagtgg

SEQ ID NO: 395445 - DNA, 568 bp, Homo sapiens
  misc_feature: GZ8MTXP01CO5OB.44.87.H10.1.454.CMB.2.raw
  modified_base (350)..(350): a, c, t, g, unknown or other
  modified_base (481)..(481): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtccacccctggacagccgcctcatctcctgcaagtccagtcagacgtcccttcctacgttggtgaagtaggaaaccagtcttaattttgtaaccttgggtaaccctggcaggagggcaaggccagtcctccgacggtctacctaatgtatgagcttcgagacggtntcgtggagtcgaccaagatagacttcgagtggcgaggcgggtacggagtagagttcgaactacgtagaaaatcgaggccgggtaggagcgtaggggaggtagttggttaggtagtttattacgtgtatgtntagtgtgtgtcttcgtccttcggtaggtcgtttcggcgaacgggtaacgtaaaggtaacgaaagtacgaaacgtaacgttgtaacgg

SEQ ID NO: 395446 - DNA, 578 bp, Homo sapiens
  misc_feature: GZ8MTXP01BC5E3.44.87.H10.1.454.CMB.2.raw
  modified_base (253)..(253): a, c, t, g, unknown or other
tcagacagtatatacacgaccggtgctcgatttagcagtactgcgttgggtttggggactgatcaggacttctcagttcatcttctcaccatgaggctccctgctcagctcctggggctgctaatgctctggatccctggatccagtgcggatattgtgatgtcccagactccactctctctgtcagtcaccctggacagccgctcatctcctgcaagtccagtcagacgcctcctacttggtgatggaaacngtctatttgtactggtacctgcaggaggcaggccagtctccacggctacctaatgtatggacggtcccttccgagacgggtctcgtgggagtgccaagatagattcaggtggcaggcgggtcgggacaggtgttacacgactagaaaacgtcgacggccggggtggaggggcgttaggaggtagttggttaggtagttttaagttagtgtagtgctaagtggtagttgggtccttcggtcccgttcgttcgggttcggttttacgggaacccgtaaacggggtaaccgtaaagggtaacgaaaacgtaacgttaaaaccgtaagg

SEQ ID NO: 395447 - DNA, 623 bp, Homo sapiens
  misc_feature: GZ8MTXP01ELOF2.44.87.H10.1.454.CMB.2.raw
  modified_base (199)..(199): a, c, t, g, unknown or other
  modified_base (232)..(232): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagacctccactctctctgtcagtccacccctggacngccgcctccatctcctgcaagtccagtcagacnggtcctcgtactaggtggaatggaaactagtcgtaactttggtaacctgggtaccctaggcgacgaggggccagggtcccagtacgtccctacggacttccgtaaatgtaacgtcgtacgacgtttcccccgagtacggggttcgtactgggaaacgttaggccctaaggtaattacgaagtttccgaaggttggggccggacggacgggtaccggggaacgtacgaagttacgaacgaaacttcggaaaagtccggagaccgggtggaagggcggtaggtaggggtagtaggtttaggtagtttagttaactgtatagtgtatggtaatggctcggttcgtcgtggacgttggaccaagggtacaagtagaaagttacgtaacgaacgtg

SEQ ID NO: 395448 - DNA, 549 bp, Homo sapiens
  misc_feature: GZ8MTXP01AJ9HV.44.87.H10.1.454.CMB.2.raw
  modified_base (246)..(246): a, c, t, g, unknown or other
  modified_base (256)..(256): a, c, t, g, unknown or other
  modified_base (294)..(294): a, c, t, g, unknown or other
tcagacagtatatacacgaccggtgctcgatttagcagtactgcgttgggtttggggactgatcaggacttctcagttcatcttctcaccatgaggctccctgctcagctcctggggctgctaatgctctggatccctggatccagtgcggatattgtgatgtcccagactccactctctctgtcagtcacccctggacagccgcctccatctcctgcaagtccagtcagacgcctcctacttggngatggaaacngctatttgtactggtacctgcagaggcaggccagtccnccacggctcctaatgtatgacggtcccttccgaggacgggtctcgtagggagtgaccagatagattcgagtggcgaggcgggtacggacaggacgttacacactagaaaactcgacggccgggtaggacggggtcgtagggaggtagttggttaggtagtttagttacgtgtatgtatgtggtagttggtcttcgttccgtcggttggttcgtttggaacgaagggaaccgaaggtagaactaacgaacgtaacg

SEQ ID NO: 395449 - DNA, 599 bp, Homo sapiens
  misc_feature: GZ8MTXP01CYVXW.44.87.H10.1.454.CMB.2.raw
  modified_base (258)..(258): a, c, t, g, unknown or other
  modified_base (342)..(342): a, c, t, g, unknown or other
  modified_base (400)..(400): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtccacccctggacagccgcctccatctcctgcaagtccaagtcagacgtcctcctacgttggtgataggaaacngtcttatttgtactggtacctgcaggaggcaggccagtcctaccgacggtctacttaagtgtatgaggattccgagtacgggtntcgtggagtgaccaagatagattcgagggtcgggacgacgggcggggtacccgggaanacggtagttaccaaacgaacttaaggaaaactcggaacgggtccgggagggaaggtcgtaggggaaggtagttgggttaggtaagtttagttagtagtagtgtatagtggtatcggtcttcggtccgttcggttggtacgtttaggaccgaagggtaaccaaagggttaagaaactacgaaaacgtaacgttggtaagg

SEQ ID NO: 395450 - DNA, 543 bp, Homo sapiens
  misc_feature: GZ8MTXP01E1OPY.44.87.H10.1.454.CMB.2.raw
  modified_base (256)..(256): a, c, t, g, unknown or other
  modified_base (459)..(459): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtccacccctggacagccgcctccatatcctgcaagtccagtcagacgccctcctacttggtgataggaaacngctatttgactggtacctgcagaggcaggccagtctaccgacggctacctaatgtatggaggtcttccgaggtaccggggtctcgtgggagtcgaccaagatagattcgaggtggcaggcgggtcgacagagtcacacgtagaaaatcgaaggccgggtaggaggcgtaggggaggtagtggttaggtatttatagtgtatgntagtggtatggcttcgtccgttcggtggtacgttcggccgaaggtaacgaaggtaacgaaatacgaaacgtaacgttgtaacgg

SEQ ID NO: 395451 - DNA, 644 bp, Homo sapiens
  misc_feature: GZ8MTXP01DYGAT.44.87.H10.1.454.CMB.2.raw
  modified_base (202)..(202): a, c, t, g, unknown or other
  modified_base (253)..(253): a, c, t, g, unknown or other
  modified_base (264)..(264): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggactccctggatccagtgcggatattgtgatcgtcccagacctccacttctctctgtcagtccacccctggacncgccgcctcatctcctgacaagtccagtcagacgcccttctacgttggtanagtaggaaacngtcttagtttcgactggtacctgcgaggacggcacggcctaggtcctaccgacggtccttacccgttaaagttcggtaatcggacggtccctttaccgaacgggtccggtctcgtggacgtcgacctaaggactagtacttcgaggtggacgtagggccgggtacggactaggtacgttacaacgtacgtaaagaaacgtcggaagggtccgggtagggaacggtcgtagggggaaggtagtttggtttaaggtagttttaagtagtgttaatcgtagtagttggtagtcggtccgttcggttccgttcggtacggtacgtttcggacgttaaacggaaccgtaaaggtaacgaaaactcgaaacgtaacgttggtaacg

SEQ ID NO: 395452 - DNA, 796 bp, Homo sapiens
  misc_feature: GZ8MTXP01AL68S.44.87.H10.1.454.CMB.2.raw
  modified_base (256)..(256): a, c, t, g, unknown or other
tcagacagtatataccacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtccacccctggacagcccgcctcatctcctgcaagtccagtcagacgccctctacttggtgataggaaacngtcttatttgactggtacctgcaggaggcaggccagtcctccacggtctcctaaatgtactgacggtcttccgaagggtccggggtctcgtagggacgtcgaccctaaggtactaggtaactttcgaagggttcgggcgtaaacggggtcccgggggttaccggggaaacacgggtaacgtttaccaaccgtaaaccgttaaaggaaaaaacgttccgggaaacggggtccccgggggttaggggaaagggttccggttagggggtaaacgggggttaagttttggggtttaagggtttaaacggtttttaacgttaaacgtttggtttaaacgttcggtacgttaagggtttacgggtttaaggtcggggttcccgtttcccgggtttaccccgggtttcccggggtttaacgggggttaacccgggtttttacgggggaaacccccgttaaaacggggggtaaccccgtaaaaggggtttaaaccggaaaaacgtttaacccgggaaaaacccgtaaacggttgggtttaacccgggg

SEQ ID NO: 395453 - DNA, 820 bp, Homo sapiens
  misc_feature: GZ8MTXP01CAA8Q.44.87.H10.1.454.CMB.2.raw
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatcgtcccagacctccactctctctgtcagtccacccctggacacgcccgcctccatctcctgcaagtccagtcagacgcccttacctacgttggtagataggaaacagtacttatttacgtactggtaccctgacgaggacgggcaacggcctacgtcctaccgacggtacctacttaagtgtatagacggtccttaccgacggtaccggggttctacggtggtacgtacgaccgaagtaagtaacgtacgtttacggagggttacgggacggtaacggggtcccggggttaccggggaacggtaacggtacgttaaccgtaaacgtaaaccgtaaggtaaaaacttcgggaacgggtacccgggggtagggtaacgggtccggttaagggggtaaggggtttaaggtttgggttttaaacgggggtttaattttttaaccggttaaacgtttaggtttaaacggttcgtaacggttaaggtttcgggttaagggttcgggtttacccggtttccgggtttaccccggttccggggttacggggtttaacccgggttttaaccgggggaacccggttaaaacgggggtaaaccccgtaaaagggggttaaaacgtaaaaacgtaaacgggttaaaaacccgttaaggttaacggttaaccggg

SEQ ID NO: 395454 - DNA, 694 bp, Homo sapiens
  misc_feature: GZ8MTXP01CIWW5.44.87.H10.1.454.CMB.2.raw
  modified_base (265)..(265): a, c, t, g, unknown or other
  modified_base (359)..(359): a, c, t, g, unknown or other
  modified_base (368)..(368): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagacctccactctctctgtcagtccaccccgtggacacgcccgcctcatcctcctgacaagtccagtcagacgtcccttcctagttggtgaagtaggaaacngtacttagtttagtactggtacctgacaggaggcacggccacgtcctccgacggtctactaagtcgtatcgagtccttacgacggtcggtctgnggatcgacngatagattcgaggtcgggacgacggggccggggtacggagtacggtacgttaccgaacgtaacgtaacggtaaacgtaccgggacggggtaccggggtagggaacgggtcggttaagggggtaaggggttaaggtttcgggttaagggtttaagttttaacgtaacgttggttaagtggtagttaaggttgggttacgtcggggttcccttccggttcccggttcgggtaccgggttacgggtttaaccgggaccggaaaaccggggtaacgtaaaagggtaaacgtaaacggttaaccgaaaacggtaacggttaaggtaaccgg

SEQ ID NO: 395455 - DNA, 631 bp, Homo sapiens
  misc_feature: GZ8MTXP01C1P0O.44.87.H10.1.454.CMB.2.raw
  modified_base (261)..(261): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatcgtcccagacctccactctctctgtcagtccacccctggacagcccgcctcatcctcctgcaagtccagtcagacgtcccttcctacttggtgataggaaacngtcttattgtactggtacctgcaggaggcacggccagtcctcgacggtctacctaatgtagtcggtacgtcttaccgacggtaccggtctcgtgggtacgtcgacctaagtactagtagttacgaggtacggacgacgggaccggggtccgggaacgacggtacgttacaacgtaacgtaagtaaacgtcgaacgggccgggtagggaggtacgtaggggtaaggtagttggttaggttatttacgttagttagtagtgtatagtggtagtcggtcgttcgttcccgttcggttaggtccggtttacgggaccgttaaaagggtaaccgtaaaggtaacgtaaacgtacgaaacgtaacgttggtaacgg

SEQ ID NO: 395456 - DNA, 743 bp, Homo sapiens
  misc_feature: GZ8MTXP01CO9LK.44.87.H10.1.454.CMB.2.raw
  modified_base (199)..(199): a, c, t, g, unknown or other
  modified_base (229)..(229): a, c, t, g, unknown or other
  modified_base (241)..(241): a, c, t, g, unknown or other
  modified_base (243)..(243): a, c, t, g, unknown or other
  modified_base (250)..(250): a, c, t, g, unknown or other
  modified_base (273)..(273): a, c, t, g, unknown or other
tcagacagtatatacacgaccggtgctcgatttagcagtactgcgttgggtttggggactgatcaggacttctcagttcatcttctcaccatgaggctccctgctcagctcctggggctgctaatgctctggatccctggatccagtgcggatattgtgatgtcccagactccactctctctgtcagtcaccctggacngccgcctcatctcctgcaagtccagtcagngcctctattggnanggaaacngctattgactggtacctgcaggnggcaggccagtctaccgacggtctaccgtaatcgtaatcgtaaggtccccttccgaagggtaccggggttcctaccggttagggggaacgttcggaccctaaagggtacttaagggtactttacgaaaggggttcgggaccggtacgggtaccggggtacccggggtaacgaaggtacgttaaccgaaccgtaaaccgttaaggtaaaaacgttcgaacgggtacccggggtacgggtagggggtaaccgttaggggtaacgggtaagttaggggtttaacgggttaaggtttttaaagtttaccgttaggttaaccgttcgggtacgttaaggttaagggtaagttcgggtaccgttcccgggttccccgtttcgggttacggggttccggtttaccggggaacccggtaacggggtaaccccggtaaaggggtaaggttaaaaccgttaaccgaaaaccggtaacggg

SEQ ID NO: 395457 - DNA, 610 bp, Homo sapiens
  misc_feature: GZ8MTXP01AWLS9.44.87.H10.1.454.CMB.2.raw
  modified_base (244)..(244): a, c, t, g, unknown or other
  modified_base (255)..(255): a, c, t, g, unknown or other
  modified_base (296)..(296): a, c, t, g, unknown or other
  modified_base (341)..(341): a, c, t, g, unknown or other
  modified_base (353)..(353): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtccacccctggacacgcccgcctcatctcctgacatccagtcagacgtcctctagttggngataggaaacngtcttatttcgtactcggtactgcgagaggcagccagtccnccgacggtctactaagtcgtagtgacgtctacgacggtacggtcncgtggagtcacngtatgattcgaggtcggacgacggtcggggtaccggagtaggacgttacaacgtaacgaacggtaaaagtccggacgggtacgggtaggaggtacggaggggtaggtaggttagttacggttaagtttacgtagtagtagtgtacgtagttggtcgtcggtccgttcggtcccgttacgggttaggtccggttacggacgttaacgggtaacgtaaacggtaagtaaacgtacggttaaaaccgtgttcggtaaccg

SEQ ID NO: 395458 - DNA, 667 bp, Homo sapiens
  misc_feature: GZ8MTXP01EXZEU.44.87.H10.1.454.CMB.2.raw
  modified_base (231)..(231): a, c, t, g, unknown or other
  modified_base (257)..(257): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagacctccactctctctgtcagtccacccctggacagccgcctcatcctctgcaagtccagtcagacncccttcctacgttggtgatggaaacngctatttgactggtacctgcaggaggcaggccagtctccacggctacctaatgtatgacggtcttccgaaggtccgggttctcgtagggacgtcgacctaaggtaattagggatttccgagggttcgggacgtacgggtccggggtaccgggaacaaggtagttaccaacgtaacgtaagtaaaacgtccgaagggccggggtaggaagggtcgtagggggtaaggggtaagtttggggtttacggttaaggttttaactttacgttaggttacgtagtgtaaagttgggttaatcggggtcctttccggtacccgttaccgggttcggggttaacggtttacgggacccgttaaaacggggtaaccgtaaaggtaaacgtaaagtaccgaaaacgtaacgttaagtcgg

SEQ ID NO: 395459 - DNA, 756 bp, Homo sapiens
  misc_feature: GZ8MTXP01BH9DF.44.87.H10.1.454.CMB.2.raw
  modified_base (271)..(271): a, c, t, g, unknown or other
tcagacagtatatacacgaccggtgctcgatttagcagtactgcgttgggtttgggggatcaggacttctcagttcatcttctcaccatgaggctccctgctcagctccgtggggctgctaatgctctggatccctggatccagtgcggatattgtgatcgtcccagacctccactctctctgtcacgtccaccccgtggaccacggcccgcctccatcctcctgaccaacgtccagtcagactcctcctagtggtacgagtacggaaacntacttagtttcgtaacgtcggtacctgacgagggacggcgacggtccacgtcctaccgacggtcttaccgtaagtcgtactggacgtccgttaccgacggttacggtctaggtcggacgtcgactaagtagtacgtaacgttccggtaaggtcgggacgggtaccggggtaccgggggtaccggaacgtaggttacgttaccgaaacgtaaccgtaacgggtaaaacgtcgggacgggtccggggtaggacgggtaggtagggggtaagggttggtttaggtttagggttaattttaggtagtttaggtagttacgtcgtaaaggttggttaacggtcggtttccgttccgggttaacccggtttccggggtacgggtttaccgggtttaaccggggaaaccggggttaacgggttaaaacccggtaaagggttaaaacgtaaaccgggttaaccgaaaaaccggttgggttaacgggttcccgg

SEQ ID NO: 395460 - DNA, 622 bp, Homo sapiens
  misc_feature: GZ8MTXP01B7MC6.44.87.H10.1.454.CMB.2.raw
  modified_base (253)..(253): a, c, t, g, unknown or other
  modified_base (264)..(264): a, c, t, g, unknown or other
tcagacagtatatacacgaccggtgctcgatttagcagtactgcgttgggtttgggggatcaggacttctcagttcatcttctcaccatgaggctccctgctcagctccgtggggctgctaatgctctggatccctggatccagtgcggatattgtgatgtcccagacctccactctctctgtcagtccacccctggacacgcccgcctcatactcctgacaagtccagtccagacgcccttactacgttggngataggaaacngtcttatttgtactggtacctgcgagaggcacggccagtcctaccgacggcttaccgtaatgtatcgacggtccttaccgacggtaccgggtctcgtagggcgtacgaccgaaggtactagtactttacgaggtcgggacgacgggtcccggggtacggacgtaggtacgttccaacgtaccgtaagaaacgtccggagggccgggtaggaacggtcgtaggggtaaggtagttaggttaggttaagtttacgttagtgttaagtgtacgtagtgtagtcggtcttcgtaccgttcggtaggtcgttacggaccgaaggtaaccgaaggtaacaaactagaaaccgtaagttgtaacg

SEQ ID NO: 395461 - DNA, 660 bp, Homo sapiens
  misc_feature: GZ8MTXP01D80VT.44.87.H10.1.454.CMB.2.raw
  modified_base (204)..(204): a, c, t, g, unknown or other
  modified_base (220)..(220): a, c, t, g, unknown or other
  modified_base (253)..(253): a, c, t, g, unknown or other
  modified_base (264)..(264): a, c, t, g, unknown or other
tcagacagtatatacacgaccggtgctcgatttagcagtactgcgttggggtttggggactgatcaggacttctcagttcatcttctcaccatgaggctccctgctcagctccgtggggctgctaatgctctggatccctggatccagtgcggatattgtgatgtccccagacctccactctctctgtcagtccaccctggacncgccgcctcatcctcngcaagtccagtcagacgtcctcctacgtggtanagtaggaaacngtcttaatttgactcggtacctggcaaggacggcacggcccaagtcctaccgacggtacttacctagtgtagtggacgtcccttccgaggtacgggtctcggtagggatcgacagaagtagtattcggagggtcggcgtacgggtaccgggtaccggatacggtacgttaccaacgtaacgtaaggtaaaacgccggtacggggaccggggttagggacggggtacggtaggggtaacggttaggttcgggtttaaggttaagtttaagttacgttggttacgtgtacgtggttggttacgttcgggtccttcggtacccggttcggttacgggttccgttacgggaacccgtaaagggtaaccgtaaaggggtacaaacgtaacgaaacgtaagg

SEQ ID NO: 395462 - DNA, 544 bp, Homo sapiens
  misc_feature: GZ8MTXP02IOCIQ.44.87.H10.1.454.CMB.2.raw
  modified_base (242)..(242): a, c, t, g, unknown or other
  modified_base (251)..(251): a, c, t, g, unknown or other
  modified_base (275)..(275): a, c, t, g, unknown or other
  modified_base (447)..(447): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccgcctccatctcctgcaagtccagtcagagcctcctattggtnatggaaacngctatttgtactggtacctgcagnggcaggcagtctcacgctctatgtatgagctccagacgggtctcgtggagtgccaggatagattcgagtggcaggcgggtcggacgagagtcaacacgtagaaaatcgaggccgggtggaggtcgtaggaagggtagttggttagggttaagtttagttacgttaggtatgngtagtggtatcggtcgttcgtccgttcggtcggtacgtttcggacgtaaacgggaacgtaaacggtaagaaacgtacgaaaacgtacgtaggtacgg

SEQ ID NO: 395463 - DNA, 637 bp, Homo sapiens
  misc_feature: GZ8MTXP02J3U2S.44.87.H10.1.454.CMB.2.raw
  modified_base (248)..(248): a, c, t, g, unknown or other
  modified_base (257)..(257): a, c, t, g, unknown or other
  modified_base (276)..(276): a, c, t, g, unknown or other
tcagacagtatatacacgaccggtgctcgatttagcagtactgcgttgggtttggggactgatcaggacttctcagttcatcttctcaccatgaggctccctgctcagctcctggggctgctaatgctctggatccctggatccagtgcggatattgtgatgtcccagactccactctctctgtcagtccacccctggacagccggcctccatctcctgcaagtccagtcagacgccctctactggtnatggaaacngtctatttgactggtaccngcaggaggcaggccagtctccagctactaatgtatgacgtcctccgagaccgggtctcgtgggagtcgaccgaagtatagtattcgagggtcggacgacgggtccgggtacccgggaacaggtacgttacgaactaaccgttagaaaacgttcgaacgggtcccgggggttaggaacgggtcgtagggtagggtaagtttgggtttaggttaaggttttacttaacgttaggttaagttgacgttaagttgggtacgtcggtccgttccggttacccgtcggttacgggttaccggtttacgggaaccggtaaacgggtaaccgtaaaggttaaacgaaacttaaccggaaaacgtaacgg

SEQ ID NO: 395464 - DNA, 554 bp, Homo sapiens
  misc_feature: GZ8MTXP02HW7D7.44.87.H10.1.454.CMB.2.raw
  modified_base (240)..(240): a, c, t, g, unknown or other
  modified_base (286)..(286): a, c, t, g, unknown or other
  modified_base (303)..(303): a, c, t, g, unknown or other
  modified_base (333)..(333): a, c, t, g, unknown or other
  modified_base (365)..(365): a, c, t, g, unknown or other
  modified_base (410)..(410): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccgcctccatctcctgcaagtccagtcagagcctctatggtnatggaaacagctatttgactggtacctgcagaggcaggccagtccncacggctcctaatgtangaggcttccgagacggtctcgtggatcgcngatagattcgagtggctaggcgggtaccgganagacgtacactacgtagaaaactcgaaggtccggggaggaacggngtaggaggtagttaggttaggtagtttaagttagtagttaagtggataagtggtatcggacttcgtccgtcggtcggtacgtttcggaccgaaagggaaccgtaaagggtaaacgtaaaagtacgaaaacggtacgttagggcg

SEQ ID NO: 395465 - DNA, 637 bp, Homo sapiens
  misc_feature: GZ8MTXP02GEPNG.44.87.H10.1.454.CMB.2.raw
  modified_base (251)..(251): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccgcctccatctcctgcaagtccagtcagagcctctacttggtgatggaaacngctatttgactggtacctgcaggaggcaggccagtctccacggctctaatgtatgagcttcgagacggtctcgtggagtcgccaggtataggattcgaggtcggacgacgggccggggtccgggacgaggtaacgttacaacgtaacgtagaaaaacgtcgaacgggcccggggtagggacgggcgtaggagggtagttgggttagggtagtttaagttacgttagtaagtggtacgtaagtgggttagtcgggtccttccgggttcccgttccgggttacgggttaccgggttttacggggaacccggtaaaacgggggtaacccgtaaaagggttaaacggtaaaacgttaaccggaaaaaccggtaaccgttaggttaacggg

SEQ ID NO: 395466 - DNA, 575 bp, Homo sapiens
  misc_feature: GZ8MTXP02JRMOW.44.87.H10.1.454.CMB.2.raw
  modified_base (254)..(254): a, c, t, g, unknown or other
  modified_base (293)..(293): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccggcctccatctcctgcaagtccagtcagacgcctcctacttggtgatggaaacngctatttgtactggtacctgcaggaggcaggccagtccnccgacggctacctaatgtatgaggcttccgagacgggtctcgtggagtgccagatagattcgagtgcgaggcgggtccggacgagagtcaacgactagaaaactcgacggccggggtaggacggcgtaggaggtagttagggttagggttaagtttagttagtaggttagtgtcgtagtggtacgttcggcgttccgtccgtcggttacgggtacggtttcggaccgtaaaggggaaccgtaaagggtaacgaaaacgtacgaaaacggtacgtaggtacgg

SEQ ID NO: 395467 - DNA, 629 bp, Homo sapiens
  misc_feature: GZ8MTXP02JUT0C.44.87.H10.1.454.CMB.2.raw
  modified_base (256)..(256): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtccacccctggacagccgcctccatctcctgcaagtccagtcagacgccctcctacgttggtgatggaaacngtcttatttgtactggtacctgcgaggacggcaggccagtcctccgacgctctaatgtatgagcttcgagtacggtctcgtggagtcgaccagtatagtactttcgaggtggcagggccggggtaccggagagacgttcaacgtacgtagaaaacgtcgaacgggtccggggtagggacgggcgtagggaggtagttagggttagggttagttttaagttacgtgtagtgacgtagtaggtacgtcggtcgttccggttccgttaccgggttacgggttaccggtttacgggaacccggtaaaacgggggtaacccgtaaaaggggttaaaacgtaaaacgtaaaccggtaaaacggtaaccgttggtaacgg

SEQ ID NO: 395468 - DNA, 623 bp, Homo sapiens
  misc_feature: GZ8MTXP02IU9S1.44.87.H10.1.454.CMB.2.raw
  modified_base (248)..(248): a, c, t, g, unknown or other
  modified_base (258)..(258): a, c, t, g, unknown or other
  modified_base (299)..(299): a, c, t, g, unknown or other
tcagacagtatatacacgaccggtgctcgatttagcagtactgcgttgggtttggggactgatcaggacttctcagttcatcttctcaccatgaggctccctgctcagctcctggggctgctaatgctctggatccctggatccagtgcggatattgtgatgtcccagactccactctctctgtcagtcacccctggacagccgcctccatctcctgcaacgtccagtcagacgccctctacttggtnataggaaacngtcttatttgactcggtacctgcaggaggcacggccagtcnccgacggccttactaatgtatgacggtcccttaccgagtacgggtctcgttggagtcgacctagatagattcgagggtcggacgacggccggggtaccgggacgaggtacgttacaaccgtaacgtaacgaaaacgtcgaagggccgggggttaggacgggtcgtaggagggttagttagggttaggttagttttaagttacgtaggttataggtataggttaggttacgttggtccgttcgttccgttcgggttacggttaccggtttaggaacccggaaggtaaccgtaaaggttaacgaaacgttaacgaaaacgttacgg

SEQ ID NO: 395469 - DNA, 513 bp, Homo sapiens
  misc_feature: GZ8MTXP02GHVZH.44.87.H10.1.454.CMB.2.raw
  modified_base (241)..(241): a, c, t, g, unknown or other
  modified_base (443)..(443): a, c, t, g, unknown or other
  modified_base (491)..(491): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccgctccatctcctgcaagtccagtcagagcctctacttggtnatggaaacagctatttgactggtacctgcagaggcaggccagtctccacggctcctaatgtatgaggtcttccgaggaccgggtctcgtgggatgccagataggattcgagtggacaggcgggtcggacagagttcacactagaaaatcgaagccggggtggaggcgtggaggtatggttaggtagtttattagtagtatgnatgtatggctcgtctcgtggacgtttggcgaaggaaccgaaaggtaanaaactacaaaacgaactgtacg

SEQ ID NO: 395470 - DNA, 557 bp, Homo sapiens
  misc_feature: GZ8MTXP02GBZC5.44.87.H10.1.454.CMB.2.raw
  modified_base (345)..(345): a, c, t, g, unknown or other
  modified_base (352)..(352): a, c, t, g, unknown or other
  modified_base (459)..(459): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccggcctccatctcctgcaagtccagtcagacgccctcctacttggtgatggaaacagtctatttgtactggtacctgcagaggcaggccagtctccacggctcctaatgtatgaggcttccgagtacgggtctcgtggagtcgccngataggnttcgagtggcaggcggggtccggacagacgttcacactagaaaactcgaacggccggggtaggaggcgtaggaggtagtggttaggtagtttagttacgtgtagtgntagtggttagtcggtcgttccgtcgttccggtcggtacggtttcggaccgtaaggggaaccgaaggtaacgaaactacggaaacgtaacgtggtacgg

SEQ ID NO: 395471 - DNA, 518 bp, Homo sapiens
  misc_feature: GZ8MTXP02FR9HY.44.87.H10.1.454.CMB.2.raw
  modified_base (244)..(244): a, c, t, g, unknown or other
  modified_base (253)..(253): a, c, t, g, unknown or other
  modified_base (445)..(445): a, c, t, g, unknown or other
tcagacagtatatacacgaccggtgctcgatttagcagtactgcgttgggtttggggactgatcaggacttctcagttcatcttctcaccatgaggctccctgctcagctcctggggctgctaatgctctggatccctggatccagtgcggatattgtgatgtcccagactccactctctctgtcagtccaccctggacagccgctccatctcctgcaagtccagtcagagccctctacttggnatggaaacngctatttgactggtacctgcaggaggcaggccagtctccacggctcctaatgtatgagccttccaggacggtctcgtggatggccaggatagattcgaggtggcgaggcgggtcggacagagttacacatagaaactcgaggccgggtaggaggcgtagaggtagtgttaggtagtttattatagtatagtnagtgtagtggctcgtccgtcgtcgtacgttcggaacgaacggaccgaaggtaagaaacgtacgaaacgtaacg

SEQ ID NO: 395472 - DNA, 647 bp, Homo sapiens
  misc_feature: GZ8MTXP02GYJOO.44.87.H10.1.454.CMB.2.raw
  modified_base (255)..(255): a, c, t, g, unknown or other
  modified_base (557)..(557): a, c, t, g, unknown or other
  modified_base (627)..(627): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccgcctccatctctgcaagtccagtcagacgcctcctacttggtgagtacggaaacngtacttagtttacgtacgtaccggtaccgtgaccgaagggacggacgacggccgtaacgtcccaccggaccggtccctaaccgttaagtgtacgtaggaccgtccttaccgacgggtaccggtctggtacggagtccgacgagtaagtagtacgttagagggtgacgacgggggtcccgggtacggaataggtacttaccgaaaccgtagtaaacgaaacgttcgggaacgggtccgggggtagaacgggcttaagggggaagttggttagggttagggtttaatttacgtagttagagtgnttaagtgtagtcgtcttccgtcgtcggaggttcgttacggacggtaaggaacgtaaggtaacgtaaaacncgtaaaacgtggtcgtacgg

SEQ ID NO: 395473 - DNA, 599 bp, Homo sapiens
  misc_feature: GZ8MTXP02F921P.44.87.H10.1.454.CMB.2.raw
  modified_base (251)..(251): a, c, t, g, unknown or other
  modified_base (262)..(262): a, c, t, g, unknown or other
tcagacagtatatacacgaccggtgctcgatttagcagtactgcgttgggtttggggactgatcaggacttctcagttcatcttctcaccatgaggctccctgctcagctcctggggctgctaatgctctggatccctggatccagtgcggatattgtgatgtcccagacctccactctctctgtcagtccacccctggacacgccgcctccatcctcctgcaagtccagtcagacgccctcctacttggngataggaaacngtcttatttgtactggtacctgcaggaggcaggccagtcctccgacggctacctaatgtatgacggtccttaccgaggtacggtctcgtggagtcgccaagatagattacgaggtggacgaggcggggtaccgggaactaggacgttacacgactaagaaaacgtacgacgggccggggtaggaggtacgtggaggtagtaggttaggtagtttagttagtgtatgtagtagttggtagtcggtccgttccggttccgttcggttacggtacggtttacgggaaccgtaaacggggaaccgtaaacggtaagtaaaacgtaaccgaaacgtaaacgg

SEQ ID NO: 395474 - DNA, 563 bp, Homo sapiens
  misc_feature: GZ8MTXP02IQKMK.44.87.H10.1.454.CMB.2.raw
  modified_base (242)..(242): a, c, t, g, unknown or other
  modified_base (251)..(251): a, c, t, g, unknown or other
  modified_base (306)..(306): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccgcctcatctcctgcaagtccagtcagagcctcctacttggtnatggaaacngctatttgactggtacctgcagaggcaggccagtctccgacggctcctaatgtangaggcttcaggtacgggtctcgtggagtgccagataggattcagtggactaggccgggtccggacagacgttcacactagaaaactcgaaggccgggtggaaggcgtaggaggtagtggtttagggtaagtttagttaacgttggtaatggtactagtaggtagtcggtcttccggtccgttccggtacggttacggtttcggacccgaagggaaccgtaaaggtaagaaaactacgaaaacgtaacgtttcggacg

SEQ ID NO: 395475 - DNA, 543 bp, Homo sapiens
  misc_feature: GZ8MTXP02HO30O.44.87.H10.1.454.CMB.2.raw
  modified_base (242)..(242): a, c, t, g, unknown or other
  modified_base (251)..(251): a, c, t, g, unknown or other
  modified_base (379)..(379): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccgcctccatctctgcaagtccagtcagacgcctcctacttggnatggaaacngctatttgtactggtacctgcaggaggcaggccagtctccgacgctcctaatgtatgagcttccgagtacgggtctcgtggagtcgaccaggtactagattccgagtcggacgaggcggggtccgganagtagttcacactagaaatcgaggccgggtgaggctaggaggtagtggttaggtatttagttacgtgtagtgatagtgtagtcggtcgttcgtccgtcggtggtacgtttcggaccgtaaggaaccgtaaggtaacgtaaactacgaaaacgtacgttgtacgg

SEQ ID NO: 395476 - DNA, 533 bp, Homo sapiens
  misc_feature: GZ8MTXP02G5RLC.44.87.H10.1.454.CMB.2.raw
  modified_base (247)..(247): a, c, t, g, unknown or other
  modified_base (256)..(256): a, c, t, g, unknown or other
  modified_base (309)..(309): a, c, t, g, unknown or other
  modified_base (439)..(439): a, c, t, g, unknown or other
tcagacagtatatacacgaccggtgctcgatttagcagtactgcgttgggtttggggactgatcaggacttctcagttcatcttctcaccatgaggctccctgctcagctcctggggctgctaatgctctggatccctggatccagtgcggatattgtgatgtcccagactccactctctctgtcagtcacccctggacagccgcctccatctcctgcaagtccagtcagagccctcctacttggtnatggaaacngctatttgtactggtacctgcagaggcaggccagtctccacgctctaatgtangagccttaccgagacgggtctcgtggagtcgacagatagattcgagtgcaggcgggtcggacagagttcacactagaaaatcgagccgggtggaggcgtagaggagtgttagtagtttatacgtgtatgntagtggtagtggcgttcgtccgtcggtacggtacggtttacgggaaccgtaaacgggaccgtaaacggtaagaaaacgttacgaaaacgtaaag

SEQ ID NO: 395477 - DNA, 753 bp, Homo sapiens
  misc_feature: GZ8MTXP02I05H8.44.87.H10.1.454.CMB.2.raw
  modified_base (200)..(200): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagacctccacttctctctgtcagtccacccctggacngccgcctccatctcctgcaagtccagtcagacgcccttacctacgttggtgaataggaaactagtcttagtttcgtacgtggtacctgcgaggagggcgaggcctaggtcctcccgacggtccttacctaagtgttacgtggtaccggtcctttaccggaagggtacccggggtcttcggtagggtacgttccggaacctagggtacttaaggtaacttccgaaggggtcgggaccgggtaacgggtcccgggggtacgggacgtaggtacgttaccaacgtaactaacggaaaacgttccggagggggtaccgggggtaggtacggtcggttaagggacggggtttagtttaggggttagggtttaaacgttttagttacgtttaggtagttacggtagtaggtttaggggttacgttcgggtccgtttcccgggttccggttacgggttcggggttaaccggggtttaccgggaaaccgggtaagggtaaacccggtaaaacgggtaaagtaaaaacggtaaccggtaaaaccggtacgttaacggtcggg

SEQ ID NO: 395478 - DNA, 668 bp, Homo sapiens
  misc_feature: GZ8MTXP02IU5U1.44.87.H10.1.454.CMB.2.raw
  modified_base (252)..(252): a, c, t, g, unknown or other
  modified_base (263)..(263): a, c, t, g, unknown or other
tcagacagtatatacacgaccggtgctcgatttagcagtactgcgttgggtttggggactgatcaggacttctcagttcatcttctcaccatgaggctccctgctcagctcctggggctgctaatgctctggatccctggatccagtgcggatattgtgatgtcccagactccactctctctgtcagtccaccccgtggaccacgcccggcctccatctcctgcaagtccagtcagacgcctcctacttggngataggaaacngtctattgactcggtacctgcgaggcggcacggccagtcctaccgacggtctacctaagtgtagtcggagtccccttacgaagtccgggtactcggtggtacgtcggaccgtaagtaagtacgtaacgttcgagggttacgggcgtacggggccggggtacccggaatacggtacgttaccaacgtaacgtaaacgtaaacgtccggaacggggtaccggggtggaacgggtacgtagggaaggttaggtttcggttaaggttagttttaagtagtagttagtagtagtaggttaggtacggttcggcccgtttacggttcccgttacggggtacgttacggtttaccgggaacccgtaaaggggtaaccgtaaaggtaagtaaacctaacggtaaacggtacgg

SEQ ID NO: 395479 - DNA, 731 bp, Homo sapiens
  misc_feature: GZ8MTXP02HCO0Z.44.87.H10.1.454.CMB.2.raw
  modified_base (178)..(178): a, c, t, g, unknown or other
  modified_base (241)..(241): a, c, t, g, unknown or other
  modified_base (252)..(252): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctntgtcagtcacccctggacagccgctcatctcctgcaagtccagtcagacgtcctctacttggngataggaaacngtcttatttcgtactcggtacctgacaaggtacgggcacgggcctacggtcctccgaacggcttacccgtaaatggtactggtacggtcttaccgacggtacggggttctcgtgggactcggacctagacttagactttcgaggtcggacgtagggtaccggggtacggactaggtacgttacgaacccgtagttaacggaaaacgttcggaaacgggttcccgggggagggtacgggtaccggttagggaagggttaagttcggggtttagggttaaaccggttttacgttaacggttagggttaacgttggtaaccggttaagtttcgggggttaacgttacgggttaccgtttccgggttccgtttaccggggttacggggttaccggtttaccgggaaccggtaaaacggggtaaccggtaaaaagggttaacgaaaaacgtaaaccggtaaaaccggtaaaggtcggttaacgg

SEQ ID NO: 395480 - DNA, 606 bp, Homo sapiens
  misc_feature: GZ8MTXP02F8X5V.44.87.H10.1.454.CMB.2.raw
  modified_base (195)..(195): a, c, t, g, unknown or other
  modified_base (224)..(224): a, c, t, g, unknown or other
  modified_base (236)..(236): a, c, t, g, unknown or other
  modified_base (283)..(283): a, c, t, g, unknown or other
tcagacagtatatacacgaccggtgctcgatttagcagtactgcgttgggtttggggatcaggacttctcagttcatcttctcaccatgagctccctgctcagctcctggggctgctaatgctctggatccctggatccagtgcggatattgtgatgtcccagactccactctctctgtcagtccaccctggacngccgcctcatctctacagtccagtcagancctctagttggnatggaaactgctattgactggtacctgacaggacggcaggccagtcnccagctacaatgtatgagtcttcgagcccggtctcgtggacgtcgaccagtatagatttcgaggtcgacgagggccggggtaccggataggtacgttaccaacgtacttaaaggaaaacttccggaacgggtccggggtaggacggtacgtaggaagggtagttggttaggttaagtttataccgtggtactgacgtagtaggtatcggtcgttccgttaccgtcgggttaggtaccggtttcggaaccggtaacgggtaaaccgtaaaacgggtaaaacgtaaaacgttaaaccgaaaccggtacgtaagggtcgtaaccgg

SEQ ID NO: 395481 - DNA, 862 bp, Homo sapiens
  misc_feature: GZ8MTXP02FKE81.44.87.H10.1.454.CMB.2.raw
  modified_base (291)..(291): a, c, t, g, unknown or other
tcagacagtatatacacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagacctccactctctctgtcacgtccacccctggacacggcccggcctccattcctcctagacaacgtccagtcagcgcctcctagttggtgataggaacagtctatttgtactggtacctgcgaggnggtcgacggccagtcctccgacgtctactatggtactggacgtcttaccgacggtacgggtctacgtggtagtcgaccgaggtacttaacgtagttccggaacggttgggacccgggtaggggtaccgggggttacccggggaaacgtaacgtacggtttaaccgaaaccgttaaacgtaaacgggttaaaaacgtcccggggaaacggggttaccccggggggtaagggaaacggggttaccgggttaagggggtaaggggttaaggtttacgggggtttttaaggggtttaaaccggtttttaaaccggttttaacggtttaaagggttaaacgtttggtaaacccgtttagggtttacggggtttaaacggttccggttcccggttttaacccggggttcccggtttaccgggggtttaacggggtttaaccgggggttttaaacccgggggaaacccgggtttaaaaaccgggggaaaaccccggttaaaaggggttaaaaaccggtaaaaaccggtttaaaacccgaaaaaacggggtttaacccgggttaggggtttaacccggg

SEQ ID NO: 395482 - DNA, 581 bp, Homo sapiens
  misc_feature: GZ8MTXP01DHJC1.41.57.F02.1.454.CMB.2.raw
  modified_base (357)..(357): a, c, t, g, unknown or other
tcagtctatactatcacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctctggtatttccatcagttctgatctattcgttggggctggatccggcacggcccccgaggggaggggaagtgggagtggagttggtgacatccattatacgtgggcgacgtactactctccgtcccctcaagngtcgtctccactgtttcgacgggacacgtccatcgaaccgtcttctccctagaaactgaaccctcgtcgaccgccgcggaccacggtcgtttattcgtgtgcgaggcgagcgttggttctttcaattcgtagtcggggcgtggcctaccgttggtcctacgttcgttccttcctcctacgtccttacccgacccgttacggggtccccttaacgtttccccggg

SEQ ID NO: 395483 - DNA, 586 bp, Homo sapiens
  misc_feature: GZ8MTXP02IT08Q.41.57.F02.1.454.CMB.2.raw
tcagtctatactatcacgaccggtgctcgatttagctcgatatagttgggtttgggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgaggggaggggaagtgggagtggagttggtgacatcctattagtacgtggggcgacgtactactctccgtcccctacaagtacgtccgtctccacctgtttcgacgggacctaccgtccagtcgaacccgtcttcctaccctagtaaactcgaccctcgtcgaccgtcgcgacgacggtcgtttattcgtgtgcggtaggcgagtacgttggttcttacaattcgtagtcggggtccgtcggcctacccgtggtcctacgtcgtctcctcgacgtccttaccaccgtaacggccctacgtttccccgg

SEQ ID NO: 395484 - DNA, 519 bp, Homo sapiens
  misc_feature: GZ8MTXP01CTX3V.51.5.A05.1.454.CMB.2.raw
  modified_base (320)..(320): a, c, t, g, unknown or other
  modified_base (365)..(365): a, c, t, g, unknown or other
  modified_base (474)..(474): a, c, t, g, unknown or other
  modified_base (486)..(486): a, c, t, g, unknown or other
  modified_base (502)..(502): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaaagatcacctgctttggagatgcgttgaccaaaagaatctgtctttttggtaccatcagaggccaggccaggcccctgtattggtcatctatgaggacaccaagcgaccctccggaatccccngagagagtcgctcggctcaggtcagggaacaatgccactgactancactgggacccagatggacgatgaaggtgactacgactgttatcgacaggacagcagtggtagtcgagggggtactcggcggaggcgaagctgaccgtcttggagtcgngcccaaggtccncgcccccgtggtcccncctccgttccgtccccg

SEQ ID NO: 395485 - DNA, 511 bp, Homo sapiens
  misc_feature: GZ8MTXP01CD829.51.5.A05.1.454.CMB.2.raw
  modified_base (437)..(437): a, c, t, g, unknown or other
tcagcgatcgtatacacgaccggtgctcgatttagatagatagacagggggctgtgggctcaggaggcagagctctgggaatctcaccatggcctggacccctctcctgctcccctcctcactttctgcacagtctctgaggcctcctatgagctgacgcagccaccctcagtgtcagtgtctccaggacaaacggccaagatcacctgctttggagatgcgttgaccaaagaaatctagtcttttggtaccatcagaggccaggccaggccctgtactggtcatctatgaggacaccaagcgaccctcggaatccctgacgagagtccgctggctccgaggtcagggcaaatggccactgactatcacgtgggacccagatggacgatgaagtgactacatgttattcggacagacagcagtgtagtcgaggggtntcgggcggagggaacgtaagcgtgaccgtctgacgttcagcccgaaggcctcggccccttggtccaacttcccg

SEQ ID NO: 395486 - DNA, 515 bp, Homo sapiens
  misc_feature: GZ8MTXP01EJ54O.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggccaggccaggcccctgtattggtcatctatgaggacaccaagcgaccctccggaatccctgagagagtcgctggctcgaggtcagggacaatggccacttgactatcactgggacccagatggacgatgaaggtgactaccactgttattcgacagggacagcagtggtagtcgtagggggtctttcgggcggaggggacgaaggctgaccgtccttgacgtcagcccaaggctgcccctggcactcgttcgttcccc

SEQ ID NO: 395487 - DNA, 616 bp, Homo sapiens
  misc_feature: GZ8MTXP01BHEK0.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaaagaaattctgtctttttggaccatcagaggccaggccaggccctgtattggtcatctatgagacaccaagcgaccctccggaatccctgagagagcgctcggctcgaggtcagggaacaagtcggacctaccgttgactactcacgtcgggacccagactgggaacagtaggaaggtgtaactacctacttagttacttacggaacaagggaacaggaccaggtggtaagtcggaagggggttcgttcgggacgggggacgggaacggaaaggtcgtcggaacccggttcccgttagggacggttccgaacggccccgaaagggtcccgtcccggtccccccgttcgggtacccttacccgttccgtttcccggtttcccccccgg

SEQ ID NO: 395488 - DNA, 531 bp, Homo sapiens
  misc_feature: GZ8MTXP01BXTUE.51.5.A05.1.454.CMB.2.raw
  modified_base (402)..(402): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaattctgtctttttggaccatcagaggccaggccaggcccctgtattggtcatctatgaggacaccaagccgaccctccggaactccctgagagagtcgctcggctcgaggtcagggaacaagtcggcctacttgactatcacgtcgggacccagatggacgatgaaggtnactacactgtatcgacaggacagcagtgagtcgaggggtcgtcggcgggaggacgaagctcgacggtccttggacgtcgacgcccgaaggcctccggcccccgtggtccgacctccgttcgttcccccg

SEQ ID NO: 395489 - DNA, 533 bp, Homo sapiens
  misc_feature: GZ8MTXP01BQ41Z.51.5.A05.1.454.CMB.2.raw
  modified_base (480)..(480): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaaagaatctagtctttttaggaccatcagaggccaggccaggcccctgtatggcatctatgagacacaagcgaccctccggaatccctgagagagtcgctcggctcgaggtcagggaacaagtcggaccacttgactatcactcgggacccagatggacgataggaaggtacgactacacgttagtattcgaacaggacagacagtggtagtcgagggggtctcgggcggagggacgaagcgtgaccgttcngacgtcacgcccaaggctccggcccctcggtccacgttccgttcgttcccccg

SEQ ID NO: 395490 - DNA, 511 bp, Homo sapiens
  misc_feature: GZ8MTXP01EVT74.51.5.A05.1.454.CMB.2.raw
  modified_base (467)..(467): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggaccatcagaggccaggccaggcccctgtattggtcatctatgaggacaccaagcgaccctccggaatccctgagagagtcgctcggctcaggtcagggaacaatggccacttgactatcactgggacccagatggacatgaaaggtgactacactgtattcgacaggacagcaggtggagtcgagggggtctcgggcggagggacgaaggctgaccgtcttgngtcagcccaagggcctgccccctggtcactccttcgttcccccg

SEQ ID NO: 395491 - DNA, 533 bp, Homo sapiens
  misc_feature: GZ8MTXP01EY55K.51.5.A05.1.454.CMB.2.raw
  modified_base (485)..(485): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgcttttggaccatcagagcaggccaggccctgtatggtcatctatgagacaccaagcgaccctcggaatccctgagagagtccgctggctcaggtcagggcaagtggccacttgactatcacgtgggacccagactgggacgagtggaaaggtcgacttaccacttagttaattcggaacaggacagcaaggtggtagtggagggggtcttcgggcgggagggaacgaagcgtggaccgtccgtgngttcgagccccgaggcctcggcccccgttgggtccgttaacttcccgg

SEQ ID NO: 395492 - DNA, 516 bp, Homo sapiens
  misc_feature: GZ8MTXP01CC7ZF.51.5.A05.1.454.CMB.2.raw
  modified_base (215)..(215): a, c, t, g, unknown or other
  modified_base (489)..(489): a, c, t, g, unknown or other
  modified_base (502)..(502): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaatctgtctttttggtaccatcagaggccaggccaggcccctgtattggtcatctatgaggacaccaagcgaccctccggaatccctgagagagtcgctggctcgaggtcagggaacaatggccaccttgactatcactgggacccagatggacgatggaaggtgactaccgactgtattcgacaggacagcagtggtagtcgagggggtcttcgggcggagggacgaagctgacgtccttggagtcgacgccaaggcncgcccctcggtcnctcttcgttccccg

SEQ ID NO: 395493 - DNA, 506 bp, Homo sapiens
  misc_feature: GZ8MTXP01C16IU.51.5.A05.1.454.CMB.2.raw
  modified_base (215)..(215): a, c, t, g, unknown or other
  modified_base (368)..(368): a, c, t, g, unknown or other
  modified_base (469)..(469): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctcaggacaaacggccaagatcactgcttgganatgcgttgaccaaagaaatctgtctttttggaccatcagaggccaggccaggcccctgtattggtcatctatgaggacacaagcgaccctcggaatccctgagagagtccgctggctccgaggtcagggcaaagtcggaccctacttgactancactgggacccagatggacgatgaagtgactacactagttatcggacagacagcagtggtagtcgaggggtctcgggcggaggcgaagcgtcgaccgtcgngacgttcacgccgagctcgccccttggtccaacgtcc

SEQ ID NO: 395494 - DNA, 509 bp, Homo sapiens
  misc_feature: GZ8MTXP01AG99T.51.5.A05.1.454.CMB.2.raw
  modified_base (470)..(470): a, c, t, g, unknown or other
  modified_base (472)..(472): a, c, t, g, unknown or other
  modified_base (476)..(476): a, c, t, g, unknown or other
  modified_base (485)..(485): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaaatctgtctttttggaccatcagaggccaggccaggcccctgtatggtcatctatgaggacaccaagcgaccctcggaatccctgagagagtcgctcggctcgaggtcagggaacaagtcggccaccttgactatcacgtgggacccagatggacgatgaaggtgactaccacttgttattcgacaggacagcaggtggtagtcgagggggtctgggcggagggacgagctgacgtcngngtcncgccaggcncgcccctggtcactcttcgtcccc

SEQ ID NO: 395495 - DNA, 504 bp, Homo sapiens
  misc_feature: GZ8MTXP01D2X2F.51.5.A05.1.454.CMB.2.raw
  modified_base (172)..(172): a, c, t, g, unknown or other
  modified_base (219)..(219): a, c, t, g, unknown or other
  modified_base (497)..(497): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttgganatgcgttgaccaaagaatctgctttttggaccatcagaggccaggccaggcccctgtattggtcatctatgaggacacaagcgaccctcggaatcctagagagagtccgctggctcgaggtcagggcaagtggacccacttgactatcactgggacccagatggacgagtgaagtgactaccatagttatcggacaggcagcagtggtagtcgaggggtctgggcggagggaacgagctggaccgtctgagttcagcccagcctcgccccttggtccncgttccg

SEQ ID NO: 395496 - DNA, 720 bp, Homo sapiens
  misc_feature: GZ8MTXP01BY4RU.51.5.A05.1.454.CMB.2.raw
  modified_base (215)..(215): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggcaagatcacctgctttgganatgcgttgaccaaagaattctgtctttttagacatcagagccaggccaggccctgtatggtcatctatgagacaccgaagccgacctccggaactcccgtgagtagagtcgcgtcggcctcgaggtcgagggaacaaagtcggaccctaaccgttgaacctataccgacgtacgggaaccccagaacgtacgggaacgtagtacgggaaaggttcggtaaacctaaccgtaaccgttagggtttaacttaccggtaaaccgaaggggtaacgtaagggccgtaaagggtttacgggtaagggtacccgggtaaggggggtttccggtttacggggaccgggggtaaaggggtaacccgggaaaggtccggttacggttaccccggttaacccggttgggtaccgtacccgaccggggccccttaaaacgggggccccttcccgggcccccccgttccggggtccccttaacccgtttcccgttccccgggttttaaccccccccg

SEQ ID NO: 395497 - DNA, 500 bp, Homo sapiens
  misc_feature: GZ8MTXP01C5X7L.51.5.A05.1.454.CMB.2.raw
  modified_base (494)..(494): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgcttttggaccatcagaggccaggccaggcccctgtattggtcatctatgaggacacaagcgaccctcggaatccctgagagagtccgctggctccgaggtcagggcaagtcggccacttgactatcacgtgggacccagatggacgatgaagtgactacactgtattcggacagacagcagtggtagtcgaggggtctcgggcggagggaacgaagcgtgaccgtctgagttcagccaggctcgccccttgtcncgtccg

SEQ ID NO: 395498 - DNA, 541 bp, Homo sapiens
  misc_feature: GZ8MTXP01D8XGN.51.5.A05.1.454.CMB.2.raw
  modified_base (216)..(216): a, c, t, g, unknown or other
  modified_base (464)..(464): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaaagaatctgtctttttaggaccatcagaggccaggccaggcccctgtattggtcatctatgaggacaccaagccgaccctcggaactccctgagagagtcgctcggctcgaggtcagggaacaagtcggccaccttgactatcacgtcgggacccagatggacagtaggaagtcgactaccagttgttattacgacaggtacagacaggtggtagtcggtaggggtcgttcgggngggagggacgaagcgtcgaccgtcgttgacgtcgacgccaacggcctcgccccgtcggcactccgttcgttcccccg

SEQ ID NO: 395499 - DNA, 558 bp, Homo sapiens
  misc_feature: GZ8MTXP01EG07M.51.5.A05.1.454.CMB.2.raw
  modified_base (217)..(217): a, c, t, g, unknown or other
tcagcgatcgtatacacgaccggtgctcgatttagatagatagacaggggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtctttttggaccatcagaggccaggccaggcccctgtattggtcatctatgagacacaagcgaccctcggaactcccgtgagagagtcgcgtcggctcgaggtcagggaaacaagtcggaccctaccgttgactagtcacgtcggggaacccagagtacggacgataggaaagtcgaactaccacttgttatacgaacaggacagcaggtgtagtcgagggggttctcgggcgggagggacgaagcgtgacgcgttccgagagttcgcggacccgaagggtcctccgtcccccgtggttcctaaccgttccttaaccccg

SEQ ID NO: 395500 - DNA, 524 bp, Homo sapiens
  misc_feature: GZ8MTXP01AUZDH.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggcaggcagccctgtatggtcatcatgagacacagcgaccctcggaatccctgagagagtcgctcggctcgaggtcagggaacaagtcggccaccttgactatcacgtcgggacccagagtggacgataggaaggtcgactacactgttactcgacaggacagcgaggtggtagtcggagggggttctcggggcgggagggacgaagcgttcgaccgtcgttgacgtcacggcccgagcctcgccccgtcggtccacgtcttcgtcccc

SEQ ID NO: 395501 - DNA, 605 bp, Homo sapiens
  misc_feature: GZ8MTXP01AQ8EQ.51.5.A05.1.454.CMB.2.raw
  modified_base (219)..(219): a, c, t, g, unknown or other
  modified_base (596)..(596): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtcttttggaccatcagacggcaggccacggccctgtattgtcatctatgacgacaaccaagccgaccctcggaactcccgtgagagagtccgcgtggcctccgaggtacgagggaacaagtcgggacctaccttgactactacacgtacgggacccagacgtaggaacgtagtaggaaagggttcgaacttacccgtacgttagtttaacgttcgggaaacaggaaccaggacgtagggttggtaacggtcgggtaacggggggttcgttacggggcggggagggaacgaacggttcgtagttacccgtcgtgacgttcgacgaacccgaacgtcctcccggccccgttcggtccnccgttcccg

SEQ ID NO: 395502 - DNA, 530 bp, Homo sapiens
  misc_feature: GZ8MTXP01DXB9Z.51.5.A05.1.454.CMB.2.raw
  modified_base (359)..(359): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggccaggccaggccctgtattggtcatctatgagacaccaagcgaccctcggaactccctgagagagtcgctggctcgaggtcaggaacatggccactgactancacgtggacccagatggacgagtaggaaggtcgactacattgttattacgacgagactagcaggtggtagtcggagggggtcttcgggcggagggacggaagcgtggaccgtccgttgacgtcacgccgaacggcctacgcccctcgggtcaccttccgttcgtttccccg

SEQ ID NO: 395503 - DNA, 558 bp, Homo sapiens
  misc_feature: GZ8MTXP01AG8PS.51.5.A05.1.454.CMB.2.raw
  modified_base (494)..(494): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagagccaggccaggccctgtatggtcatctatgagacacagcgaccctcgatccctgagagagcgctcggctcgaggtcagggaacaagtcggacctacgttgactatccgacgtcgggacccagagtgggaacgagtaggtaaggtcgtaacctacctacgttgttaagtcgacaggacagcagggttggagtcggagggggttctcggggcgggagggacgaaggcgtcggaccgtccgnggacgtcgacggcccgacggccgtcccgccccgttcgggcccttacgttccgttccgttccccc

SEQ ID NO: 395504 - DNA, 485 bp, Homo sapiens
  misc_feature: GZ8MTXP01CCUG5.51.5.A05.1.454.CMB.2.raw
  modified_base (449)..(449): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaatctgtctttttgaccatcagagcagccagccctgtatgtcatctatgagacacaagcgaccctcggaactccctgagagagtcgctcggctcaggtcagggaacaagtggccacttgactatcacgtggacccagactggacgatagaagtgactacgactgtaatcgacagacagcagtgtagtcgaggggtctgggcgaggcgagctgacgtcngagtcacgccagctcgccctgcactcgttcgtcccc

SEQ ID NO: 395505 - DNA, 502 bp, Homo sapiens
  misc_feature: GZ8MTXP01DR32J.51.5.A05.1.454.CMB.2.raw
  modified_base (388)..(388): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgctttttggaccatcagagccaggccaggcccctgtatggtcatctatgaggacaccaagcgaccctccggaatccctgagagagtcgctcggctcaggtcagggaacaatcggccacttgactatcactgggacccagatggacgatgaagtnactacactgtatcgacaggacagcagtgagtcgagggggtctcgggcggtaggcgaagctgaccgtcgttgacgtcacgccaaggctcgcccctcggcacctcgttcgtccccg

SEQ ID NO: 395506 - DNA, 551 bp, Homo sapiens
  misc_feature: GZ8MTXP01EYIJZ.51.5.A05.1.454.CMB.2.raw
  modified_base (450)..(450): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttggaccatcagagcaggccaggcccctgtattggtcatctatgagacacaagcgaccctccggaatccctgagagagtccgctggctccgaggtccaaggggcaagtcggcccacttgactatcacgtgggacccaggatggacgtataggaaggtgaactaccacttgttaacttcggactaggaccagcaggtggtagtcggnggggtcttcggggcgggaagggaacgaaggcgtacggaaccgtccgtggacgttccacggcccgaagggcctcggcccccgttggtccttaaccgttcccg

SEQ ID NO: 395507 - DNA, 508 bp, Homo sapiens
  misc_feature: GZ8MTXP01DN660.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaaatctagctttttggaccatcagaggccaggccaggccctgtattggtcatctatgagacaccaagcgaccctcggaatccctgagagagtcgctcggctcaggtcaggaacaatggccacttgactatcacgtgggacccagatggacgatgaaaggtgactacactgtattacgacaggacagcagtggtagtcgaggggtctcgggcggagggacgaagctgaccgtcttgagtcacgccaaggctcgccccgtggcactcgttcgttccccg

SEQ ID NO: 395508 - DNA, 507 bp, Homo sapiens
  misc_feature: GZ8MTXP01EL0I3.51.5.A05.1.454.CMB.2.raw
  modified_base (500)..(500): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgcttttggaccatcagaggccaggccaggcccctgtattggtcatctatgaggacaccaagcgaccctcggaatccctgagagagtccgctggctccaggtcagggcaatggccacttgactatcacgtgggacccagatggacgatgaagtgactaccactgttattcggacaggcagcagtggtagtcgagggggtcttcgggcggagggaacgaagctggaccgtcgtgacgttcacgcccaggctcgccccttggtccncgttccg

SEQ ID NO: 395509 - DNA, 522 bp, Homo sapiens
  misc_feature: GZ8MTXP01DFG60.51.5.A05.1.454.CMB.2.raw
  modified_base (316)..(316): a, c, t, g, unknown or other
  modified_base (477)..(477): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggccaggccaggcccctgtatggtcatctatgagacacaagcgaccctcggaatcccngagagagtccgctggctccgaggtccaagggcaaagtcgggaccaccgttgactatcacgtgggacccagatggacgagtagaaggtgactaccatagttatcggacagacagctagtggtagcgagggggtcttggcgggaggaagagcgtgaccgtcgngacgttcgagcccaaggcctcggccccgttggtccttcgttcccg

SEQ ID NO: 395510 - DNA, 521 bp, Homo sapiens
  misc_feature: GZ8MTXP01C8TZ9.51.5.A05.1.454.CMB.2.raw
  modified_base (315)..(315): a, c, t, g, unknown or other
  modified_base (319)..(319): a, c, t, g, unknown or other
  modified_base (375)..(375): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggccaggccaggcccctgtattggtcatctatgagacacagcgaccctcggaatccngagngagtccgctggctccgaggtaccgagggaacaagtcgggacccaccgttgactacncacgtgggaccctagatggacgagtagaagtgactacatgttattcggacagacagcagtggtaggtcgaggggtctcgggcggagggaacgaagcgtgccgtcgtgagttcacgcccgaagctcgcccgttcgtccgcgttcccg

SEQ ID NO: 395511 - DNA, 510 bp, Homo sapiens
  misc_feature: GZ8MTXP01CGOJE.51.5.A05.1.454.CMB.2.raw
  modified_base (477)..(477): a, c, t, g, unknown or other
  modified_base (479)..(479): a, c, t, g, unknown or other
  modified_base (505)..(505): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgccaaagaaatctgctttttggaccatcagaggccaggccaggcccctgtattggtcatctatgaggacaccaagcgacccctcggaatccctgagagagtccgctggctccgaggtcagggcaatcgggccacttgactatcactgggacccagactgggacgatggaaggtgactaccactgttattcggacaggcagcagtggtagtcgagggggtcttcggggcggagggaacgaagctgaccgtcngngttcagccagctcgccccttggtccnctccg

SEQ ID NO: 395512 - DNA, 553 bp, Homo sapiens
  misc_feature: GZ8MTXP01D3S9D.51.5.A05.1.454.CMB.2.raw
  modified_base (168)..(168): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctnagtgtcagtgtctccaggacaaacggccaagatcacctgctttggagatgcgttgaccaaagaatctgtcttttttggaccatcagaggccaggccaggcccctgtattggtcatctatgaggacaccaagcgaccctcggaatccctgacgagagtcgctcggctcgaggtcaggggaacaagtcggcccacttgactatcacgtcgggacccagagtggacgatgaaaggttcgaactaccacttgttaattacgaacaggacaagcgtaggtggtagtcgagggggttcttcggggcgggaggggacgaaggcgtcgaccggtccttaggagtcgacgcccgaaggcctacgccccgtcggtccacgttccttcgttccccg

SEQ ID NO: 395513 - DNA, 512 bp, Homo sapiens
  misc_feature: GZ8MTXP01B1XG1.51.5.A05.1.454.CMB.2.raw
  modified_base (319)..(319): a, c, t, g, unknown or other
  modified_base (341)..(341): a, c, t, g, unknown or other
tcagcgatcgtatacacgaccggtgctcgatttagatagatagacagtgggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgctttttggaccatcagaggccaggccaggcccctgtattggtcatctatgaggacaccagcgaccctcggaatccctgagngacgtcgctggctccaaggtcngggacaatgggccacttgactatcacgtgggacccagatggacgatgaaggtgactacacttgttattcgacagacagcaggtggtagtcgagggggtcttcgggcggaagggcgagcgttgaccgtccgttgcgttcaagcccaaggcctcgccccctggttcctaaccg

SEQ ID NO: 395514 - DNA, 617 bp, Homo sapiens
  misc_feature: GZ8MTXP01BNIIO.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttgacatcagaggccaggccaggcccctgtattggcatctatgaggacaccaagcgacccctacggaactcccgtgagagagtcgcgtcggctcgaggtcgacgggaacaagtcggacctaccgttgactatcacgtcgggacccaggagtgggacgagttaggaaacgggtgtaacctaccgacttgttacttacgaacagggaacaggcgtaggtggtacggtcggaagggggttccgttacggggcgggtaaggggaccgaaagggccgttacggacccggttcgacgggtacgttccgaccggaccccgaagggccctcccggtccccccgttgggtacccttacccgtcccgtttcccggttaaccccccg

SEQ ID NO: 395515 - DNA, 560 bp, Homo sapiens
  misc_feature: GZ8MTXP01EBFX2.51.5.A05.1.454.CMB.2.raw
  modified_base (216)..(216): a, c, t, g, unknown or other
  modified_base (541)..(541): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaaagtaaattctgtctttttggaccatcagaggccaggccaggcccctgtattggtcatctatgagggacaccaagccgaccctcggaactccctgagagagtcgctcggctcgaggtcagggaacaagtcggcctacgttgactatcacgtacgggacccagagtggaacgataggaaaggtgaactaccattgttaattcgacaggaacagacgaggtggtacgtcggagggggttcttcggggcgggtagggacgaaggctcggaccggtccttggacgtcacggccgaacggctccgccccgtggtacncgtccgttccgttcccccg

SEQ ID NO: 395516 - DNA, 574 bp, Homo sapiens
  misc_feature: GZ8MTXP01BQ0KF.51.5.A05.1.454.CMB.2.raw
  modified_base (490)..(490): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggacatcagagcaggccaggccctgtatggtcatctatgaggacaccaagcgaccctcggaactccctagagagagtcgctcggctcgaggtcagggaacaagtggccacgttgactatcacgtcgggacccagactgggacgagtagaaggtgactaccactgttatcgactaggacagcaggtggtagtcggagggggtcgttcgggcgggtaggggacgaaaggcgttcgggacccgttcccgnggaaacgtccgaacggccccgaagggcccctcgggccccccgttcgggtcccttaccgttcccgtttaacccggtttccccccc

SEQ ID NO: 395517 - DNA, 644 bp, Homo sapiens
  misc_feature: GZ8MTXP01BFF6L.51.5.A05.1.454.CMB.2.raw
  modified_base (220)..(220): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccaccctcagtgtcagtgtctccaggacaaacggccaagatcacctgctttgganatgcgttgaccaaagaattctgtctttttggaccatcagacgccaggccacgccctgtattggtcatctagtgacgacaccgagccgacccgtcggaactccagagagagtcccgcttggcctccgaggtaacgagggaactaacgtcggaccctaccgttgactacgtccacgtacgggaccctaggagtaggaacgtacgtagggaacggtcgtaacctaccgtaagttacgttaacgttacgggaacgtaacggaccaggtacgtaagggttggtaacggtaccgggttaggggggttccgttacggggacggggaacggggaacgtaacggttccggtacgacccggtccgtggaccggttccgacggtaaccccggacgtcccgtcccggtcccccgttgtaacccttccgtttccccg

SEQ ID NO: 395518 - DNA, 555 bp, Homo sapiens
  misc_feature: GZ8MTXP01CDHXA.51.5.A05.1.454.CMB.2.raw
  modified_base (169)..(169): a, c, t, g, unknown or other
  modified_base (216)..(216): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttgganatgcgttgaccaaagaatctgtctttttgaccatcagagcaggccaggccctgtatggtcatctatgaggacaccaagccgaccctccggaatcccgtgagagagtcgctcggctcgaggtcaggaacagtcggcctacttgactatcacgtcggaccagatggacgagtgaaggtcgaactaccgattacgttactcgactaggaacagcgaggtggtagtcggtagggggttctcggggacgggagggacgaaggcgtcggacctcgagacgtcgacggttcccaacgggtccgccgtccccggtcggtcccaccttccgttccggtttaacccccc

SEQ ID NO: 395519 - DNA, 501 bp, Homo sapiens
  misc_feature: GZ8MTXP01ESICC.51.5.A05.1.454.CMB.2.raw
  modified_base (467)..(467): a, c, t, g, unknown or other
  modified_base (496)..(496): a, c, t, g, unknown or other
tcagcgatcgtatacacgaccggtgctcgatttagatagatagacaggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgcttttggtaccatcagaggccaggccaggcccctgtattggtcatctatgaggacaccaagcgaccctcggaatccctgagagagtccgctggctccaggtcagggcaatggccaccttgactatcactgggacccagactggacgagtgaagtgactaccatgttatcggacagacagcagtggtagtcgagggggtcttcgggcggaagggcgaagctggaccgtcngagttcagccaggctcgccccttcggtcncgtcc

SEQ ID NO: 395520 - DNA, 529 bp, Homo sapiens
  misc_feature: GZ8MTXP01C7MRX.51.5.A05.1.454.CMB.2.raw
  modified_base (487)..(487): a, c, t, g, unknown or other
tcagcgatcgtatacacgaccggtgctcgatttagatagatagacagggggctgtgggctcaggaggcagagctctgggaatctcaccatggcctggacccctctcctgctccccatcctcactttctgcacagtctctgaggcctcctatgagctgacgcagcccacctcagtgtcagtgtctccaggacaaacggccaagatcacctgctttggagatgcgttgccaaaagaatctgcttttggaccatcagaggccaggccaggcccctgtattggcatctatgaggacaccaagccgaccctcggaatccctgagagacgtcgctggctccgaagggtcaaggggacaagtcggccaccttgactatcactgggaccagatggacgatgaaggtgactacacttgttagttcgactagacagcagttggtaacgtcgtagggggttctcgggcggaagggcgaaagcgttggaccgtcttggngttacgaacgcccgaaggcctcgcccccgtggttcctaaccg

SEQ ID NO: 395521 - DNA, 530 bp, Homo sapiens
  misc_feature: GZ8MTXP01DP64P.51.5.A05.1.454.CMB.2.raw
  modified_base (169)..(169): a, c, t, g, unknown or other
  modified_base (215)..(215): a, c, t, g, unknown or other
  modified_base (481)..(481): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcactgctttgganatgcgttgaccaaaagaatctgtctttttggaccatcagaggccaggccaggcccctgtattggtcatctatgaggacaccaagccgaccctcggaactccctgagagagtcgctcggctccgaggtcagggaacaagtcggaccacttgactatcacgtcgggacccagatgggacagtagaaggtcgaactaccacttgttatcgacaggggacagcaggtgtagtcgagggggtctcgggcggagggacgaagctgaccgtcnggagtcacgcccaggcctccgccccgtggccactccgttcgttcccccg

SEQ ID NO: 395522 - DNA, 556 bp, Homo sapiens
  misc_feature: GZ8MTXP01BUJMY.51.5.A05.1.454.CMB.2.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggccaggccaggcccctgtattggtcatctatgaggacaccaagccgaccctccggaactcccgtgagagagtccgctggcctccgaggtccaggggcaagtcgggccctaccgttgactatccacgtcggggacccaggagtgggacgagtggaaaggtgaacctaccacttagttattacgggactagaccaggcaggtggtagtcggagggggtcttcgggcgggagggaacgagctcgaccgtccgtgacgttcacggcccgaaggcctcggccccttcgggtccttcgtcccg

SEQ ID NO: 395523 - DNA, 679 bp, Homo sapiens
  misc_feature: GZ8MTXP01DS758.51.5.A05.1.454.CMB.2.raw
  modified_base (172)..(172): a, c, t, g, unknown or other
  modified_base (218)..(218): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagttgtcagtgtctccaggacaacggccaagatcactgctttggantgcgttgaccaaagaatctgtcttttagaccatcagacggccacggccacggtccctgttattggtcattctatggacgaccaaccgaagccgacccgtcggaactccgtagagagacgtccgcgtggcctccgaggtacgaaggggaactaagtccgggaccctaccgtttaggaaccttacgtaccgtaccgtacggggaaccccaggtacgttacgggaacgtaagtacggtaaaggtacgaaccttacctacgtttagtttaacgttacgggacgtaagaaccgagtcgtaggtagggtttacgtaacgggtacggggggttcgttacgggggacggggaaggggaaccgtaaggttccgtacgggttacccgtccggttaggacggttccgaccggtccccgtaaaggggcccttcccggggcccccccgtttacgggttcccttccgtttccccg

SEQ ID NO: 395524 - DNA, 790 bp, Homo sapiens
  misc_feature: GZ8MTXP01DERAW.51.5.A05.1.454.CMB.2.raw
  modified_base (275)..(275): a, c, t, g, unknown or other
  modified_base (305)..(305): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaaagaatctgtctttttggaccatcagagcagccagccctgtatgtnatctatgagacacagcacctcgaatcccgngagagagtcgctcggctacgaggtcgagggaaacaaacgtcggaccctaacttacggaacctaactaccgtaacgtaccggggaaccccaaggtaacgtaggggaaaccggaagttacgggaaaaaagggggtttcgaaaccgttaaccccgtaaactttagggtttaaactttacccgggaaacctaaggggggtaaaccctaaaggggcccgttaaaaggggtttcgggggttaaagggttcccgggtaaagggggggggtttccgtttaccccggggggtaccggggggaaagggggtaaacccggaaaacgggtccggttaaccggggttaaaccccgggttttaccccgggttacgggtaaaccggtaaccggaacccgggttacccggttaaccggggttccccgtacccccgggttaaccccccggttccgggttaccccgttaccccgtttccccgtttccccggtttaaccccccg

SEQ ID NO: 395525 - DNA, 565 bp, Homo sapiens
  misc_feature: GZ8MTXP01EKX7J.51.5.A05.1.454.CMB.2.raw
  modified_base (498)..(498): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaattctgtctttttggaccatcagagcaggcaggccctgtatggtcatctatgagacacagcgaccctcggaactcccgtgagtagagtcgctcggctcaggtcagggaacaatggccacgttgactatcgacgtcgggacccagatggacagtaggaaggttcgactacccagttgttacttacgacaggaactaggactaggtggtaacgtccggtaagggggttccgttcgggcgggagggaccgaaggctcggacccgttccgnggaacgtcaacgcccgaagggtccctcggcccccgtgggtccaccgttccgttcgggtttccccccg

SEQ ID NO: 395526 - DNA, 608 bp, Homo sapiens
  misc_feature: GZ8MTXP01D2872.51.5.A05.1.454.CMB.2.raw
  modified_base (215)..(215): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaatctgtctttttggaccatcagacggcaggccacggccctgtattggcatctatgagacaccaagccgaccctcggaactcccgtagagacgagtcgcgtcggcctcgaggtcgaagggaacaagtcggcctacgttgactatcacgtcgggaccagactagggacgagtaggaaaggtgaactaccgacttgttaactacgacaggacaggtacctaggtggttaacggcggtagggggttccgttcgggggaccggggtaagggaccgaaaggtccgtacggacccggttccgttggacgtaccgacggttcccgaaacgggtccctaccgggtcccccttcggggtccttaccttccgttcccgtttccccccg

SEQ ID NO: 395527 - DNA, 564 bp, Homo sapiens
  misc_feature: GZ8MTXP01DNJKE.51.5.A05.1.454.CMB.2.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagagcaggccaggcccctgtattggtcatctatgagacaccaagccgaccctcgaatccctgagagagtccgctggctccgaggtacagggaacaaagtgggacccacttgactatccacgtcggacccagatggaacgagtaggaaggtcgaactaccgattagtttaacttcggaactaagaccagtccgaaggttggtagtacggaagggggttccttcggggcgggaaggggaacgaaagcgtacgaccgtccgtgacgttcacgcccgaaggtccgtccgcccccgttggtccttaacgttcccg

SEQ ID NO: 395528 - DNA, 514 bp, Homo sapiens
  misc_feature: GZ8MTXP01AO6XI.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgtctttttggaccatcagaggccaggccaggcccctgtattggtcatctatgaggacaccaagcgaccctcggaatccctgagagagcgctcggctcgaggtcaggggaacaatggccaccttgactatcactgggacccagactggacgatgaaggtgactacactgttatcgacagggacagcaggtgtagtcgagggggtcttgggcggaggacgaaggctgaccgtcttgagtcagcccaagggcctgccccctggtccactcttcgttaaccccc

SEQ ID NO: 395529 - DNA, 536 bp, Homo sapiens
  misc_feature: GZ8MTXP01CW238.51.5.A05.1.454.CMB.2.raw
  modified_base (368)..(368): a, c, t, g, unknown or other
  modified_base (444)..(444): a, c, t, g, unknown or other
  modified_base (467)..(467): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaattctgtctttttggtaccatcagagccaggccaggcccctgtattggtcatctatgaggacaccaagcgacccctcggaactccctgagagagtcgctcggctcaggtcagggaacaagtcggccacttgactancacgtgggacccagatggacgatggaagtgactaccattgtatcgacagcagcaggtgtagtcgaggggtctgggnggagggacgaaggctgccgtcgngtacggcacggcccgacggtcctccggtcccccgttcgggtcccttaccgtccgttccgtttccccccg

SEQ ID NO: 395530 - DNA, 521 bp, Homo sapiens
  misc_feature: GZ8MTXP01A6Y0Q.51.5.A05.1.454.CMB.2.raw
  modified_base (169)..(169): a, c, t, g, unknown or other
  modified_base (387)..(387): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttggagatgcgttgaccaaaagaatctgtctttttggaccatcagaggcaggcagccctgtatggcatcatgagacacaagcaccctcggaatccctgagacgagtcgctcggctcgaggtcaggaacaatggccacttgactatcacgtcgggaccagactggacgatgaaaggtnactacactgtatcgacaggacagcagtggtagtcgaggggtctcggcggagggacgaaagcgtggacccggtcttggacgtcacggcccaaggccctccgtccccgtcggtaccttacgtccgttccgtccccg

SEQ ID NO: 395531 - DNA, 553 bp, Homo sapiens
  misc_feature: GZ8MTXP01BXSAD.51.5.A05.1.454.CMB.2.raw
  modified_base (413)..(413): a, c, t, g, unknown or other
  modified_base (454)..(454): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaaatctgtctttttggaccatcagaggccaggccaggcccctgtattggtcatctatgaggacaccaagcgaccctcggaactccctgagagagtcgctcggctcgaggtcgagggaacaagtcggcctacttgactatcacgtcgggaccctagatcgggacgagtggaaagtgactaccnttgtattgacaggacagcagtgtagtgagggggtctcgggngggtagggacgaaggtcgtggaccggtccttggacgtcgacggttccccgaagggtcctcccggccccgtcgggacttcccgtcgttccggttcccccg

SEQ ID NO: 395532 - DNA, 755 bp, Homo sapiens
  misc_feature: GZ8MTXP01A6QIV.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtctttttaggaccatcaggaggccaggccacggcccctgtattggtcatctatgagacacaagcaccctccggaactcccgtgagagacgtcgctcggcctcgaggtcgagggaacaacgtcggaccctaccgtttagacctacgtcacgttacgggaccccaaggtacgtaggggacgtaagtaggaaacgggtcggtaaccttaacctaccgttaggtttaacgttacggaaaccgtaaggggaacgaacggtaccgtaagggttaggggttaacgggttaccggggttaaagggggggtttcccggttacggggggtaaccgggggtaaacggggggtaaaccggaaagggtcccggttacggggttaaaccccggttccccgttagggtaaacggttacccgaaccggggttaccccggaaaccggggtcccgttacccccgggtcccccccggtttacgggggttaccccttacccggtttccccgtttccccgggttttccccccccccggg

SEQ ID NO: 395533 - DNA, 529 bp, Homo sapiens
  misc_feature: GZ8MTXP01AKPJS.51.5.A05.1.454.CMB.2.raw
  modified_base (400)..(400): a, c, t, g, unknown or other
  modified_base (471)..(471): a, c, t, g, unknown or other
  modified_base (478)..(478): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaatctgtctttttggaccatcagaggccaggccaggcccctgtattggcatctatgaggacaccagcgaccctcggaatccctgagagagtcgctcggctccgaggtccagggaacaatggccacttgactatcactgggacccagatggacgatgaaggtgactaccncttgtatcgacagggacagtcagtggtagtcgagggggttctcgggcggagggacgaagctgaccgtccgngacgtcncgttcccaagggtcctcggcccccgtggtccacctccgttcggtttccccc

SEQ ID NO: 395534 - DNA, 732 bp, Homo sapiens
  misc_feature: GZ8MTXP01AZ7CO.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccaggccctgtattggcatctatgagacaccagccgaccctcggactcccgtgagagacgtcgcgtcggctcgaggtcaggggaacagtcggacctaccgtgactagtccgacgtcgggacccaggagtacgggaacgacgtaggtaaacgggtcgtaaccgtaacccgtacgttacgtttaacgttacggaaccgaacgggggtaaccgaagggtaccgtaaggggtttacggggtaaccgggttaccggggtaacggggggggtttacccggtttccggggggaaccgggggttaacggggggaaccggtaaacgggtcccgggttaaccgggaaccccgggtttccggttacgggaaccggttcccgaaccgggttccccggaacgggggtccccttacccggggtcccccccgttcggggtaccccttacccggttccccggtttccccgggttttccccccccgg

SEQ ID NO: 395535 - DNA, 709 bp, Homo sapiens
  misc_feature: GZ8MTXP01EEI4Y.51.5.A05.1.454.CMB.2.raw
  modified_base (217)..(217): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgcagtgtctccaggacaaacggccaagatcacctgctttgganatgcgttgaccaaagaaatctgtctttttggaccatcagaggccaggccacggcccctgtattggtcatctatgaggacaccaagcaccctcggaactcctagagagacgtccgctggcctccgaggtacgaagggaacaagtcggaccctaccgttgactattccacgtacgggacccaggatcgggaacgtagttacggaaaggttcgaaccttacccgaacgtttaggttttaacttccggggaaacgaaacggtaaccgaacggtaccgtaagggttgggggttaacggttaccggggtaacgggggggttcccgtttacgggggaccgggggtaacgggggtaaaccggaaaggttccggttaccgggaaacccggttcccggtagggttaaaccggttccgaaaccgggcccccggtaaaaggggtccccgttcccgggtaccccccccgtttcgggtaaccccgtttaacccgttttcccccggg

SEQ ID NO: 395536 - DNA, 605 bp, Homo sapiens
  misc_feature: GZ8MTXP01A4TQE.51.5.A05.1.454.CMB.2.raw
  modified_base (204)..(204): a, c, t, g, unknown or other
  modified_base (219)..(219): a, c, t, g, unknown or other
  modified_base (416)..(416): a, c, t, g, unknown or other
  modified_base (594)..(594): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagntcacctgctttgganatgcgttgaccaaagaatctgtcttttggaccatcagaggccaggccaggcccctgtattggtcatctatgaggacacagccgaccctcggaactcccgtgagagagtcccgctggctccgaggtacagggcaagtcggacccacgttgactatccacgtcgggacccagacgtaggacgtagtaggaaacgggttnaaccttaccacttgggtttaaacttcggggaaccaaggacaacggcctaagggttggttaacggtaccgggtaggggggttccgttaccgggggacgggaaggggaacgaaaggttcgtacggacccgtccgtagacgttcgacgccccgtaaggcccgtccgcccccgttcggtccnccgtttccccg

SEQ ID NO: 395537 - DNA, 651 bp, Homo sapiens
  misc_feature: GZ8MTXP01CPDBY.51.5.A05.1.454.CMB.2.raw
tcagcgatcgtatacacgaccggtgctcgatttagatagatagacagggggtgggctcaggaggcagagctctgggaatctcaccatggcctggacccctctcctgctcccccctcctcactttctgcacagtctctgaggcctcctatgagctgacgcagcccaccctcagtgtcagtgtctccaggacaaacggccaagatcacctgctttggagatgcgttgaccaaagtaatctgtctttttggaccatcgagaggccaggccacggccctgtatggtcatctatgacgacaccgaacgccgaccccgtccggaactcccgtaggagagacgtcgcgtccggctcgaggtcgagggaactaagtcggaccctaccgttgacctagtccacgtcgggaaccctaggacgtagggaacgtaacgtaggaaaggtcaaccttaccgacgttagttaaccgttacgaacgaaggacgaggtacgtaacgggttgggtaacgtccgggtaagggggttccttacgggggaccgggagggaaccgaaggtccgtacggacccgttcgaggtaccgtcgacccggttccgaccggtccctccccggtcccccgttacgggtccttacccgtttcccgttcccggtttccccccg

SEQ ID NO: 395538 - DNA, 637 bp, Homo sapiens
  misc_feature: GZ8MTXP01B82N0.51.5.A05.1.454.CMB.2.raw
  modified_base (169)..(169): a, c, t, g, unknown or other
  modified_base (218)..(218): a, c, t, g, unknown or other
  modified_base (552)..(552): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctnagtgtcagtgtctccgaaggacaaacggccaagatcacctgctttgganatgcgttagaccaaagtaatctgtctttttggaccatcagacggccaggccacggcccctgtattggtcatctatgagaccacgaacgccgacccgtccggaactcccgtagagagagtcgacgtcggctacgaggtcgagggaacaagtcggacctacttgactatcacgtcgggacccagacgtggacgagtaggaaaggtcgaactaccgtacttagttaacttacgaacgtagggaactaggtacgtaagggttaggtaggtcgggtagggggttaccgttcggggacggggtacgggaacggaaggtccgtacgggttacccggttcgnggtaacgtccgaaccggcccgaacgggtcccctcccggtcccccgttcgggtaccttaccgttcccgtttccgttaacccccccg

SEQ ID NO: 395539 - DNA, 613 bp, Homo sapiens
  misc_feature: GZ8MTXP01CFGMB.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcacttttctgcacagtctctgaggcctcctatgagctgacgcagccacctcagtgtcagtgtctccaggacaaacggccaagatcacctgctttggagatgcgttgaccaaaagaatctgtcttttagacatcagagcagcacgccctgtatgcatcatgagacacagcacctcgatccctgagagagtcgctcggctacgaggtcagggaacaagtcggaccctaccgttagactatccgacgtcgggacccagactagggacagtagaaagggtcaacgtaccactagttaactcgaacaggacaggcctaagggtggtacggtacggtaagggggttccgttacgggaacggggaacggggtaacgaaacggtcgtacggacccggtccgttaggaacgttcccgaaccggccccgaaacggggtccccgtcccgggtccccccgttcggggtcccgttaacccttcccgttccccggttttaacccccccg

SEQ ID NO: 395540 - DNA, 705 bp, Homo sapiens
  misc_feature: GZ8MTXP01BKKBD.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcactgcttggagatgcgttgaccaaagaatctgtcttttgaccatcagagcagccaggccctgtatgtcatctatgagacaccgaagcgaccctcggatccctagagagacgtccgctggcctcgaggtacaagggaacaaagtcgggaccctacccgttgacctatacccgacgtcgggacccctaaggacttacgggaacgtaacgtaggtaaacggtcgaaccgttaaccgtaccgttagggtttaactttaccgggggaaacttaaacggtaacccgaaggtaccggtaaggttacggggttacggtacccggggtaacggggggttacccgttacggggggaccgggggtaaacggggaaaccggtaacgggttacccgttacggggttaccccggttccgggttacggaccgggttcccgacggtaaccccggaaacgggtcccgttaaccccgggtccccccggttacgggtccccttaacccggtttccccg

SEQ ID NO: 395541 - DNA, 618 bp, Homo sapiens
  misc_feature: GZ8MTXP01B1M9V.51.5.A05.1.454.CMB.2.raw
  modified_base (219)..(219): a, c, t, g, unknown or other
tcagcgatcgtatacacgaccggtgctcgatttagatagatagacagggggctgtgggctcaggaggcagagctctgggaatctcaccatggcctggacccctctcctgcctcccccctcctcactttctgcacagtctctgaggcctcctatgagctgacgcagccaccctcagtgtcagtgtctccaggacaaacggccaagatcactgctttgganatgcgttgaccaaaagaatcttgtctttttggaccatcagaggccaggccacggccctgtattggcatctatgaggacaccacgccgaccctcggaactccctgagagagtccgcgtggctccgaggtacgaagggctaaagtcgggaccctaccgttgaactatccgacgtcgggacccaaggacgtagggaacgtaagtacggaaggtacgaacctaacctagttagttaacttacggaactaaggaaccaggacgtagggttggtacggtcgggtacggggggttccgttacggggaccggggtaaggggaacggaaggttcgtacggttacccgtcgtggacgttccgaccggcccgaagggccctccggtcccccgttggtcccttcgttcccc

SEQ ID NO: 395542 - DNA, 596 bp, Homo sapiens
  misc_feature: GZ8MTXP01BJJPH.51.5.A05.1.454.CMB.2.raw
  modified_base (172)..(172): a, c, t, g, unknown or other
  modified_base (219)..(219): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttgganatgcgttagccaaaagaatctgtctttttggaccatcagaggccaggccaggcccctgtatgtcatctatgagacaccaagccgacccgtcggaactcccgtagagacgagtcccgcgtggctccgaggtacgaagggaacaagtcgggaccctacgttgactagtcacgtcgggacccaggacgtggaacgtaagtggaaaggtcgaacctaccgtacgttagtttacgttacgggaacgacgaacgacggtagaagggttcggtaggtaccgggtagggggttccgttcggggacgggtaggggaacgaacggttctacggaccgtcgtgacgttcgacgcccagcgtccgcccgttcggtcttaaccgttcccg

SEQ ID NO: 395543 - DNA, 574 bp, Homo sapiens
  misc_feature: GZ8MTXP01A28MA.51.5.A05.1.454.CMB.2.raw
  modified_base (302)..(302): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttgacatcagagcaggcaggccctgtatgcatcatgagacacagccgacctcggatcccgngagagagtcgctcggctcgaggtcgaggaacaagtcggcctacgttgactagtcacgtcgggaccctagactgggaacgataggtaaagggtcaacctaccgacgttgttaacgttacgaacaggggaacaggacgtagggttcggtaaggtcggtaagggggtccttcggggcgggtagggacgaaggcgtaggacccgtcgttggacgtcgacggcccgaagggtcctccggccccgttcggtccttaccgttccttaaccggttccccc

SEQ ID NO: 395544 - DNA, 737 bp, Homo sapiens
  misc_feature: GZ8MTXP01A2G4U.51.5.A05.1.454.CMB.2.raw
  modified_base (169)..(169): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttggagtatgcgttgaccaaagaatctgtctttttggaccatcagaggccaggccaggcccctgtattggtcatctatgacgacaccaagccgacctccggaatcccgtgagagagtcgctcggctcgaggtacgaggaacaagtcggacctaccgttgactagtccacgtcgggaccccagtacgtcgggaacgaagtaggaaacgggtcgtaaacctaacccgtaacttacgggttaactttaccggaaccgtaaggggtaacccgaaggtacccgtaaagggttacggggtaacggttaccgggtaacggggggggtttaccgtttacggggggaaccgggggtaacgggggaaccgggtaaacgggtccgggttaacgggttaccccgggttacccgttaggggaaaccggttcccgttaaccgggttacccccggaaacgggtcccggttaaccccggtcccccccggttcggggtaccccttaacccgtttcccgggtttcccgttttccccccccccggg

SEQ ID NO: 395545 - DNA, 542 bp, Homo sapiens
  misc_feature: GZ8MTXP01A3SWX.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaaagaatctgtctttttggaccatcagaggcaggccaggcccctgtattggtcatctatgaggacaccaagcgaccctcggaatccctgagagagtcgctcggctcgaggtcagggaacaagtcggaccacttgactatcacgtcgggacccagatggacagtgaaggtgactacactgttactcgacaggacagcaggtggagtcgagggggtctcgggcgggagggacgaaggctcggaccgtccgttggacgtcgacggttcccgaagggtcctccggcccccttgggccttaccgtccgttcgttccccc

SEQ ID NO: 395546 - DNA, 547 bp, Homo sapiens
  misc_feature: GZ8MTXP01A5BFH.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggacatcagaggccaggccaggcccctgtattggtcatctatgaggacaccgaagccgaccctccggaactcccgtgagagagtcgcgtcggctcgaggtcagggaacaagtcggccaccttgactatcactcgggacccagagtggacgataggaaggtcgaactaccacttagttacttcgacaggacagcaggtggtagtcggtagggggtcgttcggggcggagggtacgaaggcgtcgaccgtcgttgacgtcacgcccgaaggcctcgccccgtcggccacgtccgttccgttccccg

SEQ ID NO: 395547 - DNA, 528 bp, Homo sapiens
  misc_feature: GZ8MTXP01CJ0XA.51.5.A05.1.454.CMB.2.raw
  modified_base (218)..(218): a, c, t, g, unknown or other
  modified_base (270)..(271): a, c, t, g, unknown or other
  modified_base (275)..(275): a, c, t, g, unknown or other
  modified_base (298)..(298): a, c, t, g, unknown or other
  modified_base (386)..(386): a, c, t, g, unknown or other
  modified_base (498)..(498): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggcaaagatcactgctttgganatgcgttgaccaaagaatctgtcttttggacatcagagcagcagcctgatgnntcangagacacagcacctcggaatccngacgagagtccgctgctcgaggtaccgagggaacaagtggccctactgactatcacgtcgggaccagacgtggaacgataggaaggtnacctaacacttagttatcggggaacagacagcgagtggagtcgagggggtctacggggcggaaggggcgaaggcgtacgaacccgtccgtggcgcgacgaacccgaggtccnccgtccccgttcgggccttaacgttccccg

SEQ ID NO: 395548 - DNA, 575 bp, Homo sapiens
  misc_feature: GZ8MTXP01BM4NK.51.5.A05.1.454.CMB.2.raw
  modified_base (553)..(553): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttgacatcagagcaggccacggccctgtattggtcatctatgaggacaccgagccgaccctcggaactcccgtgagagacgtcgctcggctcgaggtcagggaacaagtcggcctacgttgactatacacgtcgggacccagagtaggacgagtaggaaggtcgaactacacgttagttactacgacagggaacgtaggacgagggttggtaacggtcgggtacgggggttcgtcggggacgggacgggacggaagcgtacggaccgtcgttggacgtcgacgcccgaaggcccgtccgtccccgtcggtcnccgttccgttccgttaaccccc

SEQ ID NO: 395549 - DNA, 637 bp, Homo sapiens
  misc_feature: GZ8MTXP01EE04L.51.5.A05.1.454.CMB.2.raw
  modified_base (171)..(171): a, c, t, g, unknown or other
  modified_base (372)..(372): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctctatgagctgacgcagccaccctnagtgtcagtgtctcaggacaaacggcaagatcactgcttggagatgcgttgaccaaagaatctgtctttttggaccatcagacggccaggccaggcccctgtattggtcatctatgatgacaccagccgaccctcggatcctgagagacgcgcgtggcctccgaagggtcaagggacaagtcggccctaccgttgactacncacgtacgggaccagacgtggaacgtagtaggaaagggtacaaccgtaacctaacgttacggtttaacggtttacggaacgtaaggaccaaggtaccgtaaggggttgggttaaacggtcggggtaaggggggttccgttaccgggggaggggaaacggggaacggttaacggtcgttacggaacccggttcgttagggttcgttaccgaacggacccggaacggtcccgtcccggttacccccgttcgggttcccttaacccgg

SEQ ID NO: 395550 - DNA, 603 bp, Homo sapiens
  misc_feature: GZ8MTXP01CRNQR.51.5.A05.1.454.CMB.2.raw
  modified_base (172)..(172): a, c, t, g, unknown or other
  modified_base (219)..(219): a, c, t, g, unknown or other
  modified_base (282)..(282): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccgaggaacaaacggcaaagatcactgcttgganatgcgtagacaaagaatctgtcttttgacatcagacgcagccaggccctgtatgtcatctagngagacaacgaagccgaacccgtccggaactcccgtagaacggagacgtcccgctggcctcgacggtaaccgaaggaaccgaagtcggaccctacttagactactccgacgtacggacccaagagacggaagtagtaggaacgtagaacctaccctagtacgttaacttacggaacaagaccagtacgtaggtaggtacggtacggtacggggtcgtacgggacgggaacgggaacggaagcgtacgaccggtacctagggacgcgaccgaacccgtaaggcccgtcccggtccccgttaccggtccttaaccgttccccgg

SEQ ID NO: 395551 - DNA, 626 bp, Homo sapiens
  misc_feature: GZ8MTXP01B2375.51.5.A05.1.454.CMB.2.raw
  modified_base (215)..(215): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaaagaattctgtctttttaggaccatcagacgccgaggccacggccctgtattggtacatctagtgaggacaccgaacgccgacccgtcggaactccctaggagagacgtcgcgtcggcctcgaggtcgagggaacaagtcgacctacttgactagtcacgtcgggacccagagtggacgtagtaggaacggtcgaacctaaccgtacgttagttaacttacggaacctaggaacgaggtaccaggttagggtacgtcgggaacgggggttcgttcggggacggggaggggacgaagggtcgtacggaccgttccgttggaacggttccgacggttcccgacgggtcctcccggtcccccgttcgggtaccttacccgttccgttcccgttaacccccg

SEQ ID NO: 395552 - DNA, 599 bp, Homo sapiens
  misc_feature: GZ8MTXP01BI50O.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgtctttggagatgcgttgaccaaagaatctgtctttttgaccatcagagccaggccacggccctgtattggtcatctatgagacaccaagccgaccctacggaactccctagagagagtcgcgtcggctcgaggtcagggaacaagtcggacctacgttgactatacgacgtcgggaccagatgggacgagtaggaaaggttcgaactaccgtattaggttactacggaacaggacaaggtcgagggttaggtagtccgggtaagggggttccgtcggggacggggaaggacgaaggtcgtacggaccgttcgacggtacgtcgacggcccgaacggtccgtcccggtcccccgttgggtacccttacccgttccgttcccggttccccccg

SEQ ID NO: 395553 - DNA, 600 bp, Homo sapiens
  misc_feature: GZ8MTXP01ADBEH.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaaagaaattctgtctttttggtaccatcagaggccaggccaggcccctgtattggtcatctatgatgacaccaagcgaccctccggactccctgagagacgtcgcgtggcctcgaacggtcgaagggacaaagtcgggacccaccgtttgactactccgacgtacgggacccagagtagggacgtagtaggaaggtcgaacctaacctacgttacgttagttacggaacgagaacgagacgtaggtggtaacgtcgggtagggggttcgttccgggaggggaagggaacggaaaggtccgttacggtaccgtcgcggttcgttccgaacggacccgaacggcctccgttcccccgtcggccttaacccg

SEQ ID NO: 395554 - DNA, 555 bp, Homo sapiens
  misc_feature: GZ8MTXP01EFD94.51.5.A05.1.454.CMB.2.raw
  modified_base (216)..(216): a, c, t, g, unknown or other
  modified_base (382)..(382): a, c, t, g, unknown or other
  modified_base (433)..(433): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtctttttaggaccatcagaggccaggccacggcccctgtattggtcatctatgaggacaccaagccgacccgtccggaactcccgtaggagagagtcgcgtcggcctacgaggtcaggggaacaagtcggacctacgttgactancacgtcgggacccagatggacgagtagaagtgaactaccatgttatacganaggacagcagtggtagtcggagggggtcttcggggagggacgggacgaaggcgtcggaccgtccgttggacgtcgacggccaagggcacggcccacgtcggttctaaccttcgttaaccccg

SEQ ID NO: 395555 - DNA, 564 bp, Homo sapiens
  misc_feature: GZ8MTXP01ELX1S.51.5.A05.1.454.CMB.2.raw
  modified_base (172)..(172): a, c, t, g, unknown or other
  modified_base (216)..(216): a, c, t, g, unknown or other
  modified_base (310)..(310): a, c, t, g, unknown or other
  modified_base (519)..(519): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctcaggacaaacggcaagatcacctgcttgganatgcgttgaccaaagaatctgtcttttggaccatcagagccaggccaggccctgtattggtcatctatgagacacaagcaccctcggaatcccngagagagtccgcgtggcctccgagggtaccaaggggtaacaaagtcgggaccctaccttgactatccacgtcgggaacccaggagtggaacgtagtaggaaaggtgaacctaccacttagttacttacggggaacaagacagacgaggtggtagtcggagggggttcgttacggggacgggaggggaacgaagcgtacggaccgttcgngacgttcgacgcccgagcctcggcccccttggtccttaacgtccg

SEQ ID NO: 395556 - DNA, 668 bp, Homo sapiens
  misc_feature: GZ8MTXP01DSY6A.51.5.A05.1.454.CMB.2.raw
tcagcgatcgtatacacgaccggtgctcgatttagatagatagacaggggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggcaagatcactgctttggagatgcgttgaccaaagaattctgtcttttaggaccatcagacggcaggccacggccctgtatgcatcatgacgacacaagccgaccctacggactcccgtgagagagtcgctcggcctccgaggtcgaggggaaacaagtcgggaccctaaccgtttcggaaccttacgtacacgggtacggggaaccccaggtaagtcgggaacgtaagttagggaaaagggtctaaaccgtaaccctaagttacggtttaacttaaccgaaccgaagggaaaccgaggtaccgtaaggggttagggtacggtacggggtaacggggggtttaccggtttcggggacgggggtaaacggggaacgaacggcgttacgggaacccgtcgttaggacgtaccgacggcccgaacggtcctacccgtccccgtacggtccttaccttccgttcccggttccccccg

SEQ ID NO: 395557 - DNA, 618 bp, Homo sapiens
  misc_feature: GZ8MTXP01DMK65.51.5.A05.1.454.CMB.2.raw
  modified_base (206)..(206): a, c, t, g, unknown or other
  modified_base (220)..(220): a, c, t, g, unknown or other
tcagcgatcgtatacacgaccggtgctcgatttagatagatagacagggggctgtgggctcaggaggcagagctctgggaatctcaccatggcctggacccctctcctgcctcccccctcctcactttctgcacagtctctgaggcctcctatgagctgacgcagccaccctcagtgtcagtgtctccgaggacaaacggccaagntcactgctttgganatgcgttgaccaaagaatctgtcttttggaccatcagacgccaggccacgccctgtatgctatctagtgagacacacgccgaccctcggaactccgagagagacgtccgcgtgctaccgaggtacgaacgggaacaagtcggaccctaccgttagactactccgacgttcgggaacccagagtcggacgagtaggaagtcgaacctacgtacttagttaacgtacgggaacaaggacaagtaccgtaaggtggttacggtacgtagggggttaccgttgggggaccggaaggggtaacgaacggttccgtacgacccggtaccgtggaccgttccggaccgaacccgaaacgggtcccttacccgggcccccttcgggtaaccccttccgtttccccg

SEQ ID NO: 395558 - DNA, 583 bp, Homo sapiens
  misc_feature: GZ8MTXP01EEN49.51.5.A05.1.454.CMB.2.raw
  modified_base (201)..(201): a, c, t, g, unknown or other
  modified_base (216)..(216): a, c, t, g, unknown or other
  modified_base (555)..(555): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagntcacctgctttgganatgcgttgaccaaagtaaattctgttctttttaggaccatcagacggccaggccacggcccctagtattggtctatctatgacggaacaccaacgccgaccccgtccggaactcccgtaggagacgacgtcgcgtcggcctacgaggtacgagggaaacaagtcggacctaccgttgactactcgacgtcgggaccagagtaggacagtggaaacggtgactacgattagttaatcgaacaaggacgtagacgtaggttaggacgtcggtagggggttacgttcggggacgggagggacgaaggcgtcgaccgtcgttagcgtcacggttccaggtccncgtccccgtgcttacctcgttcgtcccc

SEQ ID NO: 395559 - DNA, 677 bp, Homo sapiens
  misc_feature: GZ8MTXP01BIFFN.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccaggccctgtattggtcatctatgagacacaagccgaccctcggactcccgtgagagagtccgctggctccgaggtacagggcaagtcggacctacttgactatcacgtacggggacccaggagtcgggaacgtaagttagggaaacggttcgaaccttaaccaacgtttaggtttaacttaccggggaacaagggtaaccaggaccgtaagggttcggggtaaggttacccggggtaaggggggggtttccgtttaccggggggaccgggggtaaagggggaaccggtaaacgggttccggtacgggttaaccccgtccggttagggaacggttccgaaccgggccccgtaaaggggcccgttccccgggtcccccccggttacggggttcccgttcccgttttccccgg

SEQ ID NO: 395560 - DNA, 714 bp, Homo sapiens
  misc_feature: GZ8MTXP01BN9MZ.51.5.A05.1.454.CMB.2.raw
  modified_base (219)..(219): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtctttttggaccatcagaggccaggccaggcccctgtattggtcatctatgagacacagcgaccctcggaatcccgtgacgagagtccgctggcctccgaggtcgagggaacaagtcgggaccctaccgtttgaacttagtaccaccgttacgggggaacccccaggaacgttacgggaaaccggtaagttacggggtaaaagggtcggtaaaccttaaccccgtaaacgttaggtttaaaccgtttaccggggaacgtacggggacctagggacctagggttcgggtaggttacgggtaacggggggttccgttaccgggggacggggaacgggggaaccggaaacggttccggtaccgggaaccccgggttcccggttaggaacgggttcccgaacgggtaacccccgaaaggggtccccgtccccgggtcccccccgttcggggtaaccccttaacccgttttcccccggg

SEQ ID NO: 395561 - DNA, 801 bp, Homo sapiens
  misc_feature: GZ8MTXP01EY02X.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttggaccatcagaggccaggccaggcccctgtattggcatctatgaggacacagccgaccctcggaactccctagagacgagtccgctacggctaccgaggtaccgaaggggaacaaagtcgggaccctaccgtttggaaccttatacccgtaacgttcggggaacccccaagggtaacgtacggggaaccgtaaggtacgggtaaacgggttacggaaacccttaacccgtaacgtttacggtttaaacgtttacccggggtaaaccgaaacgggttaaccgaacgggtaccggtaaacgggtttagggggttaaaccgggttaccgggggttaaacggggggggtttccccgttttaccgggggggaaccgggggtaaacggggggtaaaccgggaaaacggggttcccggttaccggggttaaccccgggtttaccggttacggggaaaccggtttcccggaaccgggaacccccggtaaaacggggtccccgttaccccgggggtcccccccccgttacgggggttcccccttaaccccggttttccccccgg

SEQ ID NO: 395562 - DNA, 591 bp, Homo sapiens
  misc_feature: GZ8MTXP01DDGJ8.51.5.A05.1.454.CMB.2.raw
  modified_base (218)..(218): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgcttgganatgcgttgaccaaagaatctgtcttttggaccatcagaggccaggccaggcccctgtattggcatctatggagacaacaacgccgacccgtcggaactccctgagagacgtccgcgtggctccgaggtacagggaacagtcgggccctacgttgaacgtatccgacgtcgggaccaggagtcggacgaagtacggaaggtacgaccttacgtactagttaacttcggacgtagacctagcgtaggtggtagtacgggacgggggttcgtaccggggacgggagggaacgaagccgtacgccggtccgtaggcgttccgacggtaaccccgaagtccgtcccggtcccccgttggtcccgttaacctttccccg

SEQ ID NO: 395563 - DNA, 608 bp, Homo sapiens
  misc_feature: GZ8MTXP01AGPB2.51.5.A05.1.454.CMB.2.raw
  modified_base (220)..(220): a, c, t, g, unknown or other
tcagcgatcgtatacacgaccggtgctcgatttagatagatagacagggggctgtgggctcaggaggcagagctctgggaatctcaccatggcctggacccctctcctgcctcccccctcctcactttctgcacagtctctgaggcctcctatgagctgacgcagccaccctcagtgtcagtgtctccaggacaaacggccaagatcacctgctttgganatgcgttgaccaaagaatctgtcttttggaccatcagaggccaggccaggcccctgtattggtcatctatgagacacagccgaccctcggatcctgagagagtccgctggctcgaggtacagggaacaagtcggaccacttgactatcacgtcgggacccagatgggacgaagtggaaagggtcgaacctaccgtacttagtttaacgtcgggaactaacggacaaggccgtaaggttgggtaacggttacgggaggggggttccgttacgggggacgggtaagggggaaccgaacggcgtacggttaacccgttcgtacggttacggttcgaccggtccccgaagggcccttcccggacccccgttcggtcccttaaccgttccccg

SEQ ID NO: 395564 - DNA, 542 bp, Homo sapiens
  misc_feature: GZ8MTXP01AMSRF.51.5.A05.1.454.CMB.2.raw
  modified_base (169)..(169): a, c, t, g, unknown or other
  modified_base (427)..(427): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttggagatgcgttgaccaaagaatctgtctttttggaccatcagaggccaggccaggcccctgtattggtcatctatgaggacaccaagccgaccctcggaactccctgagagagtcgctcggctcgaggtcaggggaacaagtcggacccaccttgactatcgactcgggacccaggatgggacgagtagaaggtgacctacacgttgttatcganaggacaggcaggtggtaggtcggagggggttctcggggcggagggacgaggctcggaccgtccgttgacgtcgacgcccgaggcctcgccccctggtccactcgttcgttccccg

SEQ ID NO: 395565 - DNA, 584 bp, Homo sapiens
  misc_feature: GZ8MTXP01B9V6N.51.5.A05.1.454.CMB.2.raw
  modified_base (216)..(216): a, c, t, g, unknown or other
  modified_base (306)..(306): a, c, t, g, unknown or other
  modified_base (316)..(316): a, c, t, g, unknown or other
  modified_base (320)..(320): a, c, t, g, unknown or other
  modified_base (531)..(531): a, c, t, g, unknown or other
  modified_base (558)..(558): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctcaggacaacggccaagatcactgctttgganatgcgttagaccaaagaatctgtctttttggaccatcagaggccaggccacggcccctgtattggtcatctatgagacacagccgacccncggaactccngagngagtccgctggctcgaggtacagggaacagtcggaccctacgttgaactactcgacgtcgggaccaggagtagggaacgagtaggaaggttacgactaacccgtaacgttagttacttacggggacaaacggaccgaaggctaaggtcgggtaggtacgggagggggttccgtggggacgggagggaaccgaaggccgtcgaccggtccgnggacgttcgacgaacccgagggtcccncggtccccgttcgtccttcccgtccg

SEQ ID NO: 395566 - DNA, 549 bp, Homo sapiens
  misc_feature: GZ8MTXP01A7YR2.51.5.A05.1.454.CMB.2.raw
  modified_base (483)..(483): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagacggcaggcaggccctgtatggtcatctatgagacaccaagcgacctccggaatcccgtgagagagtcgcgtcggctcgaggtcgaggaacaagtcggccacttgactatcacgtcgggacccagatgggacgataggaagtgtactacacgtgttactagacaggacagcaggtgtaggtcgaggggttctcggggcggaggggacaaggcgtacgttccggtaccgnggacgtcgacggccccgaagggccctccggcccccgttggccttacggttccgttcgggttccccc

SEQ ID NO: 395567 - DNA, 510 bp, Homo sapiens
  misc_feature: GZ8MTXP01B8WM4.51.5.A05.1.454.CMB.2.raw
tcagcgatcgtatacacgaccggtgctcgatttagatagatagacaggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaaagaaatctgtctttttggaccatcagaggccaggccaggcccctgtattggtcatctatgaggacaccaagcgaccctccggaatccctgagagagtcgctcggctcaggtcagggaacaatggccaccttgactatcactgggacccagatggacgatgaaggtgactacactgttatcgacaggacagcagtgtagcgaggggtctgggcggagggcgaagcgtgaccgtccttgacgtcgacgccaaggctcgcccctggtccactccgttcgttccccg

SEQ ID NO: 395568 - DNA, 665 bp, Homo sapiens
  misc_feature: GZ8MTXP01EQGY4.51.5.A05.1.454.CMB.2.raw
  modified_base (216)..(216): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtcttttgacagtcggagcaggccaggccctgtattggcatctatgaggacacaagccgaccctcggaactcccgtgagagacgtcgcgtcggccctccgaggtcgacgggaacaaacgtcgggccctaccgtttagaccttatcccgaacggtcgggaacccgagtacgtagggaacgagtagggaaaggtacgtaaccttaaccgtacgtttagttaacgttacgaacacggaaccgtaggtaccgtaagggttgggtaggtccggggtaacggggggtttcgttaccgggggacggggtaacggggaacggaacggtcgtaacgggtaaccgttccgtaggttacgtccgaacggcccgaacggttcccgtaacccggtccccgtaacgggtccctccgttcccgttcccggttccccgtcccccg

SEQ ID NO: 395569 - DNA, 549 bp, Homo sapiens
  misc_feature: GZ8MTXP01C65US.51.5.A05.1.454.CMB.2.raw
  modified_base (284)..(284): a, c, t, g, unknown or other
  modified_base (310)..(310): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaaatctgtcttttggacatcagagccaggccaggccctgtatgcatctangagacacagcaccctcgatccagagngagtccgctgctacgaggtacagggaacaagtcgacctacgttgactatcacgtgggacccagagtggaacgagtaggaaggtcgaactaccacttagttactcggaacagaacagcgtaggtggtaggtacggtagggggttcgtcgggacgggagggtaacgaacgttcgtacggaccgtccgtagacgttcgacgaacccgaaggtccgtccgccccgttcggtcaaccgttcccg

SEQ ID NO: 395570 - DNA, 530 bp, Homo sapiens
  misc_feature: GZ8MTXP01AFDT5.51.5.A05.1.454.CMB.2.raw
  modified_base (204)..(204): a, c, t, g, unknown or other
  modified_base (422)..(422): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagntcacctgctttggagatgcgttgaccaaagaatctgtctttttggaccatcagaggccaggccaggccctgtatggtcatctatgagacaccagccgaccctccggaactccctgagagacgtccgctggctccgaggtacagggaacagtcggcaccttgactatcacgtggacccagagtggacgataggaaggtcgacctacactgttatcgganagacagcagtggtagtcggaggggtctcgggcggagggaacgaagttcgtgaccgtctggacgttcgacgcccgaaggccgtccgccccgttcggtccaacgttcccg

SEQ ID NO: 395571 - DNA, 536 bp, Homo sapiens
  misc_feature: GZ8MTXP01BLUZJ.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgctttttggacatcagagcaggccaggcccctgtattggtcatctatgaggacaccaagcgaccctccggaatccctgagagagtcgctggctcaggtcagggaacaatggccactgactatcacgtgggacccagatggacgagtgaaggtgactaccatgttattacgacaggacagcaggtggtgtcggagggggtcttcgggcgggaggggacgaagcgttcgaccggtccgttggaagtcgagttcccaagggtcctccggccccctcgggtccaccgttccgttccgttccccccg

SEQ ID NO: 395572 - DNA, 585 bp, Homo sapiens
  misc_feature: GZ8MTXP01CTFHR.51.5.A05.1.454.CMB.2.raw
  modified_base (169)..(169): a, c, t, g, unknown or other
  modified_base (281)..(281): a, c, t, g, unknown or other
  modified_base (304)..(304): a, c, t, g, unknown or other
  modified_base (356)..(356): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaaagatcacctgctttggagatgcgttgaccaaaagtaatctgtctttttagacatcagagcagcaggccctgtatgcatctangagacacagcaccctcgaatccngagagagtcgctcggctcgaggtcaagggaacaagtcgacctactagactancgacgtacgggacccagacgaggacgagtagaagtacgaactaaccacttagttaatacgacaagacagcgaggtggtagtacggaggggttcgtcgggacgggaagggaccgaaaggtcgtacggaccggtccgttaggacggtaccgaaccggccgaaacgggtcccgtacccggtcccccgttaccgggtacccttaccgttcccggttcccgtttaacccccccg

SEQ ID NO: 395573 - DNA, 554 bp, Homo sapiens
  misc_feature: GZ8MTXP01DCH1L.51.5.A05.1.454.CMB.2.raw
  modified_base (173)..(173): a, c, t, g, unknown or other
  modified_base (177)..(177): a, c, t, g, unknown or other
  modified_base (204)..(204): a, c, t, g, unknown or other
  modified_base (218)..(218): a, c, t, g, unknown or other
  modified_base (376)..(376): a, c, t, g, unknown or other
tcagcgatcgtatacacgaccggtgctcgatttagatagatagacaggggggctgtgggctcaggaggcagagctctgggaatcgtcaccatgggcctggacccctctcctgctcccctcctcactttctgcacagtctctgaggcctcctatgagctgacgcagccaccctnagtntcagtgtctcaggacaaacggccaagntcactgtcttgganatgcgttgacaaagtaatctgtcttttggacatcagacgcagccaggccctgtatgtcatctatgagacaacacgccgaccctacgaactccctgacgcgacgtccgacgtcgctaccagggtaccagggtaacaagtcggaccctacgttgacttanccgacgtcgggaaccctagagtaggacgagtcggaagtcgacctacgtagtagttactcggactagacgagctaaggtggtacgtacgggtaggggtctcgggacggtaggaacgagcgtacgcgtccgtgacgttcgacgtcccgaagtccgtaccgccccttcggcttcccttccg

SEQ ID NO: 395574 - DNA, 678 bp, Homo sapiens
  misc_feature: GZ8MTXP01BZ4VB.51.5.A05.1.454.CMB.2.raw
  modified_base (278)..(278): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttggacatcagagcaggccaggcccctgtatgtnatctatgagacaccacgccgaccctcggaactcccgtagagagcgtcgcgtggctccgagtacgaacgggaacaagtcgggaccctaccgttagactattccacgttacggggaaccccaggagtacgggaacgtaagtaggtaaacggtcgaaccttaacccgtacgttacgtttaacgtacggggaacgtacggggacctaaggtaccgtagggttggggttacggtaccgggggttaagggggttcccgggttacggggaccgggggaagggggaaaccggaacggttccggttaccggttacccggtacgtcgggttaccggttccgaccggtaaccccgaaccgggtccctccccgggtccccccgttccgggttccttaacccgttttccccgg

SEQ ID NO: 395575 - DNA, 499 bp, Homo sapiens
  misc_feature: GZ8MTXP01BNW9F.51.5.A05.1.454.CMB.2.raw
  modified_base (213)..(213): a, c, t, g, unknown or other
  modified_base (359)..(359): a, c, t, g, unknown or other
  modified_base (406)..(406): a, c, t, g, unknown or other
  modified_base (464)..(464): a, c, t, g, unknown or other
tcagcgatcgtatacacgaccggtgctcgatttagatagatagacaggggtgggctcaggaggcagagctctgggaatctcaccatggcctggacccctctcctgctcccctcctcactttctgcacagtctctgaggcctcctatgagctgacgcagccaccctcagtgtcagtgtctccaggacaaacggccaagatcacctgctttgganatgcgttgccaaaagaaatctgtctttttggaccatcagaggccaggccaggcccctgtattggtcatctatgaggacaccaagcgaccctccggaatccctgagagagtcgctggctcaagtcaggaacaatggcacttgactancactgggacccagatggacgatgaaggtgactacgactgtattcganaggacagcagtgtagcgagggggtctcggcggagggacgaagctgacgtcttgagtcngccaaggctcgcccctcggcactccttcgttcccc

SEQ ID NO: 395576 - DNA, 666 bp, Homo sapiens
  misc_feature: GZ8MTXP01A6I0P.51.5.A05.1.454.CMB.2.raw
  modified_base (249)..(249): a, c, t, g, unknown or other
  modified_base (276)..(276): a, c, t, g, unknown or other
  modified_base (361)..(361): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccgaggacaaacggcaagatcacctgctttggagatgcgttgaccaaagaatctgtcttttgacatnagagcagcaggccctgtatgcatctangagacacagccgacccgtcggaactccgtgagagagtcgctcggcctcgaggtcgagggaacaacgtcggacctacgttgactanccgacgtacgggacccaggagtacgggacgtagtagggtaaacggtacgaaccttaaccgtacgttacggttaacttacggaactacggggaacgtagggtaccgtaagggttagggtaacggtcggggtaacggggggtttccggttcgggggaaccggggtagggggaaccgtaacgggcgttaccgggttaccggttacccgttgggaaccggtccgaaaccgggcccgaacggggtccccttcccgggtcccccgtttcggggtaccttacccgtttcccgttaacccggtttcccccccg

SEQ ID NO: 395577 - DNA, 602 bp, Homo sapiens
  misc_feature: GZ8MTXP01D11EA.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaaagatcacctgctttggagatgcgttagaccaaaagtaatctgtctttttaggaccatcagagcagcaggccctgtattggtcatctatgacgacaccaagccgaccctcggaactccctgagagagtcgcgtcggcctcgaggtcagggaacaagtcggaccctaccgtttgaactatcgacgtcggggacccagagtggacgagtagaaaggtcgaactacctacgtagttaacttacggacacgggacaggactagggtaggtacgtcggtagggggttcgttcgggagggacgggacgaaggtcgtggttaacccggtccttggacgttcgaacggttcccgaacggtccgtaccgtcccccgtgggttcccaccgtttccgttcccggtttaacccccg

SEQ ID NO: 395578 - DNA, 603 bp, Homo sapiens
  misc_feature: GZ8MTXP01DVI3U.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgcgtttggagatgcgttgaccaaagaatctgtctttttaggaccatcagacggcaggccacgccctgtattgcatctatgagacaccgaagccgaccctacggaactcccgtagacgagacgtcgcgtacggcctacgaggtacagggaaacaagtcggacctaccgtgactagtcgacgtacgggaccagacgtaggacgagtaggaaacggtcgtaacctactattaggttaactacgaaccgagaacgaggtactagggtggtaaggtcggtagggggttacgtcggggacgggaaggggaccgaaggtcgtacggttaccggtccttaggacgtacgacgccgaacggcccgtaccgccccgttggaccttccgttcgttcccggttccccg

SEQ ID NO: 395579 - DNA, 606 bp, Homo sapiens
  misc_feature: GZ8MTXP01ERTSB.51.5.A05.1.454.CMB.2.raw
  modified_base (172)..(172): a, c, t, g, unknown or other
  modified_base (216)..(216): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggcaagatcactgcttgganatgcgttagaccaaagtaatctgtctttgacatcagagcagccacgccctgtatgtcatctatgacgacaacgaagccgaccctacggaactcccgtagagagacgtcccgcgtcggctaccgaggtaaccaagggaactaagtcggaccctacgttacgactacgtccgacgtcgggaacccaggacgtggaagtaagtaggtaaggtacaactacctaacgttagtttaacgtcggaaacgtaaggaacctaggcgtaaggttacgggttaggtccgggtaagggggttccgttacggggacgggaagggaacgaaacggttcgtacggttaccgtcgtaggacgttcgacgcccgagccgtccgccccgttgtccttaacgttcccg

SEQ ID NO: 395580 - DNA, 641 bp, Homo sapiens
  misc_feature: GZ8MTXP01DQEO5.51.5.A05.1.454.CMB.2.raw
  modified_base (172)..(172): a, c, t, g, unknown or other
  modified_base (213)..(213): a, c, t, g, unknown or other
  modified_base (453)..(453): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctcaggacaacggcagatcactgcttgganatgcgttagacaaagaatctagtcttttggaccatcagaggcaggccagccctgtatggtcatctatgagacacagcgacccctcggatcctgagagacgtccgctggcctccgagggtaaccgagggaacaaagtccgggacccaccgttagacttagcctacgtcggggaccctagacgtgggaaccgtagtagtaaggtacgaaccttaccacgtttagttaacttcggggaaaccnggaaaccgagtaccgtaaggtcggtaaggtcggtaagggggttccgttacgggacggggacggggaacgtaaacggccgtacggttaaccccggttccgttagggacggttccgaaaccgggccccgtaaacgggtcccgtttaaccccggccccccgttacggggttcccttaaccgttttccccgg

SEQ ID NO: 395581 - DNA, 570 bp, Homo sapiens
  misc_feature: GZ8MTXP01CF4EH.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtctttttggacatcagagcaggcagccctgtatggtcatctatgagacaccaacgccgaccctccggaactcccgtagagagagtcgctcggctcgaggtcagggaaacaagtcggcctaccgttgactactcgacgtacgggacccagagtaggacgagtaggaaggtacgactacctagttacgttattacgactaggacgagtcgaggtacggtagcggtaggggtcgtacgggcgggagggacgaggcgtcggaccgtcgttaggacgtcgacgccgacggtcctccggtccccttcggtccttaccgtttccgttccccttaaccccg

SEQ ID NO: 395582 - DNA, 536 bp, Homo sapiens
  misc_feature: GZ8MTXP01BKSYA.51.5.A05.1.454.CMB.2.raw
  modified_base (476)..(476): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggcaggccaggcccctgtattggtcatctatgagacacaagcgaccctcggaactccctgagagagtcgctcggctcgaggtcaggggaacaagtcggccaccttgactatcacgtcgggacccagatggacgatggaaggtgactaccactagttatacgacaggacagcgaggtggtagcgtagggggtctgggcgggagggacgaggctcggccgtcgngtacgcgacgttcccgaacggccgtccgcccccgtcggtccacgtccgttccgttccccc

SEQ ID NO: 395583 - DNA, 658 bp, Homo sapiens
  misc_feature: GZ8MTXP01AXT4Q.51.5.A05.1.454.CMB.2.raw
  modified_base (414)..(414): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagcccaccctcagtgtcagtgtctccgaggacaaacggccaagactcacctgtctttggagtatgcgttagaccaaaagtaatctgttcgtttttaggaccatcaggacggccgaggccgacggccctagttacgttggtctatctagtacggaacggaccaaccgtaacggccgtaaccccgtacggaactccgtaggagacgagtcgcgtcgcctacgaggtcgaggaacaagtcggacctactagaccttanaccgacgtacgggaccaggagtacggacgagtaggaaggtcacgtacctagttattactacgaacagggtacagcgtaggtaggtacggtacggtacgggggttcgtacgggacggggaacgggtaccgaagggtcgtaaccgttccggttacgaggtacggaccgaccggttcccggaacggtccctacccggtcccccggttacgggtccttacccggttccccttaaccccgttcccccgg

SEQ ID NO: 395584 - DNA, 623 bp, Homo sapiens
  misc_feature: GZ8MTXP01EC7R4.51.5.A05.1.454.CMB.2.raw
  modified_base (170)..(170): a, c, t, g, unknown or other
tcagcgatcgtatacacgaccggtgctcgatttagatagatagacaggggggtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggcaagatcacctgctttggagatgcgttgaccaaaagaatctgtctttttaggaccatcagaggccaggccacggccctgtattggtcatctatgacgacaccaagcgaccccgtcggactccctgagagagtcgctcggctacgaggtcgagggaacaagtcggcctaaccgttgactatccgacgtacgggacccagagtggacgtagtaggaaggtcgaacctaccgattcgttaattacgaacaggggaacaggtaccgtagggttaggtacggtcggtaaggggggttcgttcgggggacgggaaggggacgaaggtccgtacggttaccggtcgttaggacgttaccgacggttcccgaacgggcccgttcccggtcccccgttcgggtcccttaccgttcccgttcccgttttaacccccc

SEQ ID NO: 395585 - DNA, 628 bp, Homo sapiens
  misc_feature: GZ8MTXP01CN02N.51.5.A05.1.454.CMB.2.raw
  modified_base (215)..(215): a, c, t, g, unknown or other
  modified_base (311)..(311): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgtgaccaaagaatctgtcttttgacatcagagccaggccacggccctgtattggcatctatgacgacaccagccgacccgtacgactcccgngagagagtcgcgtcggcctcgaggtcgagggaacaagtcggacctaccttgactacgtacacgtacgggaccctaggactgggaacgagttagaaggtacgacgtacctacgttagttaacgtacgactacggacgagcgtaggtcggtaacggcggtagggggtccgttacggggacgggagggaacggtaaggccggtcggttacccggtccgttagggtaaactccggaaccggccccgttaaacgggtccctcccgggtcccccccgttcggggtaccccttacccgtttcccggttccggtttccccccccg

SEQ ID NO: 395586 - DNA, 582 bp, Homo sapiens
  misc_feature: GZ8MTXP01CVF2V.51.5.A05.1.454.CMB.2.raw
  modified_base (169)..(169): a, c, t, g, unknown or other
  modified_base (216)..(216): a, c, t, g, unknown or other
  modified_base (224)..(224): a, c, t, g, unknown or other
  modified_base (277)..(277): a, c, t, g, unknown or other
  modified_base (292)..(292): a, c, t, g, unknown or other
  modified_base (299)..(299): a, c, t, g, unknown or other
  modified_base (510)..(510): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttgganatgcgttnaccaaagaatctgtcttttgacatcagacgcaggccacggcccctgtatggcntctatgagacacgancgacccncggaactccctagagagacgtcgcgtcggctcgagtcgaagggaacaagtcggacctactcgactatcacgtcgggacctagagtcggacgtagtaggaaggttacgaacctacgtactagttacgtcgacaggacagcgtagggtgtaggtcggtagggggtccgttggggacgggaacgggaacgaggtcgttcgggacccgtttccgngggtagtaccgcggacccgaacggtcctcccgtcccccgttggaccttccttcggttaacccgtttcccccg

SEQ ID NO: 395587 - DNA, 733 bp, Homo sapiens
  misc_feature: GZ8MTXP01BI793.51.5.A05.1.454.CMB.2.raw
  modified_base (168)..(168): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctnagtgtcagtgtctccaggacaaacggccaagatcacctgctttggagatgcgttgccaaagtaatctgtctttttggaccatcagagccaggccaggccctgtatggtcatctatgacggacacagcgaccctcggatccctgagagagtcgctcggcctcgaggtccaggggaaacaacgtcggaccctaccgttgacctaatccgaacgtcggggaacccaggagtgggaaccgagttacgggaaaggtcgtaaccgtaacccgaacgttacggttaactttacgggaccaaaggggtaacccgaaggtaccgtagggttaaggggttaaccggttcgggtaaacgggggggtttccgtttaccggggggtacgggggtaaacgggggtaaccgggaaagggtccggttaaccgggttaccccgggttacccgttacgggtaaacggtcccggttaaacgggttcccccggaaaacgggtccccgtttaccccgggccccccccgtttaccgggggtccccttaaccccgtttcccgttaaccccggttttaaccccccccgg

SEQ ID NO: 395588 - DNA, 594 bp, Homo sapiens
  misc_feature: GZ8MTXP01APA1B.51.5.A05.1.454.CMB.2.raw
tcagcgatcgtatacacgaccggtgctcgatttagatagatagacagggggtgggctcaggaggcagagctctgggaatctcaccatggcctggacccctctcctgtcctccccctcctcactttctgcacagtctctgaggcctcctatgagctgacgcagccacctcagtgtcagtgtctccaggacaaacggcaagatcacctgctttggagatgcgttgaccaaaagaattctgttctttttaggaccatcgagacggccacggccacggcccctgtagttggtcatctagtgacggacaccaagccgaccctacggaactcccgtgagacgagtcgctcggctcgaggtcgaggaacaagtcggacctacgtgactagtcacgtacgggaccagagtggacgagtagaaggtacactacagttgttactacgactaggacagcgaggttggtacgtcgggtaggggttcgtcggggcgggtaagggaacgaaggtcgtacggacccggttcgaggtacgtaccgacggcccgttacgggtccctaccggcccccgttaggtccgttaccgtcccgttccgttccccccg

SEQ ID NO: 395589 - DNA, 590 bp, Homo sapiens
  misc_feature: GZ8MTXP01BMFTO.51.5.A05.1.454.CMB.2.raw
  modified_base (171)..(171): a, c, t, g, unknown or other
  modified_base (216)..(216): a, c, t, g, unknown or other
  modified_base (224)..(224): a, c, t, g, unknown or other
tcagcgatcgtatacacgaccggtgctcgatttagatagatagacagggggctgtgggctcaggaggcagagctctgggaatctcaccatggcctggcccctctcctgcctccccctcctcactttctgcacagtctctgaggcctcctatgagctgacgcagccaccctnagtgtcagtgtctcaggacaaacggcaagatcacctgctttgganatgcgttnaccaaagtaatcttgtctttttggacctatcgagacggccaggccaaggcccctgtattggtcatctatgacgacacagccgaccctcggaactccctagacgagagtccgcgtggctccgaggtacgagggcaagtcggaccacttgactagtcacgtgggacccaggatggacgagtagaacggtcaaccgttaccagttagttacgttacgggaactagacacggcagggtggtacggtcggagggggttccgttacggggcgggagggaacgaaggttcgtacggacccgttcgtaggacgttcgaccggaacccgaagggccttccccggaccccgttcgtcccgttaaccgtttccccgg

SEQ ID NO: 395590 - DNA, 549 bp, Homo sapiens
  misc_feature: GZ8MTXP01DH8F6.51.5.A05.1.454.CMB.2.raw
  modified_base (500)..(500): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttgaccatcagagcagccagccctgtattggtcatctatgagacaccaagccgaccctccggaactcccgagagacgagtcgcgtcggactacgaggtacgaggggaaacaagtcgggcccaacccgtttgactactcacgtcgggacccagatgggacgatagaaaggtgaactacgacttagtattacgacaggacagacaggtaggtaggtcggtaggggtcgttcgggacgggagggacgaagcgtgaccgtcgngacgtcgacgccgaaggcctcgccccgtcggtcacctcgttcgtccccg

SEQ ID NO: 395591 - DNA, 664 bp, Homo sapiens
  misc_feature: GZ8MTXP01CGYEO.51.5.A05.1.454.CMB.2.raw
  modified_base (173)..(173): a, c, t, g, unknown or other
  modified_base (183)..(183): a, c, t, g, unknown or other
  modified_base (282)..(282): a, c, t, g, unknown or other
  modified_base (288)..(288): a, c, t, g, unknown or other
  modified_base (333)..(333): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccaccctnagtgtcagtntctcaggaacaaacggcaagatcacctgctttggatatgcgttagaccaaagaattctgtcttttggacatcagacgcacggcacgccctgtagtgtanatctangacgacaacacgccgaccctacggaactcctaggagagacgtccncggtgctaccgaggtaccgaagggaactaagtcgggaccctaccgtagtaccgtataccgtacgacgggacccaagtacgacggtaacgagtacgggtaaggtaccgtaaacctaccgtaacttacggtttaacttacgggaaccgagaaccgaggacgtaaggtacgggtacggttacggggtacgggggttcggtaccgggggacgggaacggggaaacggacgttaccggttcggaacccggtttcggacgttaccggcgaacccggcccggaaaccgggtcccgttcccggacccccggttcgggtcccgttaaccctttcccccgg

SEQ ID NO: 395592 - DNA, 656 bp, Homo sapiens
  misc_feature: GZ8MTXP01BXZXC.51.5.A05.1.454.CMB.2.raw
  modified_base (215)..(215): a, c, t, g, unknown or other
  modified_base (224)..(224): a, c, t, g, unknown or other
tcagcgatcgtatacacgaccggtgctcgatttagatagatagacaggggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggcaagatcactgctttgganatgcgttanaccaaagaatctgtctttttggacatcagagccgaggccacggccctgtattggtcatctatgaacggacaccgaagccgtacccctaccggaaactccccgtaggagacgacgtcgctcggcctacggagggtcgaacggggaaacaaacgtcgggaccctaaccgttagaacctaagtccgaacgttacggggaaccctagagtacgggaacgtagtaggtaaacggttcgaaccttaccgtacgttgttaacttacgaacaagggactaggacgtaggtaggtaacggtcgggtaggggggttaccgtacggggacggggtaaggggacgaaacgggtccgtacggttaccggtccgttagggaccgtacgaccgttaccgacggtccgtcccgcccccgtgggccttaccgttccgttccgttccccc

SEQ ID NO: 395593 - DNA, 498 bp, Homo sapiens
  misc_feature: GZ8MTXP01EWEBP.51.5.A05.1.454.CMB.2.raw
  modified_base (172)..(172): a, c, t, g, unknown or other
  modified_base (202)..(202): a, c, t, g, unknown or other
  modified_base (217)..(217): a, c, t, g, unknown or other
  modified_base (256)..(256): a, c, t, g, unknown or other
  modified_base (462)..(462): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctcaggacaaacggcaagntcacctgctttgganatgcgttgaccaaaagaatctgtcttttggaccatcagngcagccaggccctgtatgtcatctatgagacaccaagcgaccctcggaatccctagagagacgtccgctggctcgaggtcagggcaatggcccacttgactatcactcgggaccagatggacgatagaggtcactacactgttaatcggacaggacagcaggtggtagtcggaggggtctgggcggagggaacaagctgaccgtcngacgttcacgccaggctcgcccgttgcttcgtcccg

SEQ ID NO: 395594 - DNA, 550 bp, Homo sapiens
  misc_feature: GZ8MTXP01E4D4H.51.5.A05.1.454.CMB.2.raw
  modified_base (250)..(250): a, c, t, g, unknown or other
  modified_base (253)..(253): a, c, t, g, unknown or other
  modified_base (260)..(260): a, c, t, g, unknown or other
  modified_base (272)..(272): a, c, t, g, unknown or other
  modified_base (278)..(278): a, c, t, g, unknown or other
  modified_base (389)..(389): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagcccaccctcagtgtcagtgtctccaggacaaacggccaagatcacctgctttggagatgcgttgaccaaagaatctgtcttttgacatnagngcaggcngccctgtatgtnatctangagacacagcgacctcggaactcccagagagagtcgcgtcggcctacgaggtaccgagggaacaagtcggacctacgtgactatcacgtacgggaccagagtaggacgagngaaaggtgacctacactgttaactacgacgagacagcgagtggtagtggaggggtcgtcggggcggaggacgaagtcgtacgccggtccgttgacgtcgacggttacccgaggtcccgaccggtcccccgtacggtccttacctcccgttcccgttccccc

SEQ ID NO: 395595 - DNA, 680 bp, Homo sapiens
  misc_feature: GZ8MTXP01ATVH1.51.5.A05.1.454.CMB.2.raw
  modified_base (214)..(214): a, c, t, g, unknown or other
tcagcgatcgtatacacgaccggtgctcgatttagatagatagacagggggtgggctcaggaggcagagctctgggaatctcaccatggcctggacccctctcctgcctccccctcctcacttttctgcacagtctctgaggcctcctatgagctgacgcagccacctcagtgtcagtgtctccaggacaaacggcaagatcactgctttgganatgcgttagacaaaagaattctgtctttttagactatcagagcagccaggccctgtatgtcatctatgacgacacagcgacctcggatcctgagagacgtcgcgtcggctacgaggtacgagggaactaacgtcgggaccctaccgttacgactactccgaacgtcggggaaccctaggacgttagggaacgtagtaacggtaaacggtacgtaaaccttacccgtaacgttacgttaagttaccgaacgaaacggggtaacgaacggtaccggtaaagggttacggggttaaacggttccgggtaaacggggggttcccgggttacggggtaccgggggaagggggtaaaccggtaacggtccggtaacggttaccggtcgttacggtacgtccggacggacccgttacggtcccgtccggcccccgttcgggtcttacccgggttccttcccggtttccccccg

SEQ ID NO: 395596 - DNA, 609 bp, Homo sapiens
  misc_feature: GZ8MTXP01D72IX.51.5.A05.1.454.CMB.2.raw
  modified_base (217)..(217): a, c, t, g, unknown or other
  modified_base (359)..(359): a, c, t, g, unknown or other
  modified_base (397)..(397): a, c, t, g, unknown or other
tcagcgatcgtatacacgaccggtgctcgatttagatagatagacaggggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcaacctgctttgganatgcgttgaccaaaagaaatctgtctttttggtaccatcagaggccaggcaggccctgtatggtcatctatgaggacacaagccgaccctccggaatccctgagagagtgctggctcaggtcgaggaacaatggccacgttnactatacactgggacccagagtggacgagtagggaaanggtacgaactacctacgttacgttacgttacggacgaacgacgacgacgtaggtagggttacggtacgggtacggggttacgggttacggggtcggggacgggggaacgggaacggacggtcggttacccggtaccgtacggttacggttcggaccggaacccggaccggtccgtcccggtccccggttacccggtcccgttcccgttcccg

SEQ ID NO: 395597 - DNA, 539 bp, Homo sapiens
  misc_feature: GZ8MTXP01EM8AE.51.5.A05.1.454.CMB.2.raw
  modified_base (318)..(318): a, c, t, g, unknown or other
  modified_base (368)..(368): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaaagaaattctgtctttttggaccatcagaggccaggccaggcccctgtattggtcatctatgaggacacaagcgaccctcggactcccngagagagtcgctcggctcgaggtcaggaacaatcggcctacgttgactancacgtcgggacccagatggacagtgaaggtcactaccattgttatcgacaggacagcgagttggagtcggagggggttcgttcggggcgggtaagggacgaaggtcgtacggccgtccgttgacggtcacggcccgaggcctcgccccgtggccacgtcgttcgtcccccg

SEQ ID NO: 395598 - DNA, 624 bp, Homo sapiens
  misc_feature: GZ8MTXP01BD1G0.51.5.A05.1.454.CMB.2.raw
  modified_base (171)..(171): a, c, t, g, unknown or other
  modified_base (301)..(301): a, c, t, g, unknown or other
tcagcgatcgtatacacgaccggtgctcgatttagatagatagacaggggggtgggctcaggaggcagagctctgggaatctcaccatggcctggacccctctcctgcctccccctcctcactttctgcacagtctctgaggcctcctatgagctgacgcacgccaccctnagtgtcagtgtctccaggacaaacggcaagatcacctgtctttggagtatggcgttagaccaaaagtaattcgttgttctttttaggacctatcaggacggccaaggccacggcccctgtattggctatntatgacggacaaccgaacgccgacccgtccggaactcccgtaggacgagtacgtcgcgtcggcctcgaggtcgaggaacagtcgcctactgactagcacgtacgggaccagtagtggaacgagtcggaaaggtcgaaccgtaccagttagttacttacgggaactacgggacaggaccgtagggtggtaacggtcgggtagggggttcgttacggggcgggtaagggacgagggctcggttaccgtcgttacgagtccgacggcccgttaaggtccctccggtcccccgtgggtcccttacgtccgttccccggtttcccccg

SEQ ID NO: 395599 - DNA, 728 bp, Homo sapiens
  misc_feature: GZ8MTXP01CWT0K.51.5.A05.1.454.CMB.2.raw
  modified_base (251)..(251): a, c, t, g, unknown or other
  modified_base (698)..(698): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagactcacctgtctttggagatgcgttagaccaaagaatctgtcttttagacngtcggagcaggcacggccctgtatggtcatctatgaggacaccgacgccgacccgtaccggaactcccgtggaacgacggtacgtcgcgtcggcccctccggagggtcgaacggggacaaacgttcgggccctacgttacgactacgtaccgacggtacgggaacccagtacgtggaaacggtaagtacgggtaaacgggtctaaacctaccgtacgttacgttaacgttacggaacgaacgaaacggtacggtaaccggttaagggttacgggtacggggtttaccgggtacggggggtttaccggtttaccgggggaccgggggaaacgggggtaaccggaaacgggttccgtaacgggtaacccggttccgggtacggttacgggtaccggaaccgttaccccgggaacgggttcccgttcccgggcccccgttcgggttaccncccgtttcgttccccggttccccgtccccg

SEQ ID NO: 395600 - DNA, 592 bp, Homo sapiens
  misc_feature: GZ8MTXP01BUKUS.51.5.A05.1.454.CMB.2.raw
  modified_base (171)..(171): a, c, t, g, unknown or other
  modified_base (217)..(217): a, c, t, g, unknown or other
  modified_base (314)..(314): a, c, t, g, unknown or other
  modified_base (581)..(581): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctnagtgtcagtgtctccaggacaaacggccaagatcactgctttgganatgcgttgaccaaagaatctgtcttttggacatcagaggcaggccacggccctgtattggtcatctatgagacacagcgaccctcggactcctgagngacgtccgctggctccgaggtacgagggcaagtcggacctaccgttgactatcacgtcgggaccagagtggacgagtagaagtcgaactaccgtattagttaacttcggaactagaacaggacgtaggtgggttacgtacgggtagggggttccgttaggggaccggggtaagggaaccgggaaagccggtacggttaacccggtcgtggacggttcgaccgggaaccccgtaagggtccctaccggtcccccgttacgggtaaccnccgtttccccg

SEQ ID NO: 395601 - DNA, 610 bp, Homo sapiens
  misc_feature: GZ8MTXP01CMKMH.51.5.A05.1.454.CMB.2.raw
  modified_base (172)..(172): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgagcctcctatgagctgacgcagcccaccctnagtgtcagtgtcctccgaaggaacaaacggccaagatcacctgcttggagtatgcgttagaccaaagtaatctgttcgttttggaccagtcgaagacggcacggccacggtccctgtatggtcatctagtgacgaacacgaacgccgaccctcggaactccgaggacgtagacgtcccgcgtggcctccgaggtaacgagggaactaacggcgtacccgtacttagacttacacgacgtacgggaacccagacgtggaacgtaatacgggaagtcgaaaccttaccgattagttactacggaacagaacagtacgtagggtgtacggtgggtacggggtcgtacgggacgggaaggcgtaacgccgttacgcccgtagtcgagttccgacgaacccgtagtcccgtcccgccccgttcggtaaccttccgtttccccg

SEQ ID NO: 395602 - DNA, 617 bp, Homo sapiens
  misc_feature: GZ8MTXP01E1WIT.51.5.A05.1.454.CMB.2.raw
  modified_base (540)..(540): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaacttctgtctttttggaccatcagaggccaggccaggcccctgtatggtcatctatgagacaccagcgacccctccggaactccctagacgagacgtcgctcggctcgaggtcagggaacaacgtcggcctacttgactagtcacgtcgggacccagactgggacagtaggaacggtcgaactacccgaacgttcgttaactcgacaacggtacaggccgaggtgggtaacggttcggagggggttccgtcggggcggggaaacgggacgaaacggccgttacggacccggttcgcggtacggtaccnccggacccgaacggggtccctccccggtccccccgtcgggtcccttacccgttcccgttcccgtttccccccccggg

SEQ ID NO: 395603 - DNA, 544 bp, Homo sapiens
  misc_feature: GZ8MTXP01EJV9C.51.5.A05.1.454.CMB.2.raw
  modified_base (280)..(280): a, c, t, g, unknown or other
  modified_base (452)..(452): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgctttttggaccatcagaggcaggccagcccctgtatggtnatctatgagacacagcgaccctcggatccctgagagagtcgctggctccgaggtacagggcagtcggccacttgactatcacgtggacccagatggacgagtaggaaggtgactaccactagttattcgggactaggacagcgagtggtagtcggtagggggtcttcggggngggaggggaacgaaggcgtggaccgtccgtagcgttccgaggtaacccccgaaggtcccgtcggcccccttcgggtccttccgtttccccgg

SEQ ID NO: 395604 - DNA, 584 bp, Homo sapiens
  misc_feature: GZ8MTXP01DF6SU.51.5.A05.1.454.CMB.2.raw
  modified_base (172)..(172): a, c, t, g, unknown or other
  modified_base (221)..(221): a, c, t, g, unknown or other
  modified_base (259)..(259): a, c, t, g, unknown or other
  modified_base (310)..(310): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccgaggacaaacggccaagactcacctgctttgganatgcgttgaccaaagaatctgtcttttggaccatcagngcagccagccctgtatgtcatctatgagacacagcgacctcgatcctgagngagtccgcgtgctcgaggtaccagggaacaagtcggacctacgttgactactcgacgtcgggaacccaggagtaggaacgagtaggaaacggtcgaacctaccacgttagttaacttacgggaacgtaagaacgagcgtaagttggggtaaggtaccgggtagggggttcgttaccggggacgggtagggaacgaaaggttcgtcggaccgtcgtggacgttccgacggtcccaagggccgttcccgccccgttcgggtcccttcgtttccccg

SEQ ID NO: 395605 - DNA, 617 bp, Homo sapiens
  misc_feature: GZ8MTXP01AFBH0.51.5.A05.1.454.CMB.2.raw
  modified_base (219)..(219): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccgaggacaaacggccaagatcactgctttgganatgcgttgaccaaagaatctgtctttttggacatcagacggccaggccacggccctgtattggtacatctagtgaacggacaccgaacgccgaccctaccggaactcccgtagagacgtacgtccgcgtggcctcccgaggtaccgaaggggcaaacgtcggacctacgttacgactactccgacgtacgggacccagacgtggaaccgtagtacggaaggtcaaccttacgtattgttattacggggaactaaggacacggtacgtaggttcggtaggttcgggagggggttccgttacggggacggggtagggaacgaacggttcgtacggacccgtcgagttcggttccacggccccgaaggtccctcccggaccccgttgtcccaacgttcccg

SEQ ID NO: 395606 - DNA, 532 bp, Homo sapiens
  misc_feature: GZ8MTXP01BSR8V.51.5.A05.1.454.CMB.2.raw
  modified_base (172)..(172): a, c, t, g, unknown or other
  modified_base (202)..(202): a, c, t, g, unknown or other
  modified_base (269)..(269): a, c, t, g, unknown or other
  modified_base (272)..(272): a, c, t, g, unknown or other
  modified_base (295)..(295): a, c, t, g, unknown or other
  modified_base (414)..(414): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctctatgagctgacgcacgccaccctnagtgtcagtgtctcaggacaaacggcaagntcactgcttggatatgcgttagacaaagtaatctgtcttttgacatcagagcagccgacgccctgtntgnatctatgagacacagccgacccncggactccgtgacgagacgtccgcgtggctcgaggtacgagggtaacagtcgacctacgtgactatcacgtcggaccagagtggactagtagagtcgactactattagttactcggaanagacagacgtggtggtaggtcgggtaggggtcgtaggggacggaagggaacgacgcggtacgaccgtcgtgacgttcgacgcccgaggcctccgcccgttcgtccttaaccgttcccg

SEQ ID NO: 395607 - DNA, 581 bp, Homo sapiens
  misc_feature: GZ8MTXP01BOJ65.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccgaggacaaacggccaagatcacctgctttggagatgcgttgacctaaagaatcttgtctttttggaccatcagacggcaggccacggccctgtattggtcatctatgagacaacagccgaccccgtcggaactcccgtagacgagacgtccgcgtggcctcgaggtaccgagggaacaagtcggaccctacgttgactctacgacgtcggacccagagtaggacgagtggaagtcgactacagttagttactcggaactaggaccaggacgaggttggtacggtcgggtaagggggttccgttacggggacgggtaagggaacgtaaggcgtacggaccgtcgtggacgttcgacggcccaggcctccggccccgttcggtccttcgttccccg

SEQ ID NO: 395608 - DNA, 551 bp, Homo sapiens
  misc_feature: GZ8MTXP01B71RK.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcactgctttggagatgcgttgccaaaagaaatctgctttttggaccatcagaggccaggccaggccctgtattggtcatcatgagacacaagcaccctcggaatccctgagagagtccgctggctccgaggtcagggcaatggccaccttgactatcactgggacccagatgagatagaagtagacacactagttattacggacagaacagacgagtaggtaggtacggtacggggtcggttcgggtcgggacggggaacggaacggacgtacgaccgtaccgtcgacgttcgacgaacccgaacggaaccgtccgtaccccggttcccggtccgttaaccgtccg

SEQ ID NO: 395609 - DNA, 557 bp, Homo sapiens
  misc_feature: GZ8MTXP01A1HUI.51.5.A05.1.454.CMB.2.raw
  modified_base (128)..(128): a, c, t, g, unknown or other
  modified_base (200)..(200): a, c, t, g, unknown or other
  modified_base (214)..(214): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttcngcacagtctctgaggcctcctatgagctgacgcagccaccctcagtgtcagtgtctcagacaaacggcaagntcactgctttgganatgcgttgaccaaagaatctgctttttggaccatcagcggcaggccacggcccctgtattggtcatctatgaagaccacaacgcgaccccgtcggaactcccgtaggagacgcgtccgcgtggctccgaggtacagggcagcggctactgactatcacgtcggacccagagtggacgagaggaaaggtcgaacctacctagtcgtttaacgtacggggacagacgacggtgaaggttggtaacgtccgggtaagggggtcgttcgggaccggggagggaaccgaagcgtcggaccgtcgtcgagttcacggccaggcctcgccccgttagtccgttcgtcccg

SEQ ID NO: 395610 - DNA, 528 bp, Homo sapiens
  misc_feature: GZ8MTXP01DN2RW.51.5.A05.1.454.CMB.2.raw
  modified_base (172)..(172): a, c, t, g, unknown or other
  modified_base (218)..(218): a, c, t, g, unknown or other
  modified_base (259)..(259): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcactgctttgganatgcgttgaccaaagaaatcttgtctttttggaccatcagnggccaggccaggccctgtattggtcatctatgagacaccagcgaccctcggaactccgtgagagagtccgctggctccgaggtcgagggaacaagtcggcctacgtgactactcacgtcggaccagagtggacgatagaagtgaactactacgtgttacttcgggactagacagacgagtggtagtcggagggtcgtacggcggagggaacgaaggctcgacgtccgtgcgttcacgccgagcctacgccccgttgtccttcgttcccg

SEQ ID NO: 395611 - DNA, 651 bp, Homo sapiens
  misc_feature: GZ8MTXP01AZZP0.51.5.A05.1.454.CMB.2.raw
  modified_base (169)..(169): a, c, t, g, unknown or other
  modified_base (200)..(200): a, c, t, g, unknown or other
  modified_base (410)..(410): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctctatgagctgacgcagcccaccctnagtgtcagtgtctccaggacaaacggcaagntcactgctttggagtatgcgttagacctaaaagtaacttctagttctttttaggaccagtcgagacggccaggccacggtccctagtacgttggtctatctagtaggacggacaaccgaacgcccgaccccgtacggaactcccgtaggagagacggtcgcgtaccggctacgaggtcgagggaactaagtcggacctacgttagactancgagtacggacctagacgtaggaacgagtaaggtaacggtacgtaactacccgtaagttacgttaatacgaacgacgagtaggaccgtaggtaggtacggtcgggtaacgggggttcgttccggggaaggggaacggtaacgtaacgggtccgtaacggttcccgttccgaggtaccgtccgaacgttcccgaaggtcccaccgtccccgtggtaccttccttccgttaacccgttccccg

SEQ ID NO: 395612 - DNA, 676 bp, Homo sapiens
  misc_feature: GZ8MTXP01DTF4F.51.5.A05.1.454.CMB.2.raw
  modified_base (216)..(216): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgagcctcctatgagctgacgcagccaccctcagtgtcagtgtctccaggacaaacggccaagatcacctgtctttgganatgcgttagaccaaagtaatctgtctttttaggacatcagacggccagccacggccctgtattggtcatctagtgacgacacgacgccgacccgtcggaactcccaggagagtacgtcgcgttccggcctacgacggtacgacggaaaccaagtcggacctacgttagactactacgacggtcgggacccagtacgaggacgagttaggaaggttacgactaaccgtacgttagttaacgtacgacgaacggtaacgacggtacgtaagggttcgggttaggtccggggttaacgggggttcccggttagggggtaccgggggtaaacggggtaaccggaaacgggtccgttacggaacccggttaccgttgggaaacggttccgaaccgggccgttaaaccggtcccgtaacccggcccctttacgggccttacccgttccgttccccgtttcccccgg

SEQ ID NO: 395613 - DNA, 630 bp, Homo sapiens
  misc_feature: GZ8MTXP01BERDJ.51.5.A05.1.454.CMB.2.raw
  modified_base (169)..(169): a, c, t, g, unknown or other
  modified_base (281)..(281): a, c, t, g, unknown or other
  modified_base (507)..(507): a, c, t, g, unknown or other
tcagcgatcgtatacacgaccggtgctcgatttagatagatagacaggggggtgggctcaggaggcagagctctgggaatctcaccatggcctggacccctctcctgcctccccctcctcactttctgcacagtctctgaggcctcctatgagctgacgcagccacctnagtgtcagtgtctccgaggacaaacggcaagatcactgctttggagatgcgttgacaaagtaatctgtcttttgactatcagagcaggccacggtccctgtatcggtacatntatgacgacacgagccgacccgtcggaactcccgagagagcgtcgcgtggcctacgagtcgaaggaacacgtcgacctacgttgactagcgacgtcgggacctagagtcggagtatacgggagacgtaactaccgtagttacgttacgtacgaacgtaggtacgagtccggtagtcggtaagtcgggtaccggggttacgccggggtaaggggacggtaaaccggnggttccgtaaccgggaccggttcggttacggtaccggtacccggttacccggacccgacccggtccgtaccccggtaaccccgtttcgggacccgttacccgttccggttcccccggttcccg

SEQ ID NO: 395614 - DNA, 683 bp, Homo sapiens
  misc_feature: GZ8MTXP01BO3BY.51.5.A05.1.454.CMB.2.raw
  modified_base (172)..(172): a, c, t, g, unknown or other
tcagcgatcgtatacacgaccggtgctcgatttagatagatagacaggggggctgtgggctcaggaggcagagctctgggaatctcaccatggcctggacccctctcctgcctccccctcctcactttctgcacagtctctgagcctcctatgagctgacgcagccaccctnagtgtcagtgtctcaggacaaacggccaagatcactgctttggagatgcgttgaaccaaaagaattctgtctttttggacctatcgagacggcgacggccacggccctgtattggtacatctatgatacgaccaaccaacgcccgacccttccggaactcccgtagagacgaccggtcgcgtcggtccaccgtaacgggcgaagggaacaacgtcggaccctacttacgactaactcgacgtcgggaccaggtagagggaacgtagtaggtaacgggtcgtaaaccgtaccgtaatttacggtttaacggtacgtaaacgacgaaaccggagtaacggtaggggttgggttaacggggtacgggttaacggggggttaccgttcgggggaacgggggaagggtaaccggaaacggtcggttaccggtaacccggtccgttacggaaccttcggaaccgaccccggaaggtccccgtcccggttacccccgtccgggtttaaccccgtcccg

SEQ ID NO: 395615 - DNA, 624 bp, Homo sapiens
  misc_feature: GZ8MTXP01EQWCT.51.5.A05.1.454.CMB.2.raw
  modified_base (175)..(175): a, c, t, g, unknown or other
  modified_base (266)..(266): a, c, t, g, unknown or other
  modified_base (294)..(295): a, c, t, g, unknown or other
  modified_base (325)..(325): a, c, t, g, unknown or other
  modified_base (336)..(336): a, c, t, g, unknown or other
  modified_base (359)..(359): a, c, t, g, unknown or other
  modified_base (529)..(529): a, c, t, g, unknown or other
tcagcgatcgtatacacgaccggtgctcgatttagatagatagacaggggggctgtgggctcaggaggcagagctctgggaatctcaccatggcctggacccctctcctgcctccccctcctcactttctgcacagtctctgaggcctcctatgagcctgacgcagcccaccctnagtgtcagtgtctccgaggacaaacggccaagatccaccgtgtctttgggagatgcgttagacctaaaagtaattctagtcttttaggacntcagcgcaggccaggccctgtatcggtnntctatgagacaacacgcgaccctacgtacnccgtgacgagngtccgcgtggactcgacgggtanacgggaacaagtcggacccaacgttcgactagtcacgtacgggacctagactgggaacgtagtaggtaaaggtcgaaacctcctaacgttagtttaactacggggtaaacacgaaaccgtgcgtaaagggtggttacggtcggtaacgggggttctaccggggaacgggngggaacgtaaggcgtacgggttacccgtcgtcggaacgttcgaacgaacccgacgggtcctcccgggccccgttacggtcccgttcgttaacccc

SEQ ID NO: 395616 - DNA, 504 bp, Homo sapiens
  misc_feature: GZ8MTXP02IVEYG.51.5.A05.1.454.CMB.2.raw
tcagcgatcgtatacacgaccggtgctcgatttagatagatagacaggggtgggctcaggaggcagagctctgggaatctcaccatggcctggacccctctcctgctcccctcctcactttctgcacagtctctgaggcctcctatgagctgacgcagccaccctcagtgtcagtgtctccaggacaaacggccaagatcacctgctttggagatgcgttgccaaagaaatctgcttttggaccatcagaggcaggccaggccctgtatggtcatctatgagacaccaagcgacctcggaatccctgagagagtcgctggctccgaggtccagggaccaatcgggcctaccttgacctagtcactgggacccagactggacgatgaaggtgactacactgttattcgacagacagcagtggtagtcgaggggtctgggcgagggacgagctgaccgtcctagacgtcacgaccaggctcgcccctcggcacgtctcgttacccc

SEQ ID NO: 395617 - DNA, 502 bp, Homo sapiens
  misc_feature: GZ8MTXP02JOI6M.51.5.A05.1.454.CMB.2.raw
  modified_base (437)..(437): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgcttttggtaccatcagaggccaggccaggcccctgtattggtcatctatgaggacacaagcgaccctcggaatccctgagagagtcgctggctccaggtcaggggacaagtggccacttgactatcactgggacccagatggacgatgaagtgactaccatgttattcgacagacagcagtgtagtcgagggggtctcgggnggagggacgagctgaccgtctgacgtcacgccgaagctacgccccctggcactctcgttcccccg

SEQ ID NO: 395618 - DNA, 527 bp, Homo sapiens
  misc_feature: GZ8MTXP02H8L67.51.5.A05.1.454.CMB.2.raw
  modified_base (214)..(214): a, c, t, g, unknown or other
  modified_base (473)..(473): a, c, t, g, unknown or other
tcagcgatcgtatacacgaccggtgctcgatttagatagatagacagggggtggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgccaaagaatctgtctttttggtaccatcagaggccaggccaggcccctgtattggtcatctaatgaggacaccaagcgaccctccggaatccctgagagagtcgctggctccgaggtcagggacaatggccacttgactatcactgggacccagatggacgatgaaaggtgaactacactgttaatcgacagacagcaggtggtagcgagggggtcgttcgggcggagggacgaaggctaggaccgtccgngacgcgacgccgaggtccgtccgaccccgtcggtcctaccgtcctaccgtcccc

SEQ ID NO: 395619 - DNA, 505 bp, Homo sapiens
  misc_feature: GZ8MTXP02GBQYD.51.5.A05.1.454.CMB.2.raw
tcagcgatcgtatacacgaccggtgctcgatttagatagatagacagggggtgggctcaggaggcagagctctgggaatctcaccatggcctggacccctctcctgcctcccctcctcactttctgcacagtctctgaggcctcctatgagctgacgcagccaccctcagtgtcagtgtctccaggacaaacggccaagatcacctgctttggagatgcgttgaccaaaagaaatctgtctttttggaccatcagaggccaggccaggcccctgtatggtcatctatgagacacaagcgaccctcggaatccctgagagagtcgctggctccaggtcagggacaatggccacttgacctatcactgggacccagatggacatgaaagtgaactacactgtattcgacagacagcagtgagtcgagggggtcttcgggcggagggacgaagcgtgaccgtctgacgtcagcccaaaggccgtcgcccctcggcactctgtcccccg

SEQ ID NO: 395620 - DNA, 497 bp, Homo sapiens
  misc_feature: GZ8MTXP02JDREZ.51.5.A05.1.454.CMB.2.raw
tcagcgatcgtatacacgaccggtgctcgatttagatagatagacaggggtgggctcaggaggcagagctctgggaatctcaccatggcctggacccctctcctgctcccctcctcactttctgcacagtctctgaggcctcctatgagctgacgcagccaccctcagtgtcagtgtctccaggacaaacggccaagatcacctgctttggagatgcgttgccaaagaatctgcttttggaccatcagaggccaggccaggcccctgtattggtcatctatgaggacacaagcgaccctcggaatccctgagagagtcgctggctccaggtcagggacaatggccacttgactatcacgtgggacccagatggacgatgaagtgactacactgtatcgacagacagcagtgagtcgaggggtctcggcggaggacgagcgtgaccgtcgtgacgtcgacgcccaaggctcgccccctacggcacctctcgttccccc

SEQ ID NO: 395621 - DNA, 539 bp, Homo sapiens
  misc_feature: GZ8MTXP02HXJZH.51.5.A05.1.454.CMB.2.raw
  modified_base (172)..(172): a, c, t, g, unknown or other
  modified_base (288)..(288): a, c, t, g, unknown or other
  modified_base (496)..(496): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaacggccaagatcacctgctttggagatgcgttgaccaaagaatctgtcttttggacctatcagaggccaggccaggcccctgtatggtcatctangagacacagcgaccctcggaactcctgagagagtccgcgtcggctaccgaggtcgagggacaagtcggacctaccgttgactatcacgtacgggacccagagtaggacgtagtaggaaggtcgaacctacacttagttattacgactagacagccgagtggtagtcggaggggttcgtcgggacgggaggacgagcgtcgaccgtcgngacgtcgacgccgaaggcctacgccccgtacggtctacctccg

SEQ ID NO: 395622 - DNA, 523 bp, Homo sapiens
  misc_feature: GZ8MTXP02F20MB.51.5.A05.1.454.CMB.2.raw
  modified_base (316)..(316): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgcttttggtaccatcagaggccaggccaggcccctgtatggtcatctatgagacaccaagccgaccctcggaatcccngagagagtccgctggctccgaggtcaggggacaatcggaccaccgttgaactatcacgtgggacccagactggacgatggaaggtgacttaccacgttgttaatcgaacagacagcagtggtacgtcgagggggtctcgggcggagggacgaaggctacggaccgtcgtgacgtcgagcccgaaggctccgcccctggtcacttccg

SEQ ID NO: 395623 - DNA, 585 bp, Homo sapiens
  misc_feature: GZ8MTXP02HQHOH.51.5.A05.1.454.CMB.2.raw
  modified_base (276)..(276): a, c, t, g, unknown or other
  modified_base (278)..(278): a, c, t, g, unknown or other
  modified_base (352)..(352): a, c, t, g, unknown or other
tcagcgatcgtatacacgaccggtgctcgatttagatagatagacaggggtgggctcaggaggcagagctctgggaatctcaccatggcctggaccccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttgacatcagagccagccaggccctgtatgtcatnangagacacagcaccacgatccagagagacgtcgcgtcggcctcgaggcgaaggactaagtcgacctactgactancacgtcggaccagagagacgagagaacgtacgaactactagttagttaactacgacagacgagagtaggtaggtaggtacggtacggggtacggtacgggacgggaacgggaacggaacggacgtacggtaccggtaccgtacggtacggtaccgaccggacccgaaccggtaaccgtacccgtacccccgttacccggtacccgtacccgttacccgttacccgttcccccg

SEQ ID NO: 395624 - DNA, 526 bp, Homo sapiens
  misc_feature: GZ8MTXP02JKJB8.51.5.A05.1.454.CMB.2.raw
  modified_base (411)..(411): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctagtcttttggaccatcagagccagccaggcccctgtatggcatctatgaggacaccaagcgacccctccggaatcccgtagagagagtcgctcggctccgaggtcagggacatcggccacttgactatcacgtgggacccagatggacagtagaagtgactacactagttatcganagacagcagtgtagtgagggggtctcgggcggagggacgaaggcgtgaccgtctaggacgtcgacgcccgaaggcctccggacccccgtcggtcctaccgtccgtcgttcccccg

SEQ ID NO: 395625 - DNA, 520 bp, Homo sapiens
  misc_feature: GZ8MTXP02IN3G4.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgtcttttggtaccatcagagcaggcaggcccctgtatggtcatctatgagacaccaagcgacctccggaatccctgagagagtcgctggctccaggtcagggacaatggccacttgactatcactgggacccagatggacgatgaagtgaactacactgtattcgacagacagcaggtgtagtcgaggggttctcgggcggagggacgaaggtcgtggaccgtcgttacggagtcgaacgcccaacgggctccgccccgtcggtaccaccgttctcgtttcccccg

SEQ ID NO: 395626 - DNA, 517 bp, Homo sapiens
  misc_feature: GZ8MTXP02INFRA.51.5.A05.1.454.CMB.2.raw
  modified_base (502)..(502): a, c, t, g, unknown or other
tcagcgatcgtatacacgaccggtgctcgatttagatagatagacaggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgtctttttggaccatcagaggccaggccaggcccctgtattggtcatctatgaggacaccaagcgaccctcggaatccctgagagagtcgctggctccgaggtcagggacaagtcggccaccttgactatcacgtgggacccagatggacatgaagtgactaccatgtatcgacagacagcagtgtagtcgagggggtcttcgggcggagggacgaagcgtaggaccgtcctgacgtcgacgacccgaaggcgtcgccccctcggtcnccgtctcgttccccc

SEQ ID NO: 395627 - DNA, 692 bp, Homo sapiens
  misc_feature: GZ8MTXP02F0TX5.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccaggcccctgtattggtcatctatgaggacaccaagcgaccctcggaactccctgagagagtcgctcggctccgaggtcgagggacaagtcggaccacgttgacctatacgacgtcgggacccagacgtagggaacgagtacggaaaggtacggtaaccttaacccgtacgttacgtttaacgtttaccggaacgtaacggaacccgtagggaccgtaagggtttacggggttaacgggttaccggggtaacggggggtttcccggtttacgggggaccggggaacgggggtaaccggaaacggtcccgttacggggtaaacccccgttccggtaagggtaccggttaccgaaccggtccccgaaacggtcccgtacccggtccccccgttacgggtcccttacccgtttccgttacccccttacccccg

SEQ ID NO: 395628 - DNA, 501 bp, Homo sapiens
  misc_feature: GZ8MTXP02GORZN.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgctttttggacatcagaggccaggccaggcccctgtatggtcatctatgagacacaagcgaccctcggaatccctgagagagtcgctcggctccaggtcagggacaagtggccacttgactatcactgggacccagatggacgatgaagtgactacactgttatcgacagacagcagtgagtcgagggggtctcgggcggagggacgaagcgtagaccgtctgacgtcacgcccaaggctcgcccctcggtccactctcgtcccc

SEQ ID NO: 395629 - DNA, 500 bp, Homo sapiens
  misc_feature: GZ8MTXP02HVJHH.51.5.A05.1.454.CMB.2.raw
  modified_base (422)..(422): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacacaagcgaccctccggaatccctgacgagagtccgctggctccaggtcagggcaatcggccaccttgactatcactgggacccagatggacatgaagtgactacactgttatcgactagacagcagnggtagcgaggggtctcgggcggaggacgaaggctcgaccgtctgacgtcagccgaaggctcgccctcggtcacgtccg

SEQ ID NO: 395630 - DNA, 567 bp, Homo sapiens
  misc_feature: GZ8MTXP02IBBXM.51.5.A05.1.454.CMB.2.raw
  modified_base (308)..(308): a, c, t, g, unknown or other
  modified_base (330)..(330): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaaatctgtctttttggtaccatcagaggccaggccaggcccctgtattggtcatctatgagacaccaagccgacccnccggaatccctgagagagtcgntcggctccgagtcagggacaagtcggaccctacttgaccttatcactcggacccagagtggacgagtagaaggtcgactaaccacttgttattacgacagactagcaggtaggtagtcggagggggtcgttcgggacgggagggacgaagtcgtacggtacccggtccgttaggacgtacgacgacccgaacggcccgtcgcccccgtcggtcctacccgttccgttccgtcccccg

SEQ ID NO: 395631 - DNA, 503 bp, Homo sapiens
  misc_feature: GZ8MTXP02JWZCG.51.5.A05.1.454.CMB.2.raw
  modified_base (445)..(445): a, c, t, g, unknown or other
  modified_base (467)..(467): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgctttttggtaccatcagaggccaggccaggcccctgtattggtcatctatgaggacaccagcgaccctccggaatccctgagagagtccgctggctccgaggtcagggcaatcggccacttgactatcacgtgggacccagatggacgatgaaggtgactacacttgttatcgacagacagcagtggtagtcgagggggtctcgggnggagggacgaagctgaccgtcngacgtcacgccgaggctcgccccctggtccactccg

SEQ ID NO: 395632 - DNA, 517 bp, Homo sapiens
  misc_feature: GZ8MTXP02IKR43.51.5.A05.1.454.CMB.2.raw
  modified_base (220)..(220): a, c, t, g, unknown or other
  modified_base (287)..(287): a, c, t, g, unknown or other
  modified_base (314)..(314): a, c, t, g, unknown or other
  modified_base (456)..(456): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcacttttctgcacagtctctgaggcctcctatgagctgacgcagccaccctcagtgtcagtgtctccaggacaaacggccaagatcacctgctttgganatgcgttgaccaaaagaaatctgtcttttggaccatcagagccaggccaggccctgtatgcatctangagacacaagcgaccctcggaatcccngagagagtccgctggctccgaggtccaagggacaaagtcggaccctaccgttgaactatccaacgtgggaacccagagtggaacgatgaaagtgaactaccattagttactcgacagacagcagtgagtcgagggtctcggnggaaggtacgaagctagaccgtctgacgtcacgcccgaaggctccgcccctcggctactcc

SEQ ID NO: 395633 - DNA, 506 bp, Homo sapiens
  misc_feature: GZ8MTXP02IEY6J.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgcttttggaccatcagagccaggccaggcccctgtatggtcatctatgaggacaccaagcgaccctccggaatccctgagagagtcgctggctccaggtcagggacaatgggccaccttgactatcactgggacccagatggacgatgaaggtgactacactgtattcgacagacagcagtggtagtcgagggggtcttcgggcggagggacgaagctggaccgtcgtgagtcacgcccaaggctcgcccctcggtcacctctcgttacccc

SEQ ID NO: 395634 - DNA, 520 bp, Homo sapiens
  misc_feature: GZ8MTXP02I8XVS.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagagcaggccagccctgtatggtcatctatgagacacaagcgaccctcggaactcccgtgacgagagtcgctcggctccgaggtcagggacaagtggccacttgactatcacgtgggacccagactggacgatgaaggtgactaccagtgttacttcgaacaggacagacaggtgtagtcgagggggtctgggcggtagggacgaagcgtcgaccgtcgtagacgtcgacgcccaaggcctcgccccgtcggccactcgtcgttacccc

SEQ ID NO: 395635 - DNA, 556 bp, Homo sapiens
  misc_feature: GZ8MTXP02H5QAW.51.5.A05.1.454.CMB.2.raw
  modified_base (495)..(495): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggtaccatcagaggccaggccaggcccctgtattggtcatctatgaggacaccaagccgaccctccggaatccctgagagagtcgctcggctccgaggtcgagggacaatgggaccctacttgactatcacgtcgggacccagagtggacgagtagaaaggtcgactaccaacgttgttacttcgactagactagcgaggtggtagtcggagggggttctcgggcggagggacgaacgcgtggaccgttcgnggacgtccgacgcccgaacggccgtccgcccccgtcggtcctaccgtcttccgttaccccc

SEQ ID NO: 395636 - DNA, 516 bp, Homo sapiens
  misc_feature: GZ8MTXP02I9B8J.51.5.A05.1.454.CMB.2.raw
tcagcgatcgtatacacgaccggtgctcgatttagatagatagacaggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggaccatcagaggccaggccaggcccctgtattggtcatctatgaggacacaagcgaccctcggaatccctgagagagtccgctggctccgaggtccaggggcaatggccaccttgactatcactgggacccagatggacgatgaagtgactacactgttattcgactagacagacagtggtagtcgagggggtcttcgggcggtagggacgaaggcgtacgaccgtcgtgacgtcagccccgaaggctacgcccccgtggtccacgttccg

SEQ ID NO: 395637 - DNA, 568 bp, Homo sapiens
  misc_feature: GZ8MTXP02HULL9.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgctttttggaccatcagaggccaggccaggcccctgtattggtcatctatgaggacacaagcgaccctcggaatccctgagagagtcgctcggctccgaggtcgagggaccaagtcggcctaccttgacctatcacgtcgggacccagagtgacgagtgaaggtcgacgtacctactgttaacttcgaacagacagcgaggtacggtagtcggaggggtcggttcgggacgggaggggaacggagcgtacaccggggggtcctggtacgtcgacggacccgaacggccgtccgcccccgtccggtccgtacctccgtttccgtttccccccg

SEQ ID NO: 395638 - DNA, 535 bp, Homo sapiens
  misc_feature: GZ8MTXP02GFF1R.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttggaccatcagaggccaggccaggcccctgtattggtcatctatgaggacaccaagccgaccctccggaatccctgagagagtccgctggctccgaggtcaagggacaagtcggaccaccttgactatcaacgtcggggaacccagatggaacgatggaagtgaactaccacttagttatcgacagacagcagtggtagtcgagggggtctcgggcggagggacgaagctcggaccgtcgacgacgtcgacgaacccgaaggcctaccgccccctcggtccacgttcccg

SEQ ID NO: 395639 - DNA, 538 bp, Homo sapiens
  misc_feature: GZ8MTXP02JFL4I.51.5.A05.1.454.CMB.2.raw
  modified_base (215)..(215): a, c, t, g, unknown or other
  modified_base (311)..(311): a, c, t, g, unknown or other
  modified_base (412)..(412): a, c, t, g, unknown or other
  modified_base (445)..(445): a, c, t, g, unknown or other
  modified_base (475)..(475): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgccaaagaatctgctttttggaccatcagaggccaggccaggcccctgtattggtcatctatgagacacaagccgacctcggaatcccngagagagtcgctcggctccgaggtcagggacaagtcggccaccgttgacctatcacgtgggacccagagtggacgatgaagtgactacactgttattcganagacagcaggtgtagtcgagggggtctcggggnggaggggacgaaggcgtcggaccggtccgnggaacgtcgacggcccgaaggccgtccgcccccgttcgggcctaccgtccgtcgtttcccccg

SEQ ID NO: 395640 - DNA, 547 bp, Homo sapiens
  misc_feature: GZ8MTXP02H1KP2.51.5.A05.1.454.CMB.2.raw
  modified_base (216)..(216): a, c, t, g, unknown or other
  modified_base (393)..(393): a, c, t, g, unknown or other
  modified_base (488)..(488): a, c, t, g, unknown or other
tcagcgatcgtatacacgaccggtgctcgatttagatagatagacagggggtgggctcaggaggcagagctctgggaatctcaccatggcctggacccctctcctgctcccccctcctcactttctgcacagtctctgaggcctcctatgagctgacgcagccaccctcagtgtcagtgtctccaggacaaacggccaagatcacctgctttgganatgcgttgaccaaagaatctgctttttggtaccatcagagccaggccaggcccctgtattggtcagtcatgaggacaccaagcgaccctcggaatccctgagagagtcgctggctccgaggtcagggacaagtcggacctacttgactatcacgtcgggacccagagtcggacgagngtaaggtagactaaccacttagttacttcgactagactagactaggtaggtagtcgagggggttctcgggacggagggacgaagcgtagccgtcnggacgtcgacgcccgaagcccgtacggccccctcggtccaccgttccgtacgttccccc

SEQ ID NO: 395641 - DNA, 539 bp, Homo sapiens
  misc_feature: GZ8MTXP02IITHK.51.5.A05.1.454.CMB.2.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgtctttttggtaccatcagaggccaggccaggcccctgtattggtcatctatgaggacaccaagccgaccctccggaactccctagagagagtccgctggctcaggtcagggcaatcggccaccttgactatcacgtggaccctagatggacgagtgaaggtgaactacgactaggttacttcgactaggacagcgtaggtggtagtcggagggggtctacgggcgggtagggacgaagcgtacggtacccgtctgacgtcgacgcccgaaggcctcgacccccgtcggtccacgttcccg

SEQ ID NO: 395642 - DNA, 551 bp, Homo sapiens
  misc_feature: GZ8MTXP02GYL6G.51.5.A05.1.454.CMB.2.raw
  modified_base (350)..(350): a, c, t, g, unknown or other
  modified_base (423)..(423): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggccaggccaggcccctgtattggtcatctatgagacacaagcgaccctcggaactccctgagagagtcgctcggctccgaggtcgagggacaancggccacttgactatcactcgggacccagatggacgatgaagtcgactaccgtatgttacttcgaactagacngacgaggtggtagtcggagggggtcgttacggggcgggaagggacggaagcgtacggaccgtccgtaggacgcgacgcccgtaaggccgtaccggcccccgtagtccgtacctccgtccgttcccccg

SEQ ID NO: 395643 - DNA, 515 bp, Homo sapiens
  misc_feature: GZ8MTXP02IMWCM.51.5.A05.1.454.CMB.2.raw
  modified_base (216)..(216): a, c, t, g, unknown or other
  modified_base (437)..(437): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggganatgcgttgccaaagaatctgctttttggaccatcagaggccaggccaggcccctgtattggtcatctatgagacaccaagcgacctccggaatccctgacgagagtcgctggcctccgaggtcagggacatcggccacttgactatcactcgggacccagagtggacgatgaagtgactacatgtatcgacagacagcagtgtagcgagggggtctcgggnggagggacaaggcgtaggaccgtctggactcgacgcccaaggcgtcgcccccgtcggtccacctcgtccgttcccccg

SEQ ID NO: 395644 - DNA, 571 bp, Homo sapiens
  misc_feature: GZ8MTXP02GW6T7.51.5.A05.1.454.CMB.2.raw
  modified_base (172)..(172): a, c, t, g, unknown or other
  modified_base (374)..(374): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttggagatgcgttgaccaaaagaatctgtcttttggtaccatcagagccaggccaggcccctgtattggtcatctatgatgacacaagccgaccctcgaactccctgagagacgtcgctggctccgaggtcaggggacaagtcggaccctacttgactacncacgtcggaccagatggaacgagtggaaaggtgactaccgtactgttattcgacagacagacgtaggtaggtacgtcggtacgggggttcgttcgggaccggggaagggtacgaaggccgttggaacccgtccgtaggaccgtacgaacggtaccccgaaggtcccgtcccggtacccccgtacgggtacctacccg

SEQ ID NO: 395645 - DNA, 551 bp, Homo sapiens
  misc_feature: GZ8MTXP02GQTLS.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccaggcccctgtattggtcatctatgaggacacaagcgacctcggaatccctgagagagtcgctgggctccgaggtcaggggaccaaagtcgggaccaccctttgacttatcacgtcgggacccagagtggaacgatgaaaggtcgactaccacttgttattcggacaggacagcgagtggtagtcggagggggtcgttacgggcgggagggacgaacggcgtacggaccgtccgtagacgtccgacgccccaagggctacgcccccgtcggccactcctcgttcccccg

SEQ ID NO: 395646 - DNA, 684 bp, Homo sapiens
  misc_feature: GZ8MTXP02GW1RP.51.5.A05.1.454.CMB.2.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgacccaaagaaattcgtgttcgtttacgactatcgaggcgccgacggccgaccggtccccttagttacgttcggtactacttacgtagtacggaacggaacccaaaccgaacggccccgtaacccccggtacggaaccttccccgaggacggacgtacgtccccgtcgtacgggtcctaccggtacggtacgaacgggactagtccggaccctacgttgaactcacacggtacggaacccagagtacggaactagtaggagtacgaacctaacctgttacgttagtaccgaacgaacgacgaggtacgtagggttaggtaacggtcgggggtaacgggggtttcgtacgggggacggggaacgggaacgacggtcgtaccggtacccttcggagacgtaccgaccggaaccgtaacggtccgtccccggtcccccgtacggtaccctaccgtttccccg

SEQ ID NO: 395647 - DNA, 500 bp, Homo sapiens
  misc_feature: GZ8MTXP02F74R5.51.5.A05.1.454.CMB.2.raw
tcagcgatcgtatacacgaccggtgctcgatttagatagatagacagggggtgggctcaggaggcagagctctgggaatctcaccatggcctggacccctctcctgctcccctcctcactttctgcacagtctctgaggcctcctatgagctgacgcagccaccctcagtgtcagtgtctccaggacaaacggccaagatcacctgctttggagatgcgttgccaaagaaatctgctttttggaccatcagaggccaggccaggcccctgtatggtcatctatgagacacaagcgaccctcggaatccctgagagagtcgctggctccaggtcagggacaatggccacttgactatcactgggacccagatggacatgaagtgactacactgtatcgacagacagcagtgagtcgagggggtcttagggcggagggacgaagctgaccgtctggactcgaacgcccaaggctcgccccctcggtcacgtctcgttccccc

SEQ ID NO: 395648 - DNA, 618 bp, Homo sapiens
  misc_feature: GZ8MTXP02HV3LA.51.5.A05.1.454.CMB.2.raw
  modified_base (216)..(216): a, c, t, g, unknown or other
tcagcgatcgtatacacgaccggtgctcgatttagatagatagacagggggtgggctcaggaggcagagctctgggaatctcaccatggcctggacccctctcctgctcccccctcctcactttctgcacagtctctgaggcctcctatgagctgacgcagccaccctcagtgtcagtgtctccaggacaaacggccaagatcacctgctttgganatgcgttgaccaaagaatctgcttttgaccatcagaggccaggccaggcccctgtattggtcatcatgaggacacagcgaccctcggaatccctgagagagtcgctcggctccgaggtcgaggacaagtcggaccactgactatcacgtcgggacccagagtggtacgagtagaaaggtcgaactaaccacgttagttaacgttaccggaacaacgacgagacgtagggtaggtacggtcggtaaggggggttccgttacgggggacggggaaggggaccggaaaacggtcgtacggaacccggttcccgttaggaccgtacgaacggaccccgaaacggtcccgtcccggaccccccgttaccggggtcctacccggttccctttaccggtttcccccccg

SEQ ID NO: 395649 - DNA, 557 bp, Homo sapiens
  misc_feature: GZ8MTXP02GWMGY.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggtaccatcagaggccaggccaggcccctgtattggtcatctatgaggacaccaagcgaccctccggaatccctgacgagagtcgctcggctccaggtcaggggacaagtggccacgttgactatcactcgggacccagatggacgagtgaaaggtcgaactaacccgattagttacttcgaacagacagactaggtgtagtcgagggggtcttcggggcggaggggacgaggcgtggaccgtcgtggacgtcgaacgcccgaacggtccgtccggcccccgttacggtccaccgttcgtccggtttcccccg

SEQ ID NO: 395650 - DNA, 522 bp, Homo sapiens
  misc_feature: GZ8MTXP02JPJR3.51.5.A05.1.454.CMB.2.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgtcttttggaccatcagaggccaggccaggcccctgtattggtcatctatgaggacacaagcgaccctcggaatccctgagagagtccgctggctccgaggtcagggcaagtcggccaccttgactatcacgtgggacccagatggacgatgaagtgactacactgttatcgacagacagcagtggtagtcgagggggttctcgggacggacgggacgagcgtacggaccgtccgtggacgtcgacgcccgaaggcctaccggccccctcggtccactttcccg

SEQ ID NO: 395651 - DNA, 598 bp, Homo sapiens
  misc_feature: GZ8MTXP02HDEYJ.51.5.A05.1.454.CMB.2.raw
  modified_base (219)..(219): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtcttttggaccatcagagccaggccaggcccctgtatggtcatctatgaggacacaagccgaccctcggaatccctgagacgagtccgctggcctcgaggtcgaagggacaagtcggaccaccgttgactatccacgtcgggaacccagacgtggaacgtagtagaaaggtcgaactacctacgtagtttacttacgaacgagacaggactaggtacggtaggtaccggaagggggttccgttacggggacggggaacggggaaccgaaagggtccgtacggacccgtttaccgtaggacgtccgaacggccccgaaggtcccgtccggccccccgtacggtccctacccgtttcccg

SEQ ID NO: 395652 - DNA, 583 bp, Homo sapiens
  misc_feature: GZ8MTXP02HZ8V9.51.5.A05.1.454.CMB.2.raw
  modified_base (215)..(215): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaatctgtctttttggtaccatcagagccaggccaggcccctgtattggtcatctatgaggacaccaagccgaccctcggaatcccgtgagagagtcgctcggctccgaggtcagggacaagtcggacctacttagactatcgacgtcgggacccaggacgtacggacgagtcggaaaggtcgacctaaccgtacgttagttaacttacggaacagactagacaggtggtagtacggtaagggggttccttacggggaccgggaggggacgaaacgtcgtaacgccggtcctggacgtacgacgacccgaaggccgtacggaccccctcggtacctacctccgtaccgtccccc

SEQ ID NO: 395653 - DNA, 549 bp, Homo sapiens
  misc_feature: GZ8MTXP02IGR52.51.5.A05.1.454.CMB.2.raw
tcagcgatcgtatacacgaccggtgctcgatttagatagatagacagggggtgggctcaggaggcagagctctgggaatctcaccatggcctggacccctctcctgcctcccccctcctcacttttctgcacagtctctgaggcctcctatgagctgacgcagcccaccctcagtgtcagtgtctccaggacaaacggccaagatcacctgtctttggagatgcgttgaccaaagaattctgtctttttggtaccatcagaggccaggccaggcccctgtatggtcatctatgaggacaccaagccgaaccccgtccggaactccctgagagagtcgctcggcctccgaggtcagggacaagtcgggccacttcgactactcacgtcgggacccagagtggacgagtgaagtcgaactaccacttagttacttacgacagacagctaggtggtagcggtaggggtcgttacgggcggagggacgaaggcgtacggaccgtcgtagacgtcacggccaggctccgcccttcggctacctcgtcgtccccg

SEQ ID NO: 395654 - DNA, 581 bp, Homo sapiens
  misc_feature: GZ8MTXP02IQ549.51.5.A05.1.454.CMB.2.raw
  modified_base (171)..(171): a, c, t, g, unknown or other
  modified_base (218)..(218): a, c, t, g, unknown or other
  modified_base (436)..(436): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctnagtgtcagtgtctccaggacaaacggccaagatcacctgctttgganatgcgttgaccaaagaaattctgtctttttggaccatcaggaggccgacggccacggcccctgtattggtcatctatgagaccacaagccgaccctcggaactccctagacgagacgtcccgcgtcggcctacgaggtccgaagggacaagtcgggaccctacttacgactatacacgtacgggacccagacgtggacgatggaaggtcgaactaccnttagttatcgacagacagacgaggtggtagtcggtaggggtcgtacgggagggtacggaacgaggtcgtcggtaacccgtcgtacggacttccgacgaacccggacggtcccgtccggcccccgttcggtaccaccgtttccccg

SEQ ID NO: 395655 - DNA, 637 bp, Homo sapiens
  misc_feature: GZ8MTXP02GE94M.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccaggcccctgtattggtcatctatgaggacaccaagcgacccctcggaactccctgagagagtcgctcggctccgaggtcagggacaagtcggccacttgactatcacgtcgggacccagacgtggaacgataggaaggtcgaactaaccgacttagttacttaccggaacaacggtaaccaaggccgtaagggttagggtaacgttacggggaagggggtttccgttacgggggaccggggaagggggaacggaaaggtccggtacggtaaacccggttccgttaggacggttaccgaacggcccccgaaagggtcccgttcccgggccccccgttacggggtccctaccgttcccgttaccggtttccccccc

SEQ ID NO: 395656 - DNA, 549 bp, Homo sapiens
  misc_feature: GZ8MTXP02HFR41.51.5.A05.1.454.CMB.2.raw
  modified_base (215)..(215): a, c, t, g, unknown or other
  modified_base (421)..(421): a, c, t, g, unknown or other
tcagcgatcgtatacacgaccggtgctcgatttagatagatagacagggggtgggctcaggaggcagagctctgggaatctcaccatggcctggaccccctctcctgctccccctcctcactttctgcacagtctctgaggcctcctatgagctgacgcagccaccctcagtgtcagtgtctccaggacaaacggccaagatcactgctttgganatgcgttgaccaaaagaatctgtctttttggaccatcagagccaggccaggcccctgtatggcatctatgagacaccaagccgaccctcggaatcccagagagagtcgctggcctcgaggtcagggacaatcggaccacttgactatcacgtcgggaacccagagtggacgagtagaagtcgaactaaccgatgttaactccgaanagacgagacgaggtaggtacgtcggacggggtcgtacgggaggaagggacgaacgcgtacgaccgtacgtagacgtacgacgaccgacggccgtcccgcccccgtcgacctaccgtcctaccgtcccc

SEQ ID NO: 395657 - DNA, 538 bp, Homo sapiens
  misc_feature: GZ8MTXP02FJHQ5.51.5.A05.1.454.CMB.2.raw
  modified_base (218)..(218): a, c, t, g, unknown or other
  modified_base (458)..(458): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggcaagatcacctgctttgganatgcgttgaccaaagaatctgctttttggtaccatcagaggccaggccacggcccctgtattggtcatctatgagacaccagcgaccctcggaatccctgagagagtccgctggctccgaggtcaggggacaaagtcggacctaccgttgactagtcacgtcgggacccagacgtggacgagtgaagtgactacacttgttatcgacagacagcgagtggtagtcggaggggtctcgggnggagggacgagcgtggaccgtcgtacgacgtcacggaacccgaacggtccgtccggccccctacggacctacgtttcccg

SEQ ID NO: 395658 - DNA, 597 bp, Homo sapiens
  misc_feature: GZ8MTXP02IDUUY.51.5.A05.1.454.CMB.2.raw
  modified_base (253)..(253): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaacggccaagatcacctgctttggagatgcgttgacaaagaatctgtcttttgaccatcagngccaggccaggccctgtattggtcatctatgaggacacaagccgaccctccggaatcccgtagagagagtcccgctcggctccgaggtcgagggacaagtcgacctaccgttgactatccaacgtcgggaacccagagtcggaacgtagtaggaaagttcgaaaccgttacctagttaggtttaactacgaacgtaagacgagcgtaggtacggtaaggtcggtacgggggttcttcgggggacgggtaacggggacgtaggtccgtacggaacccgttccgagaccgtcgaccggtaacccgaaggtcccacccggtcccccgtcggttacctaccgttcccg

SEQ ID NO: 395659 - DNA, 566 bp, Homo sapiens
  misc_feature: GZ8MTXP02H2QXB.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccaggcccctgtattggtcatctatgaggacaccaagccgaccctcggaactccctagagagagtccgcgtcggctaccgaggtccgagggacaagtcggccctaccgttgactataccgaccgtcggaacccagagtcggaacgtagtacggaaggtcgaactacacgttagttactacgacagacagcgagtggtaagtcggacgggggttctcggggacggagggacgaaggtcgtacggaccgtcgtgacgtacgcgtaacccgaggcctaccggccccgtcggtcctacgttcccg

SEQ ID NO: 395660 - DNA, 552 bp, Homo sapiens
  misc_feature: GZ8MTXP02JYXXY.51.5.A05.1.454.CMB.2.raw
  modified_base (365)..(365): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggccaggccaggcccctgtattggtcatctatgaggacaccagcgaccctccggaatccctgagagagtcgctcggctccgaggtcgaggacaagtggccacttgactancactgggacccagatggacgatgaagtgactaaccattagttattacgacagacagcgaggtggtagcggtagggggtcttcgggcgggtaggggacgaaaggcgtacggaccgtcgtaggacggtccgacggaccccaagggcctaccggcccccgtcggtaccaccgttccgtcggtttaccccc

SEQ ID NO: 395661 - DNA, 504 bp, Homo sapiens
  misc_feature: GZ8MTXP02FZ3NO.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggaccatcagagcagccaggccctgtatggtcatctatgagacaccaagcgaccctccggaatccctgacgagagtcgctggctccaggtcagggacaatggccacttgactatcactgggacccagactggacgatgaaaggtgaactacactgtattcgacagacagcagtgagtgagggggtctggcggagggacgaagcgtgaccgtctgacgtcaacgcccaaggctcgccccctcggtccactcgtcgttcccccg

SEQ ID NO: 395662 - DNA, 559 bp, Homo sapiens
  misc_feature: GZ8MTXP02FYY7J.51.5.A05.1.454.CMB.2.raw
  modified_base (218)..(218): a, c, t, g, unknown or other
  modified_base (316)..(316): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaaatctgtctttttggtaccatcagaggccaggccaggcccctgtatggtcatctatgagacacagcgaccctcggaatcccngagagagtccgctgctccgaggtcagggacaagtcggacctacccttgactatcacgtcgggacccagatggacgatgaaggtgactaccattgttatcgaacagacagcaagtggtaacgtcggagggggttcgtacggggacgggacgggacgaaaggcgtacggaacccggttccgtaggtacgtccgacggcccccgaaaggcccttccggcccccgttcggtaccctacctttccccg

SEQ ID NO: 395663 - DNA, 561 bp, Homo sapiens
  misc_feature: GZ8MTXP02H9Z3G.51.5.A05.1.454.CMB.2.raw
  modified_base (428)..(428): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaaagaatctgtcttttggaccatcagaggccaggccacggcccctgtattggtcatctatgaggacacaagccgaccctcggaactcccgtagagagagtccgcgtggctcgaggtcgagggcaagtcggcctaccgttgactatcacgtcggacccagatggacagtagaaggtcgactaccagtagttattcganagacagcgagtggagtcggagggggttcgttcgggacggggaagggaccgaaaggtcgtacgtaccggtccgtagacggtccgacgaaccccgaaggcccgtccggcccccgttcggtacctaccgttccccg

SEQ ID NO: 395664 - DNA, 564 bp, Homo sapiens
  misc_feature: GZ8MTXP02IDYV6.51.5.A05.1.454.CMB.2.raw
  modified_base (172)..(172): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttggagatgcgttgaccaaaagaaattctgtctttttggtaccatcagaggccaggccacggcccctgtattggtcatctatgaggacaccaagccgaccctcggaatccctagagagagtccgctcggcctcgaggtcgagggacagtcggccctacttgactataccacgtcgggacccagacgtaggacgtagtaggaaggtcgaactaccgactagttattcgactaagacagcagtaggtagcggtagggggttctacggggagggagggtacgaaggtcgtacgtaccggtctaggacgtcgaacgcccgaaggccctccggcccccgttcggcctacgttcccg

SEQ ID NO: 395665 - DNA, 540 bp, Homo sapiens
  misc_feature: GZ8MTXP02FQ9OW.51.5.A05.1.454.CMB.2.raw
  modified_base (421)..(421): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaaagaaatctgtctttttggaccatcagaggccaggccaggcccctgtattggtcatctatgaggacacaagcgaccctcggaatccctgagagagtcgctcggctccgaggtcagggacaagtggccacttgactatcactgggacccagatgggacgagtagaaggtcgaactaccgattacgttattcgaanagacagcaaggtggtagtcgagggggtcttcgggcggagggacgaaaggctggaccgtcgtagacgtcgaacgcccctaagggcctacggcccccgtcggtccactcgtcgttcccccg

SEQ ID NO: 395666 - DNA, 500 bp, Homo sapiens
  misc_feature: GZ8MTXP02FJUVG.51.5.A05.1.454.CMB.2.raw
  modified_base (439)..(439): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgcttttggaccatcagagccaggccaggcccctgtatggtcatctatgaggacaccaagcgaccctccggaatccctgagagagtccgctggctccaggtcagggcaatggccaccttgactatcactgggacccagactggacatgaaggtgactacactgtatcgacagacagcagtggtagtcgagggggtctcgggnggagggacgagctcgaccgtcctgacgtcagcccgaaggcctcgccccctggtccacgtcc

SEQ ID NO: 395667 - DNA, 593 bp, Homo sapiens
  misc_feature: GZ8MTXP02HT9X7.51.5.A05.1.454.CMB.2.raw
  modified_base (216)..(216): a, c, t, g, unknown or other
  modified_base (308)..(308): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtctttttggtaccatcagaggccaggccacggcccctgtattggcatctatgaggacaccaagccgacccncggaatccctgagagagtcgctcggctccgaggtcgagggacaagtcggcctacttgactactcacgtcgggaccctagagtacggacgtagtagaaggtcgaactacccgattacgttaatcgaacagacagctaaggtcggtaggtacggagggggtttccgtacgggggacggggaaggggacggaaacggtcgtacggtacccggtccgtggtacggtacgacgacccgaagggcccttccgcccccgtcggtacctaccgtccgttccggtttccccccg

SEQ ID NO: 395668 - DNA, 568 bp, Homo sapiens
  misc_feature: GZ8MTXP02I1UGI.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtcttttggaccatcagagccaggccacggcccctgtattggtcatctatgaggacacaacgccgaccctcggaatcccgtagagagagtcgcgtcggcctccgaggtcgagggacaagtcggcctacttgacctatccgacgtcgggacccaggatagggacgagtggaaaggtcgactaccgattgttattacgacagacgagacaggtagtagtcggtagggggtcgtcggggacgggaaggggacgaacggtcgtacggaccgtaccgtggaacgtcgaccggcccgaaggcctccggccccgttcggacctcctcgtcccgttccccg

SEQ ID NO: 395669 - DNA, 689 bp, Homo sapiens
  misc_feature: GZ8MTXP02ITR12.51.5.A05.1.454.CMB.2.raw
  modified_base (315)..(315): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagagccaggccacggcccctgtattggcatctatgagacacaagccgaccctcgaatcccngagagtgtccgctggctccgaggtcgagggcaatcggcctaccgttgactatccacgtcggacccagagtggaacgagtaggaaggtacgtaacctaccgactttagttaacgtttaccgaactaaggaaccctaagggtacccgaagggtttacgggttacgggttacgggtaaaggggggtttcccggtttaccgggggacgggggtaaacgggggtaaaaccgggaaacggttaccggttaccgggtaaaaccccgggttccgtttaacgggggaaccggttacccgaaacccgggccccgtaaaacggggtcccgttaaccccgggtccccccggttaaccggggtttccctaacccgttttcccccggg

SEQ ID NO: 395670 - DNA, 589 bp, Homo sapiens
  misc_feature: GZ8MTXP02G8OR5.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccaccctcagtgtcagtgtctccaggacaaacggccaagatcacctgctttggagatgcgttgaccaaagaatctgtcttttggaccatcagagccaggccaggcccctgtatggcatctatgagacacaagccgaccctccggaatccctgagagagtccgctggctcgagtcagggcaagtcggccactgactatcacgtcgggacccagacgtaggaacgagtacggaaggtcgaactaacccgtagttacgttacttaccgaacgtagaaccgaggacgaaggttggtaacggttcggtaagggggttccgttacggggacggggaaggggaacggaaggtccgtacggacccgttacgtcggaacgtccgacggaacccgaaggcccgttccggacccccgtggtacccacgtttcccg

SEQ ID NO: 395671 - DNA, 634 bp, Homo sapiens
  misc_feature: GZ8MTXP02HSYQI.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttggaccatcagacgcaggccacggccctgtatggtcatctatgacggacaccgaagcccgacccgtccggaactcccgtagagacgagtccgacgtggctaccgaggttccgaaggggacaaagtcggaccctaccgtttagactaacttaccgacgttacggggaacccaggacgttggaaaccgtagtaggaaaggtcgaacctaaccacgttagttaattcgaactaggaaccagcaaggttggtaacgtcgggtagggggttaccttacggggaccggggaaggggaaaccgaaaggtcgtacggtaacccggtaccgtgacggttccgaacggtaacccgtaaacggccttcccggcccccgttccgggtactaaccgttcccg

SEQ ID NO: 395672 - DNA, 674 bp, Homo sapiens
  misc_feature: GZ8MTXP02GITTP.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtcttttgaccatcagagccaggccaggccctgtatggtcatctatgaggacaccaagcgaccctcggaactccctgagagagtcgctcggctccgaggtcagggacaagtcggcctactgactatcacgtcgggaacccagacgtgggaacgagtaggtaaacggtgaaccttaacccgtagttacgtttacgttaccgaaccgaaggaccgaggaccgtaaagggtttcggggtaacggttccggggtaacggggggttccgttaccgggggagggggaaacgggggtacgggaaaacggtccggttacgggaaaccccggtttccggaacggtacggttacccgaaccgggacccccgaaaggggtccccttcccggggaccccccgtttacggggtcccttacccgttcccgtttaccccggtttcccccccgg

SEQ ID NO: 395673 - DNA, 607 bp, Homo sapiens
  misc_feature: GZ8MTXP02JTVAQ.51.5.A05.1.454.CMB.2.raw
  modified_base (179)..(179): a, c, t, g, unknown or other
  modified_base (588)..(588): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtntctccaggacaaacggccaagatcacctgctttggagatgcgttgaccaaagaatctgtcttttggacatcagaggcaggccacggcccctgtatgtcatctatgaggacacaacgcgaccctcgaactccctgagagagtcgctcggctccgaggtcgagggacaagtcggaccctacgttgactactcacgtcgggaacccaggagtcggaacgagtaggaaagggttcgaaccttaaccaacgttagtttacttaccggacgaagaacgagacgtagggtgggttaacggtcgggtaacgggggtttccgttacgggggacggggtaaagggggacgaacggtcgtacggaccgttcgtggaacgtcgaccgaccgaacggccgtccgtacccccgttcggtcccncgttcccgtcgttcccccg

SEQ ID NO: 395674 - DNA, 594 bp, Homo sapiens
  misc_feature: GZ8MTXP02JEEDT.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggccaggccaggcccctgtattggtcatctatgaggacacaagcgacctcgaactccgtgagagacgtcgctcggctccgaggtcgagggacaagtcgggacctaccgttagactatctacgtcggggaacccagagtgggaacagtaggaagtcgaactacgacgttgttaacgttacgactagacgagaccgtaggtaggtaggtcggtagggggttcgttacggggcgggaacgggacgaacggtcgtacggaccgtccgtaggacgtccgacgtcccgaaacggtccgtaccggcccccgttcggtcctacccgttccgttaccgtttacccccc

SEQ ID NO: 395675 - DNA, 547 bp, Homo sapiens
  misc_feature: GZ8MTXP02GT8KM.51.5.A05.1.454.CMB.2.raw
  modified_base (215)..(215): a, c, t, g, unknown or other
  modified_base (400)..(400): a, c, t, g, unknown or other
  modified_base (427)..(427): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaatctgtcttttggaccatcagagccaggccacggcccctgtagttggtcatctatgagacacaagccgaccctcggaactcccgtagagagagtcgtcgtcggcctaccgaggtcgagggacaagtcggacctacgttgactatcgacgtcgggacccagatggacagngaaggtgactactatagttactacganagacagcgagtgagtacgtagggggtcgtcgggaggagggacgaacgtcgtacgaccgtcgtggacgtcgacgaccgaggcctccggaccccgtcggtcctacctcgtaccgtttccccc

SEQ ID NO: 395676 - DNA, 510 bp, Homo sapiens
  misc_feature: GZ8MTXP02FI5PU.51.5.A05.1.454.CMB.2.raw
  modified_base (317)..(317): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgctttttggaccatcagaggccaggccaggcccctgtattggtcatctatgagacaccaagcgaccctcggaatcccngagagagtccgctggctccgaggtcaggggacaagtcggccaccttgactatcacgtgggacccagactggacgatgaaggtgactaccatgttatcgacagacagcagtggagtcgagggggtctcgggcggagggacgagctcgaccgtctgacgtcacgcccgaaggcctcgaccccctggccacgtccg

SEQ ID NO: 395677 - DNA, 621 bp, Homo sapiens
  misc_feature: GZ8MTXP02I2EQ8.51.5.A05.1.454.CMB.2.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaattctgtctttttggaccatcagaggccgacggccacggtcccctgtagttggctatctatgacgaccaacgacgccgacccgtcggaactcccgtgacgagacgtccgcgtcggctccgaggtcgagggacagtcggacctaccgtagactatccgacgtcggacccagacgtcggaacgagtaggaggtacgacctacgtacttacgttacttacgaacgagtaccgaggtaccgtaggttaggtacggtacgggtaacggggttcgttacggggacggggtagggaacgtaggccgtacggtaacccggtcgtacggtaacgtccgaaccgtaacccgaacggtacctcccggtacccccgttacggtccgtaccgtttccccg

SEQ ID NO: 395678 - DNA, 547 bp, Homo sapiens
  misc_feature: GZ8MTXP02HQY1A.51.5.A05.1.454.CMB.2.raw
  modified_base (218)..(218): a, c, t, g, unknown or other
  modified_base (490)..(490): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaatctgtctttttggaccatcagaggccaggccaggcccctgtattggtcatctatgagacacagcgaccctcggatccctgagagagtccgctgctccgaggtcgagggccaagtcggaccaccttgactatcacgtgggaacccagagtggacgatcggaagtgactacactagttatcgactagacagcaggtgtagtcgaggggtctggggcggagggacgaaggcgtacggacccgtcgtacgaccggttanaccggaacccgaaacggtcccgtaccggtccccctcgggtcccttacgtttccccgg

SEQ ID NO: 395679 - DNA, 564 bp, Homo sapiens
  misc_feature: GZ8MTXP02JBO0I.51.5.A05.1.454.CMB.2.raw
  modified_base (215)..(215): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaatctgtctttttggtaccatcagaggccaggccaggcccctgtattggtcatctatgaggacacaagcgaccctccggaactccctgagagagtcgctcggctccgaggtcgaggacagtcggccacttgactatcacgtcgggacccagatggacgagtagaaggtcgaactaccacttgttatacgacagacagacgtaggtgtagtcggtagggggttcgttcggggacgggaggggacgaaggtcgtacggaccgtcgtacggacgtcgacgacccgaaggccgtccggcccccgtcggtaccctaccgttccgttcccgtttcccccg

SEQ ID NO: 395680 - DNA, 568 bp, Homo sapiens
  misc_feature: GZ8MTXP02G9IJJ.51.5.A05.1.454.CMB.2.raw
  modified_base (319)..(319): a, c, t, g, unknown or other
  modified_base (325)..(325): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtcttttggtaccatcagacggccaggccacggcccctgtatggtcatctatgagacacaagcgaccctcggaactcccngagagngtccgctggctccgaggtcgagggcaagtcggccaccttgactatacacgtcggacccagacgtggacgagtcggaagtacgactaccagttaggttattaccgactagacaggactaggtcggtagtcggacgggggttcgttaccggggagggaacgggacggaacggtcgtacgaccggtcccaggacgtcgaccggaaccgaacggtccgtccggcccccgtcggtcccgactttcccg

SEQ ID NO: 395681 - DNA, 526 bp, Homo sapiens
  misc_feature: GZ8MTXP02GJSJ1.51.5.A05.1.454.CMB.2.raw
  modified_base (374)..(374): a, c, t, g, unknown or other
  modified_base (474)..(474): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgtctttttggaccatcagaggccaggccaggcccctgtattggtcatctatgaggacaccaagcgaccctccggaatccctgagagagtcgctggctccgaggtcagggacaatggccactgactatcactgggacccngatggacgatgaagtgacgtaccagtgttatcgacagacagcaagtggtatcggaggggtcttcggggacggaggggacgaagcgtacggaccgttccgnggacgcgacgccgagccgtcccgccccgtcgtacctaccgttctcccgtccc

SEQ ID NO: 395682 - DNA, 519 bp, Homo sapiens
  misc_feature: GZ8MTXP02GO1BW.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggccaggccaggcccctgtattggtcatctatgaggacaccaagcgaccctccggaatccctaggagagagtcgctggctccaggtcagggacaagtcgggccacttgactatcactgggacccagatggacgatgaaggtgactacactgtatcgacagacagcagtggagtcgagggggttctcgggcgggagggacgaaggctggaccgtctggactcgacgcccgtaaggcgtcggcccctggccacgtctccgtccccc

SEQ ID NO: 395683 - DNA, 663 bp, Homo sapiens
  misc_feature: GZ8MTXP02GFNXW.51.5.A05.1.454.CMB.2.raw
tcagcgatcgtatacacgaccggtgctcgatttagatagatagacagggggtgggctcaggaggcagagctctgggaatctcaccatggcctggaccccctctcctgctcccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagagcaggccaggcccctgtattggtcatctatgacggacaccgaagccgaccccgtaccggaactcccgtagacgagacgtccgctcggcctaccgaggtacaggggaccaagtcggacctacttgactactcgacgtcgggaacccagacgtggaacgtagtaggaaaggtcgaaccctaaccgtacgttagtttaacgttaccggaactaacgaacgacgtacgtaagggttcgggttaaacggtcggggttaaggggggttccggttccgggggacggggaacgggggtaacgaaacggtccggttacggtaaccggtccgtaggacgtaccgaaccggtcccgaacgggtcccgtacccggcccccgttacgggccctaccgttccgtttcccggttacccccg

SEQ ID NO: 395684 - DNA, 563 bp, Homo sapiens
  misc_feature: GZ8MTXP02JBRJU.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggtaccatcagaggccaggccaggcccctgtattggtcatctatgagacacaagcgacctcggaactccctgacgagagtcgctcggctccgaggtcaggacaagtcgggccacgtgactatcactgggacccagacgtgacgatagaaggtgaactaactactgttacttacgaacagacagctaggtggtagtcggagggggttcttcggggcggtaggggacgaaggccgtaggaccgtcgtggacgtcgacggaccccgaagggccttcccggacccccgttcgggtaccctaccgttccgttccgttacccccc

SEQ ID NO: 395685 - DNA, 524 bp, Homo sapiens
  misc_feature: GZ8MTXP02H6LLG.51.5.A05.1.454.CMB.2.raw
  modified_base (218)..(218): a, c, t, g, unknown or other
  modified_base (281)..(281): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaatctgtcttttggaccatcagagccaggccaggcccctgtattggtnatctatgagacacaagcacctcgatccagagagagtccgcgtggctcgaggtcgagggcaagtcgaccacttgactatcacgtggacccagacgtaggacgagtacggaagtcgaacctacacgttgttattcgacgtaggcaggctaggtggtaggtcggagggggttctgggcggaaggacgagcgcgaccgtcgtaggactcgacgccgacggactccggcccctcggacctacttcccg

SEQ ID NO: 395686 - DNA, 521 bp, Homo sapiens
  misc_feature: GZ8MTXP02G3ZX3.51.5.A05.1.454.CMB.2.raw
  modified_base (406)..(406): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgtctttttggaccatcagaggccaggccaggcccctgtatggtcatctatgaggacaccaagcgaccctccggaatccctgagagagtcgctcggctccaggtcagggacaatggccacttgactatcactgggacccagatggacgatgaaggtgactacatgtatcganagacagcagtggtagtcgagggggtctcgggcggagggacgaagcgtagaccgtcctggacgtcgacgtcccgaaggcctacggcccccgtcggtccacttcctacgtttccccc

SEQ ID NO: 395687 - DNA, 548 bp, Homo sapiens
  misc_feature: GZ8MTXP02JPIW8.51.5.A05.1.454.CMB.2.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtcttttggtaccatcagaggccaggccacggcccctgtattggtcatctatgaggacaccaagccgacccctcggaatcccagagagacgtccgcgtggctccgaggtcgaggggacaaagtcggacccaccgttgactactcacgtacggacccagagtggacgagtgaaggtcaacgtacacttagttattcgacagacagacgaggtggtacgtcggaggggtcgtcgggagggacggacggacgcgacggaccgtcgtagacgtcgacgccgaacgccgtaccgccccgtcggtccacgttccg

SEQ ID NO: 395688 - DNA, 637 bp, Homo sapiens
  misc_feature: GZ8MTXP02GYO6W.51.5.A05.1.454.CMB.2.raw
  modified_base (218)..(218): a, c, t, g, unknown or other
  modified_base (316)..(316): a, c, t, g, unknown or other
  modified_base (374)..(374): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccacctcagtgtcagtgtctccaggacaaacggccaaagatcacctgctttgganatgcgttgaccaaagaatctgtcttttggaccatcagacggccaggccaggcccctgtattggcatctatgagacacagccgaccctcggaactcccngagagagtccgctgctccgaggtacgagggacaatcgggaccctaccgttgacttacnccacgtacgggaccccaagacgtggaaccgagtaggaaacggtgtaacctacctacgttaggttacttacggacaacgactagacaaggtggtaggttcggaacgggggttccgttacggggcggggtaacggggtaacccggaaggtccggtacggtaccccggttaacccggtacggtaccgtaccggaaccggtaacccggtaacggtccccggttacccccggtacccccggttaccggtacccttacccggttccccg

SEQ ID NO: 395689 - DNA, 650 bp, Homo sapiens
  misc_feature: GZ8MTXP02FQ80I.51.5.A05.1.454.CMB.2.raw
  modified_base (216)..(216): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgccaaagaaatctgtctttttggtaccatcagaggccaggccaggcccctgtatggtcatctatgagacaccaagcgaccctcggaatccctgagagagtcgctcggctccgaggtcaggggacaatcgggacctaccttagacctatcgacgtacggggaaccccagaagtacgggaacgtagtaggaaagggtgtaaaccgtacctaacgttggttaactttcggaacaagaaccgaggaccgaagggttgggtaacggttcggtaaggggggttcctttacgggggccggggaaagggggacggaaaggtccgtagggacccggttccgttaggaacggttcgaacggaccccgaaaggggtcccgtaccggtcccccccgttacggggttccctaaccgtttccgttccggtttcccccccgg

SEQ ID NO: 395690 - DNA, 697 bp, Homo sapiens
  misc_feature: GZ8MTXP02GQY03.51.5.A05.1.454.CMB.2.raw
  modified_base (327)..(327): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtcttttgaccatcagaggccaggccaggcccctgtattggtcatctatgacggacaccaagccgaccctccggaatccctgagagagtcncgtcggctccgaggtcgagggaccaagtcgggacccacgttgactatcacgtcggggacccagacgtagggaacgataggaagtcgaactaccgtattacgttattaccgaactaacgaccaaggcctaagggttagggtaacggttacgggtacgggggggttactttaccgggggcggggttaaacgggggaaacggaaacgggtccggttaccggggtaacccggttcccggttacggtaaccggttaccgaaaccgggttacccccgaaaagggggtccccgttaacccccgggtaccccccccggtttacgggggttccccctaaaccgtttcccccggtttccccggttttaaccccccccccg

SEQ ID NO: 395691 - DNA, 710 bp, Homo sapiens
  misc_feature: GZ8MTXP02JRUBU.51.5.A05.1.454.CMB.2.raw
  modified_base (172)..(172): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcacctgctttggagatgcgttgaccaaagaactctgtctttttggaccatcagacggccaggccacggcccctgtagttcggtctatctatggacggaaccaccaacggcccgtaccccgtaccggtaactccccgtagacggagtacgtcccgcgtcgggtcctaccggagggtcgaacgggactaacggtcgggaccctacgttacggaacttacgtaccgtaaccggtcgggaaaccccaggaacgttacggggaaaccgtaggttaacgggaaacggggttactaaaccccgttaaccttaacggtttacggtttaaacgtttaccggaaacccgtaaggaacgtacggtaccgtaagggttagggtacgggtaccggggtagggggttccgttcggggacggggaacgggtacggaacggcgttaccggaccggtccgagtaccgcgaaccggccgaaacgggtcctcccggtcccccgtggtaccctacgtttaccccg

SEQ ID NO: 395692 - DNA, 556 bp, Homo sapiens
  misc_feature: GZ8MTXP02J0DTD.51.5.A05.1.454.CMB.2.raw
  modified_base (219)..(219): a, c, t, g, unknown or other
  modified_base (528)..(528): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtcttttggaccatcagaggccaggccaggcccctgtattggtcatctatgaggacaccgaagccgaccctccggaactcccgtagagagagtccgctggcctccgaggtcagggcaagtggacctacgttgactatccacgtcgggacccagagtggacgagtggaacggtgaacctaccagttacgttattcgacagaccagtacaggtggtagtcggagggggttcctcggggacgggaagggacggaagcgcggaccgtcgtagacgtcgacgcccgaaggtccnccgcccccgtcggtacctaccgttcccg

SEQ ID NO: 395693 - DNA, 531 bp, Homo sapiens
  misc_feature: GZ8MTXP02G02KG.51.5.A05.1.454.CMB.2.raw
  modified_base (421)..(421): a, c, t, g, unknown or other
  modified_base (470)..(470): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtcttttggtaccatcagaggccaggccaggcccctgtatggtcatctatgaggacacagcgaccctccggaactcccgtgagagagtccgctggctccgaggtcagggcaagtcggccaccttgactatcacgtcggacccagagtggacgatggaaggtgactacacgttagttatccganagacagcaggtggtacgtggagggggtctggggacgggagggacgaagngtacgaccgtcgtagacgtcacgcccgtaaggccgtacgccccgtcggtccacgtttcccg

SEQ ID NO: 395694 - DNA, 529 bp, Homo sapiens
  misc_feature: GZ8MTXP02HNVOA.51.5.A05.1.454.CMB.2.raw
  modified_base (215)..(215): a, c, t, g, unknown or other
  modified_base (512)..(512): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgccaaagaatctgctttttggacatcagaggccaggccaggcccctgtattggtcatctatgaggacacaagcgaccctccggaatccctgagagagtcgctcggctccaggtcaggacaatcggccacttgactatcacgtcgggacccagatggacgatgaagtgactacactgttatacgtacagactagcaggtaggtagtcgagggggtcttcgggacgggagggacgaagcgtcggaccgtcgtggacgtcgacgcccgtaaaggccgcggccccctcggaccnctccgttcgtttccccc

SEQ ID NO: 395695 - DNA, 563 bp, Homo sapiens
  misc_feature: GZ8MTXP02IGT9L.51.5.A05.1.454.CMB.2.raw
  modified_base (217)..(217): a, c, t, g, unknown or other
  modified_base (424)..(424): a, c, t, g, unknown or other
tcagcgatcgtatacacgaccggtgctcgatttagatagatagacagggggtgggctcaggaggcagagctctgggaatctcaccatggcctggacccctctcctgctcccccctcctcactttctgcacagtctctgaggcctcctatgagctgacgcagcccaccctcagtgtcagtgtctccaggacaaacggccaagatcacctgctttgganatgcgttgaccaaagaaatctgtctttttggtaccatcagagccaggccaggcccctgtattggtcatctatgaggacaccaagccgaccctccggaactccctagagagagtcgctcggcctaccgaggtcagggacaagtcggcctactgactatcactcgggacccagatggacgagtagaaggtgactaccatagttatcganagacagcaggtggtagtcgagggggtcttcggggacggagggacgaaggtcgaggtacccgtcgttaggacgtacgacggacccgaaggcccgttcggccccccgttcgggtacctaccctccgttccgtttccccccg

SEQ ID NO: 395696 - DNA, 589 bp, Homo sapiens
  misc_feature: GZ8MTXP02GJRM9.51.5.A05.1.454.CMB.2.raw
tcagcgatcgtatacacgaccggtgctcgatttagatagatagacagggggtgggctcaggaggcagagctctgggaatctcaccatggcctggaccccctctcctgctccccctcctcactttctgcacagtctctgaggcctcctatgagctgacgcagccaccctcagtgtcagtgtctccaggacaaacggccaagatcacctgctttggagatgcgttgaccaaaagaaatctgtctttttggaccatcagaggccaggccaggcccctgtattggtcatctatgaggacacaagccgaccctccggaatccctgagagagtcgcgtcggctccgaggtcgagggacaagtcggaccacttgactatcacgtcgggacccagacgtggacgatgaaggtcgacgtaccacgttgttattacgacagacagcgaaggttaggtaaggtcggaacgggggttcgttacgggggcgggtaacgggggacgaaagcgttcgggaaccggttccgtagggacgtcgaacggcccgaaaggcccgtccggcccccgtacggtcctacccgttccgtccggtttccccccg

SEQ ID NO: 395697 - DNA, 568 bp, Homo sapiens
  misc_feature: GZ8MTXP02I0RBC.51.5.A05.1.454.CMB.2.raw
  modified_base (288)..(288): a, c, t, g, unknown or other
  modified_base (318)..(318): a, c, t, g, unknown or other
  modified_base (324)..(324): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaattctgtcttttggaccatcagagccaggccaggcccctgtattggcatctangaggacaccagccgaccctcggaactcccngagagngtcccgctggctccgaggtcagggacaagtcggccctacttgaactatccgaacgtcgggaacccagacgtaggacgagtagaaaggtcgaactaccgattgttatcgacagacagctaggtgtagtggaggggttcgtcggggacgggaacgggacggaacggtcgacggtcccggtaccgtggacgtccgacggaacccgaacggccgtacccggcccccgttcggccgtacctttccccgg

SEQ ID NO: 395698 - DNA, 570 bp, Homo sapiens
  misc_feature: GZ8MTXP02G8TCJ.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtcttttggaccatcagaggccaggccaggcccctgtattggtcatctatgagacaccaagccgaccctcggaactcccgtgagagagtcgctcggcctccgaggtcgagggacaagtcggccacttgactatcacgtcgggacccagagtgacgatggaagtcgactaccacgttgttactcgactagacagctaggtggacgtcggagggggttcttacggggcgggaaggggacgaacggcgtacggaccgtccgtaggacgtccgacggaccccaaggggtccctacccggtcccccgttacgggtcctaccgttccgtccgtttcccccc

SEQ ID NO: 395699 - DNA, 724 bp, Homo sapiens
  misc_feature: GZ8MTXP02GSP6R.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaaagaaatctgtctttttggacatcagaggccaggcccgaccgtccgtagttagttcgactacgtatagaggacgaccaacgacgacccgtacccgacgtacctccgagagagtcgctggtccgtccacgtagacggacgaactacggccgacctgtacgtactacgactacgggaccgaaccgattacggacgaacgtagtaagggtaacggtacctaacccgtaacgttacgtttagtttaccgtaaaccgaaacggtaaacgaacggtaccgtaggtagggggtttaacgtaaccgggttacggggggtaacgggggttttcccggggacgggggaaacgggggtaaaccggggaaaaggtccgtttacgggacccggggttaacccggtttcggaacgggttacgtaccggaccgaaaaccggtaccggtcccgtacccccggtccccggttacggtaccctaccgttcccggtttaccccggttcccccccg

SEQ ID NO: 395700 - DNA, 576 bp, Homo sapiens
  misc_feature: GZ8MTXP02GBC0C.51.5.A05.1.454.CMB.2.raw
tcagcgatcgtatacacgaccggtgctcgatttagatagatagacagggggtgggctcaggaggcagagctctgggaatctcaccatggcctggaccccctctcctgctccccctcctcactttctgcacagtctctgaggcctcctatgagctgacgcagccaccctcagtgtcagtgtctccaggacaaacggccaagatcacctgctttggagatgcgttgaccaaagaaatctgtctttttggaccatcagaggcaggccaggcccctgtattggtcatctatgaggacaccaagccgaccctcggaactcccgtgagagagtcgcgtcggcctccgaggtccgaggggaccaagtcggacccacgttgacctatcacgtcgggacccagtagtcggaacgagtggaaggtcgaactaccgagttagttacttacgacagacagctaaggtggtaagtcggtaggggtcgttcgggcggagggacgaaggcgtacggaccgtccgtggacgtacgacgacccgaaggtccgtccggtcccccgtcggtccaccgttccgttccggttccccc

SEQ ID NO: 395701 - DNA, 762 bp, Homo sapiens
  misc_feature: GZ8MTXP02JP6YJ.51.5.A05.1.454.CMB.2.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgctttttggaccatcagaggccaggccaggcccctgtattggtcatctatgaggacacaagcgaccctcggaatccctgagagagccgctggctccgaggtcgacggggacaaacgtcggggaccctaaccgtttcgggaaccttacgttacccgtaaccgttacggggggaaaccccctaagggacgttacggggaaacccggaatttacgggggaaaagggtttacgggaaaccctttaaaccccgaaccgttttaggggtttaaactttcccggaaaccgtaaaggaacccgtagggtaccgaagggtttacgggttaaaggttccgggtaaaggggggggttccttttccgggggacgggggttaaacgggggaaaccgggaaaacgggtcccgttaacgggggaaacccccgggttcccggtttagggaaaccggtttccgaaacgggtcccccgaaaagggggtccccttaccgggcccccccgttaccgggggttaccctacccggttttcccccgg

SEQ ID NO: 395702 - DNA, 536 bp, Homo sapiens
  misc_feature: GZ8MTXP02FURTO.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctactatgagctgacgcagccaccctcagtgtcagtgtctccaggacaaacggccaagatcacctgctttggagatgcgttgaccaaagaatctgtctttttggaccatcagagcagccaggcccctgtatgtcatctatgagacaccaagcgaccctcggaatcccgtgagagagtcgctgcctccaggtcagggacatggccacttgactatcacgtcgggacccagataggacgatagaaggtcgactacgacttagttattacgacagacagacgtaggtaggtagtcgagggggtcttcgggcggagggacgaagcgtaggaccgtccgtgcggtacacgcccgaacggccgtacgcccccgtcggtcctacggtcctccggttaccccc

SEQ ID NO: 395703 - DNA, 593 bp, Homo sapiens
  misc_feature: GZ8MTXP02HYILN.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtcttttggtacctatcagaggccaggccaggcccctgtatggtcatctatgaggacacaagccgaccctcggaactcccgtgacgagacgtccgctggcctccgaggtcgagggacagtcggaccctacgttagactatcacgtcggacccagacgtggaacgtagtacggaaggtcgaacctaccgacttagttacgttacgaactaagaccaggaccgtaggtcggtaaggtcggaacgggggttcgttacggggacggggtaaggggaacgaggtcgtacggtaaccgtcgtacgacgtcgacggcccgaaggtccgtcccggtacccccgtcggtacctaccgttcccg

SEQ ID NO: 395704 - DNA, 511 bp, Homo sapiens
  misc_feature: GZ8MTXP02GAFNP.51.5.A05.1.454.CMB.2.raw
  modified_base (374)..(374): a, c, t, g, unknown or other
tcagcgatcgtatacacgaccggtgctcgatttagatagatagacagggggctgtgggctcaggaggcagagctctgggaatctcaccatggcctggacccctctcctgctcccccctcctcactttctgcacagtctctgaggcctcctatgagctgacgcagccaccctcagtgtcagtgtctccaggacaaacggccaagatcacctgctttggagatgcgttgaccaaagaaatctgctttttggtaccatcagagccagccagcccctgtatgcatctatgagacaccaagcaccctcgaatccctgagagagtccgctggctccaggtccagggcaaatggccaccttgactatcactggacccaganggacgatgaagtgactaccatagttattcgaacagacagcaagtggtagtcgaggggtctggcgggaggacgaaagctgaaccgtctgacgcgaacgcccgaaaggcctcgcccccgttacggtccaacgtttcccg

SEQ ID NO: 395705 - DNA, 568 bp, Homo sapiens
  misc_feature: GZ8MTXP02IRO19.51.5.A05.1.454.CMB.2.raw
  modified_base (176)..(176): a, c, t, g, unknown or other
  modified_base (217)..(217): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtntcagtgtctcaggacaacggccaagatcacctgctttgganatgcgttgaccaaagaattctagtctttttggacctatcagaggccaggccaggcccctgtatggtcatctatgaggacacaacgcaccctcggaactccctgagagagtccgctgctcaggtcgagggcaatcggacctacttgactatcacgtcggacccagagtgggaacgagtggaaaggtcgaacctaccgtacttaggttacttacgaacagacaggtacgaggttggtaacgtggtaacgggggttcgttacggggacgggaagggacggagcgtcggtaacccgtcgtacggacgtcgacgcccgaacggtcgtacccggccccgtacggtcaccgtttcccg

SEQ ID NO: 395706 - DNA, 564 bp, Homo sapiens
  misc_feature: GZ8MTXP02IE17G.51.5.A05.1.454.CMB.2.raw
tcagcgatcgtatacacgaccggtgctcgatttagatagatagacagggggtgggctcaggaggcagagctctgggaatctcaccatggcctggacccctctcctgctcccccctcctcacttttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccaggcccctgtattggtcatctatgaggacaccaagcgaccctccggaactcccgtagagagagtcgctcggctcgaggtcagggacaagtcggcctacttgactatcgacgtcgggacccagacgtggacgagtgaaggtcgaactaccattagttacttacgacagacagcgaggtggtagtcggagggggttcgttcgggcgggaagggacgaacggtcgtacggaccgtccgtaggacgtcgacggcccgaaggccgtccggccccgtcggtccaccgtttcctccgtttaccccc

SEQ ID NO: 395707 - DNA, 568 bp, Homo sapiens
  misc_feature: GZ8MTXP02INZP3.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgggagatgcgttgaccaaagaatctgtctttttggtaccatcagaggccaggccaggcccctgtattggtcatctatgaggacaccaagcgaccctccggaatccctgagagagtcgctcggcctccgaggtcgagggacaagtcggccacttgactacgtcacgtcgggacccagagtggacgatagaagtcgactactatgttattcgacagacagcaggtggtacggtcgagggggttcttcggggcgggaaggggacgaaggtcgtcggaaccggtccgtaggacgtaccgacggcccgaaacgggtccgtacggcccccgttcgggtcctaccgttccgttcgttccccccg

SEQ ID NO: 395708 - DNA, 536 bp, Homo sapiens
  misc_feature: GZ8MTXP02HWX4B.51.5.A05.1.454.CMB.2.raw
  modified_base (370)..(370): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgccaaagaatctgctttttgtaccatcagagcagccaggcccctgtattggcatctatgagacaccaagcgaccctcggaatccctgagagagtcgctggctccgaggtcaggacaatcggccacttgactatcactgggacccagntaggacatgaagtgactacatgtatcgacagacagcaggtgtagtcgaggggtcgttcggacgggagggacgaagtcgtacggaccgtccgtaggacgtcgacggaccccgaagggcccgttccggccccccgttcggtcctacccgttccgtccggtttcccccg

SEQ ID NO: 395709 - DNA, 627 bp, Homo sapiens
  misc_feature: GZ8MTXP02JVX4C.51.5.A05.1.454.CMB.2.raw
  modified_base (488)..(488): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttcggaccatcagagccaggccacggcccctgttatggtcatctatgaggacaaccaagccgaccccgtaccggaactccctagagagacgtcgctcggctccgaggtcagggacagcggacctacttgactatccgacgtcgggaacccaggacgtaggaccgagtacggtaaagtcggaacctacgtaacgttagttaacgttacgacgtaacggacaggtactaggggttaggtaggttacggngggggtttaccggtcggggacggggagggggaacggaaggtccgtagggacccggtcgtcggaacggttcgaccggacccgaacggtccgtcccgtacccccggtcggtccctaccgttcccggtaccgtttacccccc

SEQ ID NO: 395710 - DNA, 580 bp, Homo sapiens
  misc_feature: GZ8MTXP02G0AEM.51.5.A05.1.454.CMB.2.raw
tcagcgatcgtatacacgaccggtgctcgatttagatagatagacagggggtgggctcaggaggcagagctctgggaatctcaccatggcctggaccccctctcctgctccccctcctcactttctgcacagtctctgaggcctcctatgagctgacgcagccaccctcagtgtcagtgtctccaggacaaacggccaagatcacctgctttggagatgcgttgaccaaagaatctgctttttggacatcagagccaggccaggcccctgtatggtcatctatgacggacaccaacgccgacccgtccggaactcccgtagacgagtacgtcgctcggcctcgagggtacaggggacaagtcggcctacgtgactatcacgtcgggaccagagtggacgagtagaaggtcaccgtactaacttgttactacgacagacgtagctagggtaggtagtccggagggggttcgtacgggcgggtagggacggaacgtccgtacggacccgtccggaggacgtccgaacggtcccaacgggtcgtcccgtaccccgtggtcccacggttccctcggttaccccc

SEQ ID NO: 395711 - DNA, 529 bp, Homo sapiens
  misc_feature: GZ8MTXP02J3EYN.51.5.A05.1.454.CMB.2.raw
  modified_base (361)..(361): a, c, t, g, unknown or other
  modified_base (394)..(394): a, c, t, g, unknown or other
  modified_base (413)..(413): a, c, t, g, unknown or other
  modified_base (512)..(512): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccaggcccctgtattggtcatctatgagacacaagcgaccctcggaatccctgagagagtcgctggctccgagtcagggacaatcgggccaccttgactntcactggggacccagatggacgatcgaagggtnactaccactgttattcganagacagcagtggtagtcgagggggtcttcggggcggagggacgaagcgtaggaccgtccgtagacgcacggcccaaggccgtcggccccctggtacccnccgttccgtcgtccccg

SEQ ID NO: 395712 - DNA, 516 bp, Homo sapiens
  misc_feature: GZ8MTXP02I3FZ2.51.5.A05.1.454.CMB.2.raw
  modified_base (215)..(215): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgccaaagaatctgtctttttggtaccatcagaggccaggccaggcccctgtatggtcatctatgaggacaccaagcgaccctccggaactccctgagagagtcgctcggctccgaggtcagggacaagtggccacgttgactatcacgtcgggacccagagtgacgatgaagtgaactacactgttatcgacagacagcagtggtagtcgagggggtctagggcggagggacgaagtcgagaccgtctagacgtcgagcccaaggcgcgcccctcggtcactcgtcgttccccg

SEQ ID NO: 395713 - DNA, 513 bp, Homo sapiens
  misc_feature: GZ8MTXP02GBNFH.51.5.A05.1.454.CMB.2.raw
  modified_base (218)..(218): a, c, t, g, unknown or other
  modified_base (366)..(366): a, c, t, g, unknown or other
  modified_base (390)..(390): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaaatctgctttttggtaccatcagaggccaggccaggcccctgtattggtcatctatgaggacaccaagcgaccctccggaatccctgagagagtccgctggctcaggtcagggcaatcggccacttgactancacgtcgggacccagatggacgangaagtgactacacttgttatcgacagacagcagtggtagtcgaggggtctcgggcgggaggacgagctcggaccgtcgtgacgtcgacgcccgaagtcgtaccgccccgtcggcctactcccg

SEQ ID NO: 395714 - DNA, 624 bp, Homo sapiens
  misc_feature: GZ8MTXP02GWZZY.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccacctcagtgtcagtgtctccaggacaaacggccaagatcacctgctttggagatgcgttgaccaaagaatctgtcttttggtaccatcagaggccaggccacggcccctgtattggtcatctatgagacacaagcgaccctcggaactccctagagagagtccgctggctccgaggtcgaagggacaagtcggccctaccttgactatcacgtcggaacccagacgtggaacgagtacggaaaggtcgaaccgtacctaacgttagttacgttaccggaactagaaccagacgaaggttgggtaacggtcgggtaacgggggttcggttaccggggacgggggaacggggaacggaaacggtcgtacgggacccggttaccgtaggtacgtccgaccggaacccgaaacgggtcccttacccggccccccgtttacgggtccctacccgtttccccg

SEQ ID NO: 395715 - DNA, 546 bp, Homo sapiens
  misc_feature: GZ8MTXP02H8WCG.51.5.A05.1.454.CMB.2.raw
  modified_base (413)..(413): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgtcttttggtaccatcagagccaggccaggcccctgtattggtcatctatgaggacacaagcgaccctccggaatccctgacgagagtccgctggctcgaggtcagggcaagtcgccaccttgactatcacgtggacccagatggacgatggaagtgactacactgttattcganagacagcaggtaggtagtcggagggggttcgttcgggcgggtaaggggaccgaaggcgtcgaacccggtccgtaggacgtcgaacggaaccccgaaggtcctcggcccccgtacgggtccaacccgtttcccg

SEQ ID NO: 395716 - DNA, 594 bp, Homo sapiens
  misc_feature: GZ8MTXP02JT0M4.51.5.A05.1.454.CMB.2.raw
  modified_base (219)..(219): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtcttttggaccatcagacgccaggccacggccctgtacttggtcatctatgagacacgaacgccgaccctcggaactcccgtagagagacgtccgcgtcgctcgaggtcgagggacagtcggacctactgactacacgacgtcggacccagagtggaacgtagtaggaacggtcaaccgtaccgatttacggttaactaccgaacgtagacacggtagtaagggttcgggtaagtccgggtagggggttccttagggggcgggtaagggacggaacgcgtacggtacccgtcgtcgaccgtcgacgaacccggacggtcccgtcccggcccccgttacggtccctcgtttcccg

SEQ ID NO: 395717 - DNA, 563 bp, Homo sapiens
  misc_feature: GZ8MTXP02JARYL.51.5.A05.1.454.CMB.2.raw
  modified_base (219)..(219): a, c, t, g, unknown or other
  modified_base (254)..(254): a, c, t, g, unknown or other
  modified_base (276)..(276): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgacaaagaatctgtcttttgacatcagngcaggccaggccctgtatgtcntctatgagacacagccaccctcggactccgtgagagcgccgctggctcgaggtacgagggacagtcggcctactgactatcacgtcggacccagagtggacgagtaggaaaggtcgaactactacgtttagttacttacgaacagacgtaggacgtagggtaggtacggtcggtagggggtcgttcggggacgggagggaacggaacgcgtacgggtaccctccgtgaaccgcgaacggaacccgaaggtcccgtaccggtcccccgtcggtacctaccgtttcccg

SEQ ID NO: 395718 - DNA, 565 bp, Homo sapiens
  misc_feature: GZ8MTXP02GOLCH.51.5.A05.1.454.CMB.2.raw
  modified_base (326)..(326): a, c, t, g, unknown or other
  modified_base (470)..(470): a, c, t, g, unknown or other
  modified_base (505)..(505): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgttgaccaaaagaatctgtctttttggaccatcagaggccaggccaggcccctgtattggtcatctatgagacacaagcgacctcggaatccctgagagagtcgcncggctccgaggtcgaggacaagtcggcctactgactatcgacgtcgggaccagactggaacgatgaaacggtgaacctacctatagttagttcgaacaagacgagcgtagggtaggtaacgtcggtagggggtcttacgggggnggaacggggacgaaggcgtacggaccggttccggngacgtacgaccgccgacggtccgtcccgtccccgtcgtactaccgttccgtccgtccccg

SEQ ID NO: 395719 - DNA, 559 bp, Homo sapiens
  misc_feature: GZ8MTXP02F9CD6.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttgacatcagagcagccaggccctgtatggtcatctatgagacacaagccacctcggaactccctgagagagtcgctggcctccgaggtcgagggacaagtcgggccacgttgactatcgacgtcgggacccagagtggaacgagttagaaggtcgaacctaccagttagttattacgaacagacagacaggtggtacgtcggagggggttcttacgggacgggagggacgtaacgcgtcggaccgtcgtggacgtcgaacgcccgaacggccgtacccggccccgttcggtcctaccgttccttccggttacccccc

SEQ ID NO: 395720 - DNA, 618 bp, Homo sapiens
  misc_feature: GZ8MTXP02IEH0L.51.5.A05.1.454.CMB.2.raw
  modified_base (218)..(218): a, c, t, g, unknown or other
tcagcgatcgtatacacgaccggtgctcgatttagatagatagacagggggtgggctcaggaggcagagctctgggaatctcaccatggcctggacccctctcctgcctcccccctcctcactttctgcacagtctctgaggcctcctatgagctgacgcagcccaccctcagtgtcagtgtctccaggacaaacggccaagatcacctgctttgganatgcgttgccaaagaatctgtctttttgacatcagagcaggccaggccctgtatgtcatctatgacgacaccgaacgcgacccgtcgaactcctagagagacgtcgcgtcggcctccgaggtcgaagggtaccaagttcgggacccctacgttcgaacttatccgacgtacgggacccaggacgtaggacgtataggaaggtacgaactaccctacgttgttaacttacggaacagacgagacgtaggtacggtaggacggtagggggttcgtcggggaggacggggtacgaacgcgttacggaccggtacttacgggacgttaccgacggacccgaacgggtcccgttaccggacccccgttcggtaacccgtccgtttccttcccggtttaccccccg

SEQ ID NO: 395721 - DNA, 617 bp, Homo sapiens
  misc_feature: GZ8MTXP02ITO7N.51.5.A05.1.454.CMB.2.raw
  modified_base (212)..(212): a, c, t, g, unknown or other
  modified_base (371)..(371): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccacctcagtgtcagtgtctcaggacaaacggcaagatcacctgctttgganatgcgttgaccaaagaattctgtctttttggaccatcagagccaggccaggcccctgtattggtcagtctatgaggacacaagcgacctcgaactccctgagagacgtcgcttcggcctccgaggtcagggaaccaagcgggaccaccgttgaccttancgaccgtacgggacccagacgtggacgagtagaaggtcacgtacacgttagttattacgacaggacagacgtaggtaggtacggtacggtacgggggttcgttaccggggcgggaacgggggacggtaaacggtccggtacggtaacccggttccggtaggtaaacggttccgaccggtacccgaaacgggtccgtacccggtcccccttacggggtcctaaccggttcctaccggtttccccccg

SEQ ID NO: 395722 - DNA, 598 bp, Homo sapiens
  misc_feature: GZ8MTXP02JNP47.51.5.A05.1.454.CMB.2.raw
  modified_base (316)..(316): a, c, t, g, unknown or other
tcagcgatcgtatacacgaccggtgctcgatttagatagatagacagggggtgggctcaggaggcagagctctgggaatctcaccatggcctggaccccctctcctgcctcccccctcctcactttctgcacagtctctgaggcctcctatgagctgacgcagccaccctcagtgtcagtgtctccaggacaaacggccaagatcacctgctttggagatgcgttgaccaaagaatctgtcttttgaccatcagaggcaggccacggcccctgtattggtcatctatgaggacaccaagccgaccctcggactccngagagagtcgcgtcggctccgaggtcgagggacaagtcggacctacgttgacctatccgacgtcgggaacccagaacgtcggacgagtaggaaggtcgaacctaccgtacgttagttacttacgacgagtacgagcgtagggtggtacggtcggtagggggttcgttcggggacggggagggtacgaaggcgtacggtacccgtcgtaggacgtaccgacggacccgtacggcccgtcccggcccccgttcggaccctccgttcccgttcccgttacccccg

SEQ ID NO: 395723 - DNA, 780 bp, Homo sapiens
  misc_feature: GZ8MTXP02HMCC2.51.5.A05.1.454.CMB.2.raw
  modified_base (216)..(216): a, c, t, g, unknown or other
  modified_base (319)..(319): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtctttttggaccatcagaggccaggccaggcccctgtattggctatctatgaggtacaccaagccgaccctcggaatcccgngacgagagtcgacgtcggcctaccaggtcaggggacaagtcgggaccaactttcgactagtcgacgttcggggaaccctaggaacgttacggggaaacgtacggttacgggtaaaacgggttacggtaaacccttaaccccgtaacgtttacggtttaaaccgttttccggggaaaaccgtaaacggggttaaacccgttaacggggtaccccgttaaaggggttacgggggtttaaaccggtaccggggttaaacgggggggtttacccttttaccggggggaacccggggtttaaggggggaaaacccggtaacgggtaccgttaccgggaaacccgggtttccccgtttaaggggacccggtttaccgtaccgggaacccccgtaaaggggtcccgttacccggaccccccggtttcggggtacctaacccggttcccgtttacggtttacccccccg

SEQ ID NO: 395724 - DNA, 690 bp, Homo sapiens
  misc_feature: GZ8MTXP02GRLUE.51.5.A05.1.454.CMB.2.raw
  modified_base (219)..(219): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtctttttggaccatcagaggccaggccaggcccctgtattggtcatctatgagacacagcgaccctcggactcccgtgagagagtccgctgctcgaggtcgagggcaagtcggcctacttgactatcacgtcggacccagagtcggacgagtaggaaggtcgaacctacctacgttagtttaacgttaccgaacgtaagacccgaaggtaccgtaagggttacggggttaacggttacgggggtaacggggggtttcccgtttacggggggacgggggttaaaacgggggaaccggtaaaacgggtcccgttaccggggtaaacccccggttccggtaacggggtaaccggttaccggaaaccggggtaacccccggaaaacggggtcccccgttaccccgggtacccccccggtttcgggggttaccccttaacccgttttccccccgg

SEQ ID NO: 395725 - DNA, 639 bp, Homo sapiens
  misc_feature: GZ8MTXP02HJB5D.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtcttttggtacatcagaggcaggccaggcccctgtattggtcatctatgaggacacaagcgaccctcggaatccctgagagagtcgcgtcggcctccgaggtcgaggggacaagtcgggacctacttaggacctactacgacgtcggggacccaaggagtacgggacgagtaggaaaggtcgaacctaccgtaacgttgttaacgttaccggaaacgtaaggacctaagcgtagggttagggtacggttcgggtaacggggggttccgtttacgggggacgggggaacgggggaacggaaacggtccgtacggtacccggtccgttaggacgtccgacggacccgaacgggccgtccggcccccgttcgggtacctacccgttccgttcccggtttacccccc

SEQ ID NO: 395726 - DNA, 542 bp, Homo sapiens
  misc_feature: GZ8MTXP02HL8R8.51.5.A05.1.454.CMB.2.raw
  modified_base (304)..(304): a, c, t, g, unknown or other
  modified_base (311)..(311): a, c, t, g, unknown or other
  modified_base (444)..(444): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcactgctttggagatgcgttgaccaaagaatctgtctttttggaccatcagaggccaggccaggcccctgtattggcatctatgaggacaccaagccgacccncagaacncctgagagagtcgccgtggcctccgaggtcagggacagtcggacctaccttgacttactccacgtacgggaaccaggatacgggacgagtaggaaggtgaaccgtacacgttgttaacttccggaatacgaanagacgtagtggtaagtcggaggggttcgtgggacgggaggacgagcgtgacgtctagacgtcgacgcctaaggctccgcccctggctacgtcttcccg

SEQ ID NO: 395727 - DNA, 627 bp, Homo sapiens
  misc_feature: GZ8MTXP02GNTI2.51.5.A05.1.454.CMB.2.raw
  modified_base (214)..(214): a, c, t, g, unknown or other
  modified_base (286)..(286): a, c, t, g, unknown or other
  modified_base (503)..(503): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccacctcagtgtcagtgtctccaggacaaacggccaagatcacctgctttgganatgcgttgaccaaaagaattctgtctttttaggaccatcagaggccaggccaggcccctgtatggtcatcangagacacagccgaccctcgaactccagagagagcgcgtcgcctcgaggtcgaggacaagtcggacctacgttgactagtccaacgtccggggaacccagtacgtacggaacggtatagggaacgtacggaacttaacccgtacgttagtttaacgttacgaacgaacgacgagacgtagggttaggtacggtcggtacgggggttcgttaccggggnggaacggggacgaacggtccgtacggtaccggtcttacgggacgtaccgacggacccgaacgggtccgttcccggaccccccgttcgggtacccgttaccgtcccgtttcccggttccccccgg

SEQ ID NO: 395728 - DNA, 527 bp, Homo sapiens
  misc_feature: GZ8MTXP02HODEL.51.5.A05.1.454.CMB.2.raw
  modified_base (370)..(370): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtcttttggaccatcagaggccaggccaggcccctgtatggtcatctatgaggacaccaagccgaccctccggaatccctagagagagtcccgctggcctcaggtcagggacaagtggaccaccttgactancacgtggacccagatggacgagtgaaggtgactacacttgtattcgatagacagcaggtagtagtcgagggggtcttcgggcgggagggacgaagcgtacggaccgttcgtacgcgtacgacgcccgaaggcctccggcccctcggtccacttcccg

SEQ ID NO: 395729 - DNA, 591 bp, Homo sapiens
  misc_feature: GZ8MTXP02HMKKM.51.5.A05.1.454.CMB.2.raw
  modified_base (317)..(317): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccgaggacaaacggccaagatcacctgctttggagatgcgttgaccaaagaatctgtcttttggaccatcagacgccaggccacggcccctgtattggtcatctatgagacacgaagcaccctcggatcccngagagagtccgcgtggctcgaggtcagggcaagtcggacctaccgttgactatccacgtcggacccagagtggaacgtagtggaaggtacgaacctacacgttagttaacttcgaacacgacagacgtaggttgggtacgtcgggtagggggttcttacgggggacgggtaaggggaacgaacggtcgtacggtacccggttcgtacggacgtaccgacggaacccccgaagggtcccgttccggaccccccgttcggtccctacgtttccccg

SEQ ID NO: 395730 - DNA, 714 bp, Homo sapiens
  misc_feature: GZ8MTXP02I9WCD.51.5.A05.1.454.CMB.2.raw
tcagcgatcgtatacacgaccggtgctcgatttagatagatagacagggggtgggctcaggaggcagagctctgggaatctcaccatggcctggaccccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggtaccatcagaggccaggccaggcccctgtatggtcatctatgaggacacgaagccgaccctcggaatccctgagagagtcgctggcctccgaggtcagggacaagtcgggaccacgttgactatcacgtcgggaacccagagtggaacgagtacggaaaaggtcggaaacctacccgtaacttacggttaactttaccggaaacgtaacgaacgaacggaccgtaagggttacgggtaaacgggttccgggtaaagggggggtttcccgtttacgggggaaccgggggtaaagggggtaacccgggaaaagggtcccggtttacgggaaacccccggggtttcccgttaagggaaccgggtttaccgaaacccgggtacccccgaaaacggggtcccgtaccccgggtacccccccgttcggggttaccctaaccccgtttcccgttacccggttttaaccccccccg

SEQ ID NO: 395731 - DNA, 501 bp, Homo sapiens
  misc_feature: GZ8MTXP02G3Y58.51.5.A05.1.454.CMB.2.raw
  modified_base (218)..(218): a, c, t, g, unknown or other
  modified_base (411)..(411): a, c, t, g, unknown or other
  modified_base (418)..(418): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgganatgcgttgaccaaagaaatctgctttttggtaccatcagaggccaggccaggcccctgtatggcatctatgagacacaagcaccctcggaatccctgagagagcgctggctccaggtccaggggcaatggccaccttgactatcaatgggacccagatggacgatgaagtgaactaccactagttatccgaanagacagnagtgtagcgaggggtgtcggaggaggacgagcacgccgtcgtcgacgcgacgaaccaaggtccgaccgccccgtcgccactcg

SEQ ID NO: 395732 - DNA, 579 bp, Homo sapiens
  misc_feature: GZ8MTXP02H1IT6.51.5.A05.1.454.CMB.2.raw
  modified_base (376)..(376): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgcttttggagatgcgttgccaaagaaatctgtctttttggaccatcagaggccgaggccacggcccctgtattggcatctatgagacacaagccgaccctcggaactccctgagagacgtccgcgtcggctccgaggtcgagggcaagtcgacctaccgttgactanccacgtcggacccagagtggaacgagtaggaaggtagaccttaccagttacgtttacgttacgaacgtaggaaccagtcgaaggttggtaaggtcgggtagggggtttcgtacggggacgggaaggggacgaacggtcgtcgaccgttcgacgtacgccgacggaacccgaggccctccggccccgtcggtcctacgttcccg

SEQ ID NO: 395733 - DNA, 648 bp, Homo sapiens
  misc_feature: GZ8MTXP02I2AGO.51.5.A05.1.454.CMB.2.raw
  modified_base (216)..(216): a, c, t, g, unknown or other
  modified_base (235)..(235): a, c, t, g, unknown or other
  modified_base (253)..(253): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatntgtcttttggacatcagngcaggccaggccctgtatggtcatctatgacgacaccgaagccgacccctcggaactcccgtgagagagtcgctcggctccgaggtcaagggacaacgtcggcctacgttgactatccgacgtcgggaacccaggagtacggaacgtagtaggaaaggtcgaactaaccgtagttaggttaacttacggaaacacggaacgtagacgtaagggttaggtaacggtcgggttacgggggttcgttaccggggacgggggtaaacggggaacggtaaacggtcgttacggtaccccggttccggttaacggacggtaccgaaccggtaccccggaaggtccccgtcccggacccccgttccgggtaccctacccgttaccgtcccgtttaccccccg

SEQ ID NO: 395734 - DNA, 649 bp, Homo sapiens
  misc_feature: GZ8MTXP02GBTFD.51.5.A05.1.454.CMB.2.raw
  modified_base (204)..(204): a, c, t, g, unknown or other
  modified_base (219)..(219): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccaccctcagtgtcagtgtctcaggacaaacggccaagntcacctgctttgganatgcgttgaccaaagtaaattcgttagtcgtttttacggacctatcaggacggccgaggccacggcccctggtattggtcatctatggaacggaccaaccaacgccgaccccgtaccggaacttcccgtagacggacgtacggtcccgtcgtcggcctaccgaggtacgagggacaacgtcgggaccctacgttcgaactacgtacgacgtacgggaaccctaggacgttagggaacgtagtacggtaacggtacgtaaccgtaacccgtacgttaggtttaaacttcggaacagaccaggactaggtggtaacgtcggggtacggggttcgtacggggacgggaacggggaacgtaaggcggtacggacccgtcgtagacgtcgacgaaccgacgtcccgtcccgccccgtacggtcctcgtttccccg

SEQ ID NO: 395735 - DNA, 610 bp, Homo sapiens
  misc_feature: GZ8MTXP02FQSHK.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttggagatgcgtgaccaaagaatctgtcttttgtacatcagcgccacgccacggcccctgtattgcatctagtgagacaccgaagccgaccctcggaactcccgtagagagacgtccgctcggctaccgaggtacgaagggacaagtcggacctaccgttgaactactccgaacgtcgggaaccctagacgtggaacgaagtaggaaaggtacgacctactacgttagttaactacgaacagacagacgtaggtggtacggtcggtacgggggttctacggggacggggtaacgggaccggtagccggttcggtaaccgtttcggacggtacgtaccgaacggaacccgaacgggtccgtaccccggtccccgttcgggtaccctacgtttccccgg

SEQ ID NO: 395736 - DNA, 631 bp, Homo sapiens
  misc_feature: GZ8MTXP02JVLRM.51.5.A05.1.454.CMB.2.raw
  modified_base (333)..(333): a, c, t, g, unknown or other
  modified_base (394)..(394): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagactcacctgctttggagatgcgttgaccaaagaatctgtctttttggaccatcagacggccaggccacggcccctgtattggtcatctatggacgaccacgaagccgaccctcggaactccagagagagtcgntcggcctcgaggtcaggacaagtcggacctacttgaacctatcgacgtcgggacccagtangggacagtgaaagtcgaacgtaccagttagttatacgacagacagacgtaggtaggtacgtacggtaacgggggttcttaccgggggaggggtaacggggaaacggaacggtaccgttacggggaaccccgtttccggtaggacggttaccggaaccggacccgaaagggtccccgttacccgggacccccgttccggggtacccttacccgttcccgtccggttttacccccccgg

SEQ ID NO: 395737 - DNA, 547 bp, Homo sapiens
  misc_feature: GZ8MTXP02I60NV.51.5.A05.1.454.CMB.2.raw
  modified_base (401)..(401): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagagccaggccaggcccctgtatggtcatctatgagacacaagccgaccctcggaactccctgagagagtcgctcggcctccgaggtcaggggtacaagtcgggcctaccgttgactatcacgtcgggacccagatggacgatgaaagtnactacactgtactcgaacagactagcaggtaggtgtcggacgggggtctcggggcggtaggggacgaggactggaccgtcgtaggacgtcgacgtaccgaaggtcccgtcgcccccgtcggacccacgttccgtccgtttcccccg

SEQ ID NO: 395738 - DNA, 618 bp, Homo sapiens
  misc_feature: GZ8MTXP02FL2AV.51.5.A05.1.454.CMB.2.raw
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggcccacggcccctgtagttggtcatctatcggagaccaccgaacgccgacccgtaccggaactcccgtagagagacgtccgcgtcggctaccgaggtccgagggacacgcggacctaccgtagactatccgacgtcggggacccaagacgtaggaccgagtaggaaggtcgaacctacgtacgttagttaatcgaacagacaggacgtaggttagggtacggtcgggaagggggttcgtaccgggggagggtaacgggacgaggtccggacgtaccggttacgacggacgtacgaaccgtaacccggaacggtcccgtcccggtcccccgttcggtaccctacccgtttcccccg

SEQ ID NO: 395739 - DNA, 532 bp, Homo sapiens
  misc_feature: GZ8MTXP02GE02M.51.5.A05.1.454.CMB.2.raw
  modified_base (307)..(307): a, c, t, g, unknown or other
  modified_base (310)..(310): a, c, t, g, unknown or other
  modified_base (324)..(324): a, c, t, g, unknown or other
  modified_base (352)..(352): a, c, t, g, unknown or other
  modified_base (411)..(411): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggcaagatcacctgctttggagatgcgttgaccaaagaatctgtctttttaggaccatcagaggccaggccaggcccctgtatggcatctatgagacacagcacctcggaatccnganagacgtcgctggcnccgaggtcagggacagtgccactgactncacgtcgggaccagatgacgatagaagtgactacctagtagttatacgacaagacacgntaggtgtaagtcgagggggttctcgggcggaggacgaagcgtacggaccgttccgagacgtaccgacgaccccgaaggccgtacccgccccgtacggcctactcccgtacggtttcccccg

SEQ ID NO: 395740 - DNA, 558 bp, Homo sapiens
  misc_feature: GZ8MTXP02GXMG4.51.5.A05.1.454.CMB.2.raw
  modified_base (216)..(216): a, c, t, g, unknown or other
  modified_base (254)..(254): a, c, t, g, unknown or other
  modified_base (366)..(366): a, c, t, g, unknown or other
  modified_base (394)..(394): a, c, t, g, unknown or other
  modified_base (421)..(421): a, c, t, g, unknown or other
tcagcgatcgtatacacgaccggtgctcgatttagatagatagacagggggtgggctcaggaggcagagctctgggaatctcaccatggcctggaccccctctcctgctccccctcctcactttctgcacagtctctgaggcctcctatgagctgacgcagccaccctcagtgtcagtgtctccaggacaaacggccaagatcacctgctttgganatgcgttgaccaaagaatctgtctttttggacatcagngcagccagcccctgtatgcatctatgagacacaagccgacctccggaatcccgtgagagagtcgctcggctccgaggtcgaggggacaagtcggaccctacgttcgacttanacacgtacgggacccagagtggacgagngaagtgaacctacactgttattacganaagacagcaggtgtagtcggaggggtcgtgggcgggaggacgaagtcgtacggaccgttccgagacgtaccgacgacccgtaacggccgtacccggcccccgttacggtccctacctccggttccggtttccccccg

SEQ ID NO: 395741 - DNA, 644 bp, Homo sapiens
  misc_feature: GZ8MTXP02FIZ5J.51.5.A05.1.454.CMB.2.raw
  modified_base (309)..(309): a, c, t, g, unknown or other
  modified_base (320)..(320): a, c, t, g, unknown or other
  modified_base (358)..(358): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgctttttgaccatcagaggccaggccaggcccctgtattggcatctatgagacacaagcgaccctccgaatcccngagagagtcgntcggctccaggtcaggggacaagtggccaccttgactntacactgggacccagtatggaacgagttacggaaaggtgaaccgtaacctacgttacgtttaaacgtttccggaaaccaaaggaaccgagtaccggaaagggttggggttaaacgggtccggtaagggggggttccctttcgggggaccgggtagggggaacgtaaacgggccgtacgggacccggttcccgtaggtaacggtaccgacggacccccgaaagggtcccgtccgggaccccccccgttcggggttccccaaccggttccctaccggtttcccccccg

SEQ ID NO: 395742 - DNA, 742 bp, Homo sapiens
  misc_feature: GZ8MTXP02HLK9Q.51.5.A05.1.454.CMB.2.raw
  modified_base (171)..(171): a, c, t, g, unknown or other
  modified_base (199)..(199): a, c, t, g, unknown or other
  modified_base (213)..(213): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctctatgagctgacgcagccaccctnagtgtcagtgtctcgagacaacgcaagntcactgtcttggantgcgttagacaaagaatctgtcttttgaccatcagacgccgagccacggtccctgtatgtcatctatgacgacaccgaagccgaccccgtacggaactcccgtagagacgtagtcccgcgtcggcctacccgaggtccgaagggactaagtccggaccctaccgttcggaacctactacccgaaccgttccggaaccccgaagtaacgttacgggaaaccgtaagttacgggaaacggttacgaaacccgttaacccgtaacgtttacgtttaaacgttaccgaacgtaaacgtaacccgaggtaccgtaagggtttagggttaacgggttacggggttacggggggttacccgtttacgggggaaccgggggtaacgggggtaaaccggtaaaccggggtaccggttacccgtaaccccgggttacgtttacgggaccgttaaacccgaccggtaacccccggaaagggtcccccgtaccccggtaccccccgtttaccgggtacccctttaaccggtttacccccgg

SEQ ID NO: 395743 - DNA, 623 bp, Homo sapiens
  misc_feature: GZ8MTXP02F7651.51.5.A05.1.454.CMB.2.raw
  modified_base (276)..(276): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctcaggacaaacggccaagatcacctgctttggagatgcgttgaccaaagaatctgtctttttgacatcagagcagcagccctgtatggcatctangagacacagccgaccctacggaactccctgagagagtcgctcggcctccgaggtacgagggacaagtcggcccacgttgactactacgacgtcgggacccagacgtggaacgtagtaggaaaggtcgtaaccttaaccgacgttacgttaacttacggaacaaggaccaggtaccgtaagggttcgggtaaacgtcgggtaacggggggttccttacggggacgggaaggggaacgaaagggtccgtacggtaacccggtcgttaggaccggtaccgacgaccccgtaacggcccgtaccggtcccccgtcgggtaccctacgttccccggttcgtttcccccccgg

SEQ ID NO: 395744 - DNA, 620 bp, Homo sapiens
  misc_feature: GZ8MTXP02IV1VV.51.5.A05.1.454.CMB.2.raw
  modified_base (219)..(219): a, c, t, g, unknown or other
  modified_base (283)..(283): a, c, t, g, unknown or other
  modified_base (289)..(289): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtcttttggaccatcagacggccaggccaggcccctgtattggnatctangagacacaagccgaccctcggaactcccgtgagagagtccgcgtggcctcgaggtccaagggacaaagtcggaccctaccgttgacctatccaccgtcggggaacccaggacgtgggaacgtagtaggaaggtacgacctaaccgtattaggtttacttaccggaactagaccaggtaccgaaggttgggtaacggtcgggaacgggggttcgtccgggggacgggacggggtaacgaaacggtcggtacggaacccggtcgtacgacgttaccgacgtaaccccggaacgggtcctacccggacccccgtttcggtcctacctttcccgg

SEQ ID NO: 395745 - DNA, 586 bp, Homo sapiens
  misc_feature: GZ8MTXP02IWSN9.51.5.A05.1.454.CMB.2.raw
  modified_base (219)..(219): a, c, t, g, unknown or other
  modified_base (578)..(578): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggccaagatcacctgctttgganatgcgttgaccaaagaatctgtctttttaggaccatcaggacggccaggccacggtcccctagtatggtcatctatgagacacaagccgacccctcggaactccccgtagacgagacgtcccgctcggccttaccgaggtccagggacaagtcggccctaacgttgacgtatctaaccgtcggaaccctagagtggaaccgaagtcggaaggtcgaactaccgtacttagttaatccggaacagaaccaggaccgtaaggtggtacggtcggaacgggggttctacggggcgggaagggtaccgaaggcttacgggacctcgtagacgcgacgaaccgaacgtcgtccgccccgtgtcncctttccg

SEQ ID NO: 395746 - DNA, 571 bp, Homo sapiens
  misc_feature: GZ8MTXP02JAYOL.51.5.A05.1.454.CMB.2.raw
  modified_base (248)..(248): a, c, t, g, unknown or other
  modified_base (353)..(353): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtcttttggaccntcagagcaggccacggcccctgtattggtcatctatgagacaccaagccgaccctaccggaactccctagagacgagtcgctcggctccgaggtacgaggacaancggaccacttgacctatccgacgtacgggacccagacgtaggacgtatgggaaacgtcgaactaaccgagttagttacgttacgacagaactgacaggtacggtagtcggaggggttcgtcgggaggagggacgaacgtcgtacggaccgtcgtagtacgtcgaacggcccgaaggcctacccggccccgttacggtctaccgtcgtaccgttccccc

SEQ ID NO: 395747 - DNA, 663 bp, Homo sapiens
  misc_feature: GZ8MTXP02IUZRK.51.5.A05.1.454.CMB.2.raw
  modified_base (398)..(398): a, c, t, g, unknown or other
tcagcgatcgtatacacgaccggtgctcgatttagatagatagacagggggtgggctcaggaggcagagctctgggaatctcaccatggcctggacccctctcctgcctcccccctcctcactttctgcacagtctctgaggcctcctatgagctgacgcagcccaccctcagtgtcagtgtctccaggacaaacggccaagatcacctgtctttggagatgcgttagaccaaagtaattctgttctttttaggaccatcaggacgccgaggccacggcccctgtagttggcatctagtggacgacaccgaacgccgaccccgtaccggtaactcccgtagacgagagtccgcgtccggcctccgaggtacgaggacagtcggacctacgtgactacncgacgtacggaccagacgtaggacgtagtaggaacgtcaaccgtacctagttgttaacgttaccgaacgtagaaccgtagtacgtaagggttacgggtaacgggttccgggtaacggggggtttccgttacgggggaccggggaacggggtaacgaaacggtcgtaccggtacccggtcgtaggaccgtaccgaaccggcccgtaaacggcccgttcccgacccccggttacgtccctacgttccccgtttaccgttaccccccg

SEQ ID NO: 395748 - DNA, 592 bp, Homo sapiens
  misc_feature: GZ8MTXP02H3K5H.51.5.A05.1.454.CMB.2.raw
  modified_base (221)..(221): a, c, t, g, unknown or other
tcagcgatcgtatacacgaccggtgctcgatttagatagatagacagggggtggctcaggaggcagagctctgggaatctcaccatggcctggacccctctcctgcctcccccctcctcactttctgcacagtctctgaggcctcctatgagctgacgcagcccaccctcagtgtcagtgtctccaggacaaacggccaagatcacctgctttggagatgngttgaccaaaagaatctgtctttttaggtaccatcagagccaggccacgggcccctgtattggtcattctatgaggacaccaagccgaccctccggatccctgagagagtcgctcggctccgaggtcgagggacaagtcgacctacttgaactactcacgtcgggaacccagagtaggacgagtgaaagttgaacctacaacgttgttaactcgaacagacagacgaggtagggtagtacgggagggggttccgttcggggaccggggagggggcgaaacggtcgtacggtcccgtcgtcggacgtaccgacgccccgaacggtccgtccggtaccccccgtcggtccctaccttccgttccgtccccccg

SEQ ID NO: 395749 - DNA, 569 bp, Homo sapiens
  misc_feature: GZ8MTXP02IZ962.51.5.A05.1.454.CMB.2.raw
  modified_base (254)..(254): a, c, t, g, unknown or other
tcagcgatcgtatacacgaccggtgctcgatttagatagatagacagggggtgggctcaggaggcagagctctgggaatctcaccatggcctggaccccctctcctgctcccccctcctcactttctgcacagtctctgaggcctcctatgagctgacgcagccaccctcagtgtcagtgtctccaggacaaacggccaagatcacctgctttggagatgcgttgaccaaagaatctgtcttttgaccatcagnggcagccagccctgtatggtcatctatgagacaccaagcgaccctcgaactccctgagagagtcgctcggcctcgaggtcagggacaagcggccacttgactatcacgtcgggacccagacgtggaacagttgaaggtcgaacttaccattacgttattacgacaggaccagacgaggtaggtacgtcggagggggttcgtacggggacgggagggacgaggccgtaggaacccgttcgtggaacgtcgaacggcccgtaaaggtcccgtccggtacccccgtcgggtactacccgtcgttaccggtttcccccg

SEQ ID NO: 395750 - DNA, 617 bp, Homo sapiens
  misc_feature: GZ8MTXP02HB027.51.5.A05.1.454.CMB.2.raw
  modified_base (175)..(175): a, c, t, g, unknown or other
  modified_base (218)..(218): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtntcagtgtctccaggacaaacggccaagatcacctgctttgganatgcgttgaccaaagaatctgtcttttggaccatcagagccaggccaggcccctgtattggtcatctatgaggaccaccgaagccgacccgtccggaactcccgtagacgagacgtccgcgtgctccgaggtcgaagggctaagtcggacctaccgttgacttactaccgacgttcgggaaacccagaacgtggaacgtaagtcggaaagtcgaacctacccagttagttacgttacgaacgtagaacgagacgtaaggtggtaaggtcgggtaacgggggttccgttacggggacggggtacgggaacggacggtacggtcggaacccggttccgtagtaccgggtcaacggcccgaacggtccctaccggtacccccgtcggtaccctaccttcccg

SEQ ID NO: 395751 - DNA, 550 bp, Homo sapiens
  misc_feature: GZ8MTXP02HGCTQ.51.5.A05.1.454.CMB.2.raw
  modified_base (185)..(185): a, c, t, g, unknown or other
  modified_base (219)..(219): a, c, t, g, unknown or other
  modified_base (323)..(323): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtcnccaggacaaacggccaagatcacctgctttgganatgcgttgaccaaagaatctgtcttttggaccatcagaggccaggccaggcccctgtatggtcatctatgagacaccaagcgaccctacggactcccagagagngccgcgtggctcgaggtcgaagggcaagtcggacccacgttgacctatcacgtcgggaacccagatggaacgataggagtgaacctacgacttagttattacgatagacagtacagtaggtagttcggaggggttcgtcgggacgggaggaaccggtagcgttacggaccgtcggtacgacgtcgacgaacccgaggccgtaccgcccccgtcggacctacgttccg

SEQ ID NO: 395752 - DNA, 578 bp, Homo sapiens
  misc_feature: GZ8MTXP02JHTJO.51.5.A05.1.454.CMB.2.raw
  modified_base (234)..(234): a, c, t, g, unknown or other
  modified_base (425)..(425): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggcaagatcacctgctttggagatgcgttgaccaaagaatntgtctttttggaccatcagaggcaggccaggcccctgtattggtcatctatgaggacacaagcgacctccggactccgtagagagagcgctcggctccgaggtcagggacaagtcggaccacgttgactatcacgtcgggaacccagacgtggacgagtagaagtcgactaacctagtagttacttacganacgacagactagggtaggtacggtcggtagggggttccgtcggggacggggagggaacggaacgtcgtacggtaacccggtcgtacggacgtacgacgaccccgaagggccttccggacccccgttggccctacgtccgttccgtttcccccg

SEQ ID NO: 395753 - DNA, 710 bp, Homo sapiens
  misc_feature: GZ8MTXP02GTWXN.51.5.A05.1.454.CMB.2.raw
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagcccaccctacagtgtcagtgtcctccgaggacaaacggccaagatccacctgcgtttggagtatgcgttacgaccaaaagtaatctgtcttttaggaccatcagagcaggccagcccctgtatggtcatctatgagacacagccgaccacggactccgtgacgagtagcgcgtacgctcgaggtcgagggacaagtcggcctactgactatcacgtcggacccagacgtacggacgagtaggaaggtcgtaaccgtaactacgttagttacttaccgaaaccgagaacccgaggtaccgtaaggggtttacgggtaacggttaccgggggttaaacggggggttccggtttaacggggggacggggtaaaacgggggaaccccggtaaaagggtttcccggtaaccgggttaccccggttaccgggttaacggtaccggttaaccgaaccgggacccccgtaaaagggggtcccgttacccccggtccccccggtttaacgggtccccgttaacccttcccggttttaccccggtttaacccccccccg

SEQ ID NO: 395754 - DNA, 564 bp, Homo sapiens
  misc_feature: GZ8MTXP02J1BJF.51.5.A05.1.454.CMB.2.raw
  modified_base (172)..(172): a, c, t, g, unknown or other
  modified_base (218)..(218): a, c, t, g, unknown or other
  modified_base (337)..(337): a, c, t, g, unknown or other
  modified_base (346)..(346): a, c, t, g, unknown or other
  modified_base (361)..(361): a, c, t, g, unknown or other
  modified_base (365)..(365): a, c, t, g, unknown or other
  modified_base (391)..(391): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaaacggccaagatcactgctttgganatgcgttgaccaaagaattctgtctttttggaccatcagacggccaggccaggcccctgtattggtcatctatgaggacaccagccgaccctcggaatcgctagagagacgctgcgccngcgtacggngacagccgactactnactnacgtacggacgtacgagtaggacgangtaaggacgtacgacctactagttacgttacgacgagacacgagtacgtgggttagtcggtagggtcgggttacgtcggggacgggtacggaacgcggtcgtaaaccgtccgtacgtacgaccgacgaaccgaaccgtaccggtcctccccggtcccgtcggtactttccccg

SEQ ID NO: 395755 - DNA, 676 bp, Homo sapiens
  misc_feature: GZ8MTXP02G2MGU.51.5.A05.1.454.CMB.2.raw
  modified_base (172)..(172): a, c, t, g, unknown or other
  modified_base (298)..(298): a, c, t, g, unknown or other
tcagcgatcgtatacacgaccggtgctcgatttagatagatagacagggggtgggctcaggaggcagagctctgggaatctcaccatggcctggaccccctctcctgcctccccctcctcactttctgcacagtctctgaggcctcctatgagctgacgcacgcccaccctnagtgtcagtgtctccgaggacaaacggccaagctcacctgtctttggagatgcgttagaaccaaaagaatctgttcttttaggactatcagacggccaggccacggtcccctgtatcggcatctanggagacacacgcgaccctacggaactcccgtgacgtagacggtcgcgtccggcctaccgaggtaccgaagggactaacgtcggggaccctacgtacggactacgtacgaccggtacgggacccaggctaggaacggagtaggaaagttcgaacctaccgtatacgttaacgtcgaaatacgaacgagacgtagggtacggtacgttacgggggacggggtttccgtacgggggacggggtaacggggacgaacggttaccggcgttaaaccccggtcgttaggaacgggtacccacggacccccgggtaagtccccggttaccccggtcccccggttacgtaaccccgttcccgttcccgttcccgtttccccccggg

SEQ ID NO: 395756 - DNA, 630 bp, Homo sapiens
  misc_feature: GZ8MTXP02FKZ5D.51.5.A05.1.454.CMB.2.raw
  modified_base (302)..(302): a, c, t, g, unknown or other
tcagcgatcgtatacacgaccggtgctcgatttagatagatagacagggggtgggctcaggaggcagagctctgggaatctcaccatggcctggaccccctctcctgctccccctcctcactttctgcacagtctctgaggcctcctatgagctgacgcacgcccaccctcagtgtcagtgtctccaggacaaacggccaagactccacctgtctttggagatgcgttagaccaaagaactctgttcgtttttaggaccatcaggacggccgaggccacggcccctgtagttggtcatctangacgacacagccgaccgtcggactccgtgagagagtcgctcggcctcgaggtcgaggacagtcgacctactagactatcacgtcggacccagacgtaggacgtagtaggaacggtcgtaacctaacctagttacgtttaacgttaccggaacaacggacaggacgtagggttaggtaacggtacgggtacgggggttcgttacgggggacggggtaaggggacgaacggtcgtacggtaccgtccgtaggtacgtccgaaccggcccgtaacgggtcccgtcccggtcccccgtcggtaccctacccgttccgttcccgttacccccc

SEQ ID NO: 395757 - DNA, 524 bp, Homo sapiens
  misc_feature: GZ8MTXP02FNGHU.51.5.A05.1.454.CMB.2.raw
  modified_base (416)..(416): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgctttttggaccatcagaggccaggcccaggccccctgtattggtctatctatgaggacaaccaagccgaccctccggaatccccgtgagagagtcccgcgtaggctaccgaggtcaggggacaatggccaccttgactatcacgtggacccagactaggacgatgaaggtcgactacncgtagttattacgacagaccagcagtgtacgtcgtagggggtctgggcgaaggggacaggctcgaccgtcgtacgcgtcagcccgaggctcgaccctcggctactccg

SEQ ID NO: 395758 - DNA, 628 bp, Homo sapiens
  misc_feature: GZ8MTXP02FTEC9.51.5.A05.1.454.CMB.2.raw
  modified_base (279)..(279): a, c, t, g, unknown or other
  modified_base (297)..(297): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (358)..(358): a, c, t, g, unknown or other
tcagcgatcgtatacacgaccggtgctcgatttagatagatagacagggggtgggctcaggaggcagagctctgggaatctcaccatggcctggaccccctctcctgcctccccctcctcactttctgcacagtctctgaggcctcctatgagctgacgcagccaccctcagtgtcagtgtctccaggacaaacggccaagatcacctgctttggagatgcgttgaccaaagaatctgtctttttggacatcagagcaggccacggccctgtatgcatntatgagacacagcgaccncggaatccnganagngtcgctcggctccgaggtcgaggacaagtcggccacgttagactancgtacgtcgggaacccagacgtaggaacgtacgtaggaaaggtcgaacctaacctacgttagttacttaccggaacagtaaccgagtacgtaagggttgggtaacggtgggtaacgggggttcttacgggggagggtaacgggggaacgaacggtcggtacgggcccggttaccgtagggtacgtccgaacggaccccggtaaacggtcccgtcccggtaccccccgttcgggacccctaccggttccccgtaccggtttaacccccccg

SEQ ID NO: 395759 - DNA, 585 bp, Homo sapiens
  misc_feature: GZ8MTXP02FYUNA.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgaccaaagaatctgtctttttggaccatcagaggccaggccacggccctgtatggtcatctatgaggacacaagccgaccctcggaactcccgtgagagagtcgcgtcgctccgaggtcgaaggacaagtcggaccctacgttgactataccgaacgtcgggaacccagacgtgggaacagtaggaaaggtcgaactaccgtattagtattaccgacaagacagacgtagggtacggtacgtgggtaacgggggttcgttcgggacggggaaggaacgaaggtctcgggaccgtcgtagacgtaccgacgtaccgaaggcccgtccgtcccccgtacggacctcgttccttaccggttccccc

SEQ ID NO: 395760 - DNA, 552 bp, Homo sapiens
  misc_feature: GZ8MTXP02FOK4O.51.5.A05.1.454.CMB.2.raw
  modified_base (289)..(289): a, c, t, g, unknown or other
  modified_base (368)..(368): a, c, t, g, unknown or other
  modified_base (393)..(393): a, c, t, g, unknown or other
  modified_base (498)..(498): a, c, t, g, unknown or other
tcagcgatcgtatacacgaccggtgctcgatttagatagatagacagggggtgggctcaggaggcagagctctgggaatctcaccatggcctggaccccctctcctgcctccccctcctcactttctgcacagtctctgaggcctcctatgagctgacgcagccaccctcagtgtcagtgtcctccaggacaaacggccaagatcacctgctttggagatgcgttgaccaaagaatctgtctttttggaccatcagaggccaggccacggcccctgtatggtcatctangagacaccagccgacctcgaactcctgagagagtcgctcggcctccgaggtcgagggacaagtcgggccacttgactancgtacgcgggaccagatagacgtanaggaagcgtaccacctagtgtacttacgactaggacagcgtagggtcggtagtcgggaagggggttccgtagggcggggtaagggcgaagtcgtaggaccgtcgngacgtccgaacgccaaggccgtcccgccctcggacctcgtcgtcctttcccccg

SEQ ID NO: 395761 - DNA, 577 bp, Homo sapiens
  misc_feature: GZ8MTXP02FHBG5.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaatctgcttttggaccatcagagcagcaggccctgtatggtcatctatgagacacaagcgacctccggaatccctggagagagtcgctcggcctccaggtcagggacaatcggccacttgactatcactgggacccagatggacgatgaaaggtcgaactaccgattagttactcgaacgagaacagcaaggtggtagtaccggagggggttcgtcggggacgggtagggaacggaacgtcgtagacccggtccgtaggacggtaccgaacggcccccgaaaggggtcccgtccgggtcccccccttacgggtacccgtaaccgttcccggtaccgtttcccccccgg

SEQ ID NO: 395762 - DNA, 665 bp, Homo sapiens
  misc_feature: GZ8MTXP02G2XM0.51.5.A05.1.454.CMB.2.raw
  modified_base (172)..(172): a, c, t, g, unknown or other
  modified_base (218)..(218): a, c, t, g, unknown or other
  modified_base (226)..(226): a, c, t, g, unknown or other
  modified_base (246)..(246): a, c, t, g, unknown or other
  modified_base (254)..(254): a, c, t, g, unknown or other
  modified_base (303)..(303): a, c, t, g, unknown or other
  modified_base (320)..(320): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccgagacaaacggccaagactcacctattgganatgcgttnacaagaatctgtctttgacntcagcgcngcacgcctgtatgcatcatgagacacgagcgacccgcgaactcgtgagngacgtcgccgtcgaccncgaggtacgaggaactacgtcggcctacgtacgactacgtccgacggtacggaccctaggacgtacgggtaacgaagttagggaaccggttacaaacccgttaactacgttacgtttaaacgtccgaaacgacgaccgtaagtcggtaaaggttacgggttacggtacgggttcgggggttaccgttacgggggaacggggtaaacgggaaccggtaacggtacggttaccgggtaacccgttccgtaaaggggtacccgttacggaaccccgaccgggtaacgtccccggtaacccccgttcccccggtaacggttccctaacccgtttacccgtttcccccgg

SEQ ID NO: 395763 - DNA, 678 bp, Homo sapiens
  misc_feature: GZ8MTXP02F2F33.51.5.A05.1.454.CMB.2.raw
  modified_base (203)..(203): a, c, t, g, unknown or other
  modified_base (216)..(216): a, c, t, g, unknown or other
  modified_base (223)..(223): a, c, t, g, unknown or other
  modified_base (269)..(269): a, c, t, g, unknown or other
  modified_base (272)..(272): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaaacggcaagntcacctgcttganatgcgtnacaaagaatctgtctttgacatcagagcagcacggccctgtatgtnatntatgagacacagcgacccacggatcccgagagtagacgtcccgacgtcggcctaccgaggtacaacgggactaaagtcggacctaaccgttgaaccttataccgacgtacgggaccctaggtacgtaggggaacctagtacggtaaacggtacggaaccttaaccgtacgttacgtttaaacgtaccgggtaaacctaagaccgtaagaccgttaaacggtagggttaaggtaccggggttaacgggggttccggttacccgggggtaggggaacgggggtaaaaccggacggggtaccggtttacgggaaccccggtttacgacggttaaaccgtcggaaccggaaccccggtaaacggtcccgtacccggtccccccggtaggtccccttaccgggtttccccg

SEQ ID NO: 395764 - DNA, 631 bp, Homo sapiens
  misc_feature: GZ8MTXP02GMJBJ.51.5.A05.1.454.CMB.2.raw
  modified_base (201)..(201): a, c, t, g, unknown or other
  modified_base (215)..(215): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcacgccaccctcagtgtcagtgtctccgagacaaacggcaagntcactgtcttgganatgcgtgaccaaagaactctgtcttttagaccatcgagcgcagcacggccctgtatgtcatctatgacgacacacgcgaccgtacgactccaggagtagacgtcgcgttaccggcctaccggtaggtacgagggtaacaacgtccgggaaccctacgttagaccgttataccggacgtaccgggaacccaaggtacgtcgggaaacggtagtaacgggtaacgtctaacctacgtaacttgttaactacgggaccaagaccgaggtactagggttggtacggtcgggtagggggtcgtacggggcgggaaggtacggaacgtcgtacggaccgtcggacgtccgacgtaccggaccgtacggtcccgtacccggtccccgttcgggtacctccgttaccggtcccgtttacccccg

SEQ ID NO: 395765 - DNA, 653 bp, Homo sapiens
  misc_feature: GZ8MTXP02FQXUV.51.5.A05.1.454.CMB.2.raw
  modified_base (250)..(250): a, c, t, g, unknown or other
  modified_base (253)..(253): a, c, t, g, unknown or other
  modified_base (256)..(256): a, c, t, g, unknown or other
  modified_base (363)..(363): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagcccaccctcagtgtcagtgtctccaggacaaacggccaagatcacctgctttggagatgcgttgaccaaagaaatctgtcttttgacatnagngcngcacggccctgtatgtcatctatgagacacaagccgaccctcggaactccctagagagagtcgctcggctccgaggtacgaggaacaagtcggcctaccttgacctntcacgtcgggacccagacgtggaacgagtaggaaagtcgaaccttaacccgagttacgtttaagttaccggaaacagaacgagtaccgtaaggggttagggtaacgttcgggtaaggggggtttccgttacgggggaccgggggtaagggggaaaccgaacgggtaccgttacgggacccgttacccggtaggtacggtaccaaccggggaccccgtaaacgggtcccgtacccgggtcccccccgtacggggtaccctaccgttacccgttcccggtttaccccccccg

SEQ ID NO: 395766 - DNA, 638 bp, Homo sapiens
  misc_feature: GZ8MTXP02FZ4OE.51.5.A05.1.454.CMB.2.raw
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagcccacctcagtgtcagtgtctccaggacaaacggccaagatcacctgtctttggagatgcgttgaccaaagaatctgtctttttggtaccatcagacggcaggccaggcccctgtatggtcatctatgagacacacgccgaccctcggactcccgtagagagacgtccgcgtcgctccgaggtacgacggggtacaagtcgggaccctaccgtttagaaccttacgtcaccgtacgggggaacccaggtacgtacggggaaccgaggtacggtaaagggtcgtaaccgtacccgtaactttagggtttaacttaccggaacgacgtaccagggaccgtaggtaggggtacggtacgggtagggggttacgttacgggggacgggtaggggaacggaacggtcgtcggaaccgtcgtacgacgtccgaacggcccgaacggcctcccggccccgttcggacctaccggtttcccg

SEQ ID NO: 395767 - DNA, 601 bp, Homo sapiens
  misc_feature: GZ8MTXP02HXU0U.51.5.A05.1.454.CMB.2.raw
  modified_base (284)..(284): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttagaccaaaagaatctgtctttttggtaccatcagaggccaggccagcccctgtatggtnatctatgaggacaccaagccgacccgtcggaactccctgagagacgtccgctggctccgaggtacgagggacaagtcgggccctaaccgttgaacttagtaccaaccgtcgggaaccctagacgtacggaacgagtaggaaggtacgaacctaccgtattaggttaacttcgaacgtagacaggacgaaggttgggtacgtcggtacgggggtcgttacgggggacggggagggaccggaagtcgtcggtaaccgtcgtcggacgtcaacggaacccgaacggtcctccggccccccgtcggtaccaccgtttcccg

SEQ ID NO: 395768 - DNA, 723 bp, Homo sapiens
  misc_feature: GZ8MTXP02HWVL6.51.5.A05.1.454.CMB.2.raw
  modified_base (172)..(172): a, c, t, g, unknown or other
  modified_base (203)..(203): a, c, t, g, unknown or other
  modified_base (216)..(216): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctnagtgtcagtgtctccaggacaacggccaagntcactgcttggantgcgtgacaaagaatctgtctttggtacatcagagccaggcacgccctgtatgtcatctatgaggaccaacacgccacccgtaccggaactcccgtgaacggagtacgtcccgcgtcggtctccgtagggtaccgaaggggtacaaagtccgggacctaccgtttacgacttactccgacggtaccggaacccgagtacgtagggaacgtaagttcgggaaaaggttccgaaacttacccgtaagttacgtttaacgttaccgaacgtaacggaaccgtaacgggtacggtaacggggttacggggtacgggttacgggggtaacgggggtttccggtacgggggaccgggggaaaacggggtaccgggtaacgggtaccggtaaccggttacccggttaccggtaacggtaccgggtaacccggacccgggtaaccccggtaaccggtaccccggttacccccggttacccccgggttacccggttacccgttacccgtttccccg

SEQ ID NO: 395769 - DNA, 701 bp, Homo sapiens
  misc_feature: GZ8MTXP02GMNCX.51.5.A05.1.454.CMB.2.raw
  modified_base (217)..(217): a, c, t, g, unknown or other
  modified_base (255)..(255): a, c, t, g, unknown or other
  modified_base (258)..(258): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctcaggacaacggccaagatcacctgctttgganatgcgttgaccaaagaatctgtcttttggaccatcagngcngccacgccctgtatgcatctatgagacacagccgaccctacggaactcccgtagagagacgtcccgacgtcggcttaccggaggtaccgaagggacaacgtcgggaccctaccgtacgtactagtaccgtacgtccgggaaacccagtacgtacggaaacgtagtacggaaaggttcaaaccgtaaccgtacgttacgtttaacgttaaccggtaaccgtaagggtaacccaaggggtacctaaacggggtttgggtaaaaccgggttcgggggtaaacgggggttcccgttacgggggacgggtaaacggggaaaccgtacgggtaccgtttaccggaaacccggtttcgacggtaaaccggttaccgtaacggtaacccccggaaacggtccccgtaaccccggtacccccgttcgggtaacccttacccggtttaccccg

SEQ ID NO: 395770 - DNA, 644 bp, Homo sapiens
  misc_feature: GZ8MTXP02IXQDF.51.5.A05.1.454.CMB.2.raw
  modified_base (173)..(173): a, c, t, g, unknown or other
  modified_base (218)..(218): a, c, t, g, unknown or other
tcagcgatcgtatacacgaccggtgctcgatttagatagatagacagggggctgtgggctcaggaggcagagctctgggaatctcaccatggcctggacccctctcctgcctcccccctcctcactttctgcacagtctctgaggcctcctatgagctgacgcagccaccctnagtgtcagtgtctccaggacaacggcaagatcacctgctttgganatgcgttgaccaaagaatctgtcttttggacatcagacggccaggccacggcccctgtattggtcatctatgagaccacaagccgaccctaccggactccccgtagagagacgtccgcgtcgctccgaggtaccgaagggctaacgtcggaccctaccgttcgactagtccaaccgtcgggtacccagacgtggacgagtggaaacgtggaacctacctactttagttacttaccggacgtaagaaccgtaggaccgtaggttaggggtaggttacgggtagggggttccgtttacgggggacggggtaaacggggtaaccgggaacggtccggtaccgggtacccgtccgttacgggaacgttccgacgtaacccggaacggtcccgtacccggacccccgttcggtacccgtaccgtttccccg

SEQ ID NO: 395771 - DNA, 629 bp, Homo sapiens
  misc_feature: GZ8MTXP02JV67F.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttgggagatggcgttgaccaaagaatctgtctttttggaccatcagaggccaggccagcccctgtattggtcatctatgaggacaccaagccgaccctccggaactcccgtagagagacgtcgcgtcggctaccgagggtcaggggacaagtcggccctacttgactactcgacgtacgggacccagagtaggacgagtaggaaggtcgaacgtaaccgacttagttaacttacggaactaaggacaggacgtaagggttggtaagttcgggtacgggggttcgttacgggggcgggaaaggggacgaaacgggccgtacggaacccggtctcgggtaacgtccggaacggtccccgaaacgggccgtacccggtcccccggttcgggtaccctaccgttcccgttccgtttaccccccg

SEQ ID NO: 395772 - DNA, 630 bp, Homo sapiens
  misc_feature: GZ8MTXP02F5MHO.51.5.A05.1.454.CMB.2.raw
  modified_base (188)..(188): a, c, t, g, unknown or other
  modified_base (217)..(217): a, c, t, g, unknown or other
  modified_base (401)..(401): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcacttttctgcacagtctctgacggcctcctatgagctgacgcacgccaccctcagtgtcagtgtcncgaggacaacgcaagatcactgcttgganatgcgttagaccaaagaatctgtcttttagaccatcgagacggaccaggaccgacggtccccgtgtacgttggtacatctagtagaacggaccaaccgaacgccgaccccgtacgaactccgtagagacgagccgctcggactaccgaggacgaagggacaagtcgacctaccgttgaacttanccacgtacggaccaagtagaggaacgtagaggtaaaggtcaactacctacttagttaactacgacgaagacaggagtacggtaaggtacggttacgggaaggggtttccgtacggggtacggggaaacgggtacgaacggccgtacggtaaccgtccggttagaacgtcgaaaccggccgtaaaccggttcccacggtaccccccgttggtaccctaccgtttaccccg

SEQ ID NO: 395773 - DNA, 722 bp, Homo sapiens
  misc_feature: GZ8MTXP02G1XZL.51.5.A05.1.454.CMB.2.raw
  modified_base (175)..(175): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgacggcctcctatgagctgacgcacgcccaccctnagtgtccagttcgtcctccgaaggaaccaaaccggaccaaagactcctaccgttgtcgttttaggacgtagtcggtcgttacgaacctaaaagtaaacttcgttcgttctttttacggaacctagtacgaaggacggcccgacggccgtaccggtccccgttgttacgtcggtactattaccgttaagcggaacgaaccaacccgtaacggccccgaccccgtacggaacttcccgaagacggacgtacgccccgtcgtcgtacccgacggtacggtacgaacgggtacctaacggtccggtaccctaccgtagttactaccgtacgtaccgacgaccgtagaacgtcgaagtagtacgagtacgtactacgttagtacgttactaacgagtacgtaacgacggacggtacggtcgggtacggtcggggtaacgggggttcgtacgggggaggtaacgggtacgaacggtccgtacgacccgtcgtacggaccgacgtaacgccggaacgtcccgtccgtaccccgtcggtaccctcgtttccccgg

SEQ ID NO: 395774 - DNA, 564 bp, Homo sapiens
  misc_feature: GZ8MTXP02FIOVZ.51.5.A05.1.454.CMB.2.raw
  modified_base (223)..(223): a, c, t, g, unknown or other
  modified_base (250)..(250): a, c, t, g, unknown or other
  modified_base (362)..(362): a, c, t, g, unknown or other
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttnccaaagaaatctgtctttttggacatnagagcaggccaggcccctgtattggtcatctatgagacacaagcgacccctcggaactccagtagagagtcgacgtcggctccgaggtcagggacatcggccacttgactancacgtgggacccagagtcgacgataggaaggtagactaacgtactagttattacgacaggacagacaggttggtacgtacgggacggggttcggttcggacgggtaacggggacgaaaaggccgttacggacccgttcgtaggacgttcgacgacccgtaaggccgtccgcccccgtggtcccgaactccgtcgttaccccc

SEQ ID NO: 395775 - DNA, 697 bp, Homo sapiens
  misc_feature: GZ8MTXP02GCX8P.51.5.A05.1.454.CMB.2.raw
  modified_base (214)..(214): a, c, t, g, unknown or other
  modified_base (252)..(252): a, c, t, g, unknown or other
  modified_base (258)..(258): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctcaggacaaacggccaagatcactgctttgganatgcgttgaccaaagaactctgtcttttggacatcagngcagcncgccctgtatgtcatctatggacgaccacgaagccgacccgtacgactccgagacgagcgtcgcgtcggcctcgaggtcgacgggactaagtccggtaccctacgttacgaccttacgtccgaaccggtcgggaaaccctaggtacggtacgggaacgtaaggtaggaacgggtaccgtaaccgttaccctaacgttacgtttaacgtaccggtaaacacggaaccgagtaccgtaagggttcgggttacggtacggggttaacggggggttccggttacgggggacggggtaagggggtaaccgtacggtaccggtaccgggtacccgtttaccggtaggtaccggttaccgaccggtaccccgaacgggtccccgttaccccggtaccccccgttcggtccccctttaccgttcccgtttaccccgtttcccccccg

SEQ ID NO: 395776 - DNA, 641 bp, Homo sapiens
  misc_feature: GZ8MTXP02I2VYP.51.5.A05.1.454.CMB.2.raw
  modified_base (217)..(217): a, c, t, g, unknown or other
  modified_base (221)..(221): a, c, t, g, unknown or other
  modified_base (245)..(246): a, c, t, g, unknown or other
  modified_base (270)..(270): a, c, t, g, unknown or other
  modified_base (273)..(273): a, c, t, g, unknown or other
  modified_base (276)..(276): a, c, t, g, unknown or other
  modified_base (545)..(545): a, c, t, g, unknown or other
tcagcgatcgtatacacgaccggtgctcgatttagatagatagacagggggctgtgggctcaggaggcagagctctgggaatctcaccatggcctggacccctctcctgcctccccctcctcactttctgcacagtctctgaggcctcctatgagctgacgcagccaccctcagtgtcagtgtctccaggacaacggccaagatcacctgcttgganatgngttgacaaagatctgtctttgacnncagagccagccacggcctgtatgnatntangagacacagccgaccctcgaactccgtagagagtacgcgtctcgctccgaggtcgacggacacgtcggaccacgttagactactaccgacgtacggaacccagtacgtacggacgaagtaggaacggtactaacccttaaccgtacgtttagtttaaccgttaccgaacgttacggaaacgtaggtaaccgtagggttacggggtaaacggggttcggggtaaacgggggttcccggttacgggggaccgggggaaggggaaaaccggnggtaccggtaccggtaacccggtcgtacggacgttaccgaaaccggtcccgaacggtccccgtcccggacccccgttcggtaccttaccgttcccg

SEQ ID NO: 395777 - DNA, 530 bp, Homo sapiens
  misc_feature: GZ8MTXP02IMYP0.51.5.A05.1.454.CMB.2.raw
  modified_base (301)..(301): a, c, t, g, unknown or other
  modified_base (309)..(309): a, c, t, g, unknown or other
  modified_base (420)..(420): a, c, t, g, unknown or other
tcagcgatcgtatacacgaccggtgctcgatttagatagatagacagggggtgggctcaggaggcagagctctgggaatctcaccatggcctggacccctctcctgcctcccccctcctcactttctgcacagtctctgaggcctcctatgagctgacgcagccaccctcagtgtcagtgtctccaggacaaacggccaagatcacctgctttggagatgcgttgaccaaaagaaatctgtctttttggacatcagagcagccaggccctgtatggtcatctatgagacaccaagcgaccncgaatccngagagagtcgctcggctccgaggtcaggacaagtcggacctacctgactatacacgtgggacccagacgtggacgagtagaagtgactaccgtatcgttatcgaacagacngcagtgacgtcggtagggtcgtggggcggaagggacgaagtcgagtaccgtcgtacgagtacgacgcccgaaggccctcgccccgtgtccacttccgaccgtttcccccg

SEQ ID NO: 395778 - DNA, 604 bp, Homo sapiens
  misc_feature: GZ8MTXP02J0S1I.51.5.A05.1.454.CMB.2.raw
  modified_base (184)..(184): a, c, t, g, unknown or other
  modified_base (217)..(217): a, c, t, g, unknown or other
  modified_base (440)..(440): a, c, t, g, unknown or other
tcagcgatcgtatacacgaccggtgctcgatttagatagatagacagggggtgggctcaggaggcagagctctgggaatctcaccatggcctggaccccctctcctgcctccccctcctcacttttctgcacagtctctgaggcctcctatgagctgacgcagccaccctcagtgtcagtgtcnccaggacaaacggccaagatcactgcttggagntgcgttgaccaaagaatctgtcttttagaccatcgagaggccacggtccgacggcccctgtacgttggtacatctatgagacaccagccgaccgtcgactcctgagagtagtcgctgctcgaggtcaggacagtcgcctactgactatcacgtacggacccagagtagggaacagtaggaggtcaacgtaccctagttagttacgttacgaactagacgacgngtagggttggttaacggtcgggtaacgggggttccgttacgggggacggggtaacggacggaacgtcgtacggtaaccgtcgtaggtacgtacgaccggtaccgaacggtcccgtaccggtcccccgtacggtaccgtaccgtttccgtacccgtttccccccg

SEQ ID NO: 395779 - DNA, 627 bp, Homo sapiens
  misc_feature: GZ8MTXP02IBD7E.51.5.A05.1.454.CMB.2.raw
  modified_base (251)..(251): a, c, t, g, unknown or other
  modified_base (273)..(274): a, c, t, g, unknown or other
  modified_base (308)..(308): a, c, t, g, unknown or other
  modified_base (311)..(311): a, c, t, g, unknown or other
tcagcgatcgtatacacgaccggtgctcgatttagatagatagacagggggctgtgggctcaggaggcagagctctgggaatctcaccatggcctggacccctctcctgctccccctcctcactttctgcacagtctctgaggcctctatgagctgacgcagccacctcagtgtcagtgtctcagacaacgccaagatcactgtcttggagatgcgttagaccaaaagaatctgtcttttggaccatcagngccagccaggccctgtattgtnntctatgagacacagccgaccacgaactcctaganagntcgctgctcgagtcgaggacaagtcgaccaccgttagactataccacgtaccggaacccgagacgtaggaacgaagtacggtaaaggtacgaaacctacctactacggtttaattaccgaacgtaagaaccgaggtaccgtaagggttacgggttaaggtcgggtaaacggggggttaccggttcgggggaaccggggaaacggggtacggtaaaacggccggttacggaaccccggttgtacggacgtacccgacgtaaccccggaacggtccgtacccggaccccccgttcggggtcccctaacgttcccccgg

SEQ ID NO: 395780 - DNA, 598 bp, Homo sapiens
  misc_feature: GZ8MTXP02JBXL6.51.5.A05.1.454.CMB.2.raw
  modified_base (238)..(238): a, c, t, g, unknown or other
  modified_base (334)..(334): a, c, t, g, unknown or other
  modified_base (460)..(460): a, c, t, g, unknown or other
tcagcgatcgtatacacgaccggtgctcgatttagatagatagacagggggtgggctcaggaggcagagctctgggaatctcaccatggcctggacccctctcctgcctccccctcctcactttctgcacagtctctgaggcctcctatgagctgacgcagccaccctcagtgtcagtgtctccgaggacaaacggccaagatcacctgctttggagtatgcgttgaccaaagaattntgtctttttaggacctatcagacgccaggccacggtccctgtatggtcatctatgaacgacaaccacgccgaccctaccggaactcccgtaggagngacgtcgcgtcggcctccgaggtaccgagggaccaagtcggacctacgttcgactagacacgtcgggaccctagagtcggaacgtagtaggtaacgtcgaactaacctagttagttacgttacganacgacacgagtacggtaggtacggtggacggggttcgtacggggagggagggtacgaaggcgttacggaccgtcgagacgtcgacgaccgaacggtccgtaccggccccttcggacctcgtccgtcccgtttcccccg

SEQ ID NO: 395781 - DNA, 671 bp, Homo sapiens
  misc_feature: GZ8MTXP02GLIYT.51.5.A05.1.454.CMB.2.raw
tcagcgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgtcgttgaccaaagaaactcttgtcgttttttggaacctatcagacggccaggccaggcccctagtactggtcagtctatgaggacaaccaagccgaccctaccggaactcccgagtagacgagtcgcgtaccggcttacgaggtacgaggactaagccggtccaccgttagacttagacctacgtacgggaaccccaggtaagtacgggaacgaagttgggaaaacggtcggaaaccttaccgacttagtttacgttacgactaaggaccaggttacaggtagggtaaggtcgggacgggggttcttacgggggacgggacgggggaaacgtacggtacggtaccggtaccggtacgtacggtaacggtaccgaaaccggaccccgtaaaggccccgttacccggcccccgttaacgggtccctaccgttccccgttaccggtttcccccccg

SEQ ID NO: 395782 - DNA, 501 bp, Homo sapiens
  misc_feature: GZ8MTXP01B39AA.21.27.C05.1.454.CMB.2.raw
  modified_base (202)..(202): a, c, t, g, unknown or other
  modified_base (238)..(238): a, c, t, g, unknown or other
  modified_base (299)..(299): a, c, t, g, unknown or other
  modified_base (369)..(369): a, c, t, g, unknown or other
  modified_base (387)..(387): a, c, t, g, unknown or other
  modified_base (482)..(482): a, c, t, g, unknown or other
  modified_base (490)..(490): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggttagcctggtaccagcagaaatctggccaggctcccaggctcctcatttaccgngcatccacagggccactggtctcccagacaggttcaggtggcggtggaatttggggaacagtagttttcnctcacatcagcgccctanagagtgaagatgttgctagtttattctgccagctaatataattctggcctgcgtcgacgttcggccaacgggacaaggtgaaatcaagacgttgngctgcacnttctgttcttc

SEQ ID NO: 395783 - DNA, 641 bp, Homo sapiens
  misc_feature: GZ8MTXP01D2IGL.21.27.C05.1.454.CMB.2.raw
  modified_base (204)..(204): a, c, t, g, unknown or other
  modified_base (312)..(312): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggggacnccgccaccctctcctgcacagccagtcagtctatcgctgacttggtacgcctggtaccagcaagaaatcgtcggccaggcctcccgaggcctcctctacgtttaccgngacctactcccaccgacgggcccacgtggtctcccagacgtacggttcaggtggcggtggtaagtttgggaactagttacgttttcctctacacctatccacgccgtaccctaagagtagtagaaagtgttgttagacttaagtttatttcgtcgaccgtaagtactaaattattaaacttacgtggtaccttggtccgttaccggtaccggttccgggacccggtaaccggggtaaccgttaaaggggtaacgaaaacgtaaccgtaaaacggttaacgttcggttacggtctacgaaccctacctagttccgttcgttccttaaccg

SEQ ID NO: 395784 - DNA, 524 bp, Homo sapiens
  misc_feature: GZ8MTXP01CGM4H.21.27.C05.1.454.CMB.2.raw
  modified_base (203)..(203): a, c, t, g, unknown or other
  modified_base (300)..(300): a, c, t, g, unknown or other
  modified_base (323)..(323): a, c, t, g, unknown or other
  modified_base (371)..(371): a, c, t, g, unknown or other
  modified_base (391)..(391): a, c, t, g, unknown or other
  modified_base (500)..(500): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctacacagccagtcagtctatcgctgactggttagcctggtaccagcagaaatctggccaggctcccaggctcctcatttaccgngcatccaccagggcccactggtntcccagacaggttccaggtggcggtggatttggggactgtagttttcnctcaccatcagtcgccctanagagtgaagattgttgctagtttattctgtccaggctaaattataaattactggcctgtcgtcgtacgttcgccgacgggaaccaaggttggaaattcgaaacgattgnggctgcaaccatcttgtcttctaa

SEQ ID NO: 395785 - DNA, 609 bp, Homo sapiens
  misc_feature: GZ8MTXP01D74UG.21.27.C05.1.454.CMB.2.raw
  modified_base (203)..(203): a, c, t, g, unknown or other
  modified_base (249)..(249): a, c, t, g, unknown or other
  modified_base (297)..(297): a, c, t, g, unknown or other
  modified_base (377)..(377): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtancctggtaccagcagaatctggccaggctcccaggctcctcatttccgncatcccacagggccacgtggtcgtcccagactaggttcaggtggcggtggtaagtttggggaactaggtacgtttttccnctacactatcacgccgaccctagaggtagtagaaagtagttgttagtacttagtttactttctcgaccgtaagtactaaattaacttaaacttacgtcggtccttacggtccggttaccggtaccggttccggacccggaaacgggtaaccgttaaaggggtacgttaaaacgtaacgaaaacgttacgttggttacggtctagaacctacgtacttcgttcgtttccgttc

SEQ ID NO: 395786 - DNA, 523 bp, Homo sapiens
  misc_feature: GZ8MTXP01DTGPI.21.27.C05.1.454.CMB.2.raw
  modified_base (203)..(203): a, c, t, g, unknown or other
  modified_base (300)..(300): a, c, t, g, unknown or other
  modified_base (374)..(374): a, c, t, g, unknown or other
  modified_base (386)..(386): a, c, t, g, unknown or other
  modified_base (391)..(391): a, c, t, g, unknown or other
  modified_base (442)..(442): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtagcctggtaccagcagaaatctggccaggctcccaggctcctcatttaccgngcatcccacagggccacgtggtctcccagactaggttcaggtggcggtggtaactttgggaactgtagttttcnctcacatcagcncctanagagtgaagattgttgctagtttattctgactagtactaattaataattcnggtctagcgtcgtacgttcggcaacgggacaggtacgaaactacgaacgaacgttggttacggctgcacattctgttcttc

SEQ ID NO: 395787 - DNA, 611 bp, Homo sapiens
  misc_feature: GZ8MTXP01BEPT6.21.27.C05.1.454.CMB.2.raw
  modified_base (203)..(203): a, c, t, g, unknown or other
  modified_base (250)..(250): a, c, t, g, unknown or other
  modified_base (377)..(377): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggctcccaggctcctcatttaccgtgcatccacgtagggccacgtggtcgtcccagacctaggttcaggtggcggtggaatttggggaactagtagttttcnctcaccattcagcgccctacagagtgaaagtattggttgctagttttatttcgtcggccctaaggtactaaattattaaactttacgtgggtcccttggccggttcggtaaccggtttccgggacccgtaaacgggggaacccgaaaggggttacgggaaaacttaccgaaaaacgttaaccgttggttcggggaaccttggaaccacccgtagttccttggttcctttaaccg

SEQ ID NO: 395788 - DNA, 528 bp, Homo sapiens
  misc_feature: GZ8MTXP01DAFCQ.21.27.C05.1.454.CMB.2.raw
  modified_base (204)..(204): a, c, t, g, unknown or other
  modified_base (303)..(303): a, c, t, g, unknown or other
  modified_base (384)..(384): a, c, t, g, unknown or other
  modified_base (457)..(457): a, c, t, g, unknown or other
  modified_base (511)..(511): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctcctgcacagccagtcagtctatcgctgactggttagcctggtaccagcagaaatctggccaggctcccgaggcctcctcatttaccgngcatccaccagggcccacgtggtcgtcccagacctaggttcaggtgggcggtggtaagtttgggaactaggtagtttttcnctccaccatcacgcgaccctacagagtagaaagtatgttagctagtttattctgctagctaaatataattacngctgcgtcgtacgttcggcgaacgggacaaggtgaaatacgaagacgttgttgntgcacattctgttcttc

SEQ ID NO: 395789 - DNA, 594 bp, Homo sapiens
  misc_feature: GZ8MTXP01ECJZA.21.27.C05.1.454.CMB.2.raw
  modified_base (202)..(202): a, c, t, g, unknown or other
  modified_base (248)..(248): a, c, t, g, unknown or other
  modified_base (299)..(299): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggtancctggaccagcagaaatctggccaggctcccaggcctcctctatttaccgncactcccaccgagggcccacgtggtcgtcccagactacggttcaggtggcggtggtaagtttgggaactagtacgtttctctcacatccagcgaccctagagagtagaagattgtgacttagtttactttctcggacctaagtactaaattaattaaacttacgtcggtcctggtccgttccggtaccggttccgggcccgtaacgggaaccgaaagggttacggaaaacgttacggaaaacgttacgttggttacgggtctggaaccacgtacttcgttaacgttctttaaccg

SEQ ID NO: 395790 - DNA, 520 bp, Homo sapiens
  misc_feature: GZ8MTXP01EM9H7.21.27.C05.1.454.CMB.2.raw
  modified_base (297)..(297): a, c, t, g, unknown or other
  modified_base (362)..(362): a, c, t, g, unknown or other
  modified_base (372)..(372): a, c, t, g, unknown or other
  modified_base (389)..(389): a, c, t, g, unknown or other
  modified_base (428)..(428): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggagcgccaccctctcctgcacagccagtcagtctatcgctgactggtagcctggtaccagcagaaatctggccaggctcccaggctcctcatttaccgngcatccaccagggccactggtcgtcccagacaggttcagtggcgtgaatttgggcagtagtttcnctcacatcancgcctacagagtgaagnttgtgctagtttattctgaccagtacaaatataaattcnggtacctgccgtcgtacggttcggccgtaacggaaccgttaagggtacgaaatacgaaacgaacgttgacgctgcaccattctcgttctaac

SEQ ID NO: 395791 - DNA, 531 bp, Homo sapiens
  misc_feature: GZ8MTXP01CUUIP.21.27.C05.1.454.CMB.2.raw
  modified_base (205)..(205): a, c, t, g, unknown or other
  modified_base (215)..(215): a, c, t, g, unknown or other
  modified_base (300)..(300): a, c, t, g, unknown or other
  modified_base (372)..(372): a, c, t, g, unknown or other
  modified_base (396)..(396): a, c, t, g, unknown or other
  modified_base (409)..(409): a, c, t, g, unknown or other
  modified_base (426)..(426): a, c, t, g, unknown or other
  modified_base (446)..(446): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggggancgccaccctntcctgcacagccagtcagtctatcgctgactggttagcctggtaccagcagaaatctggccaggctcccagctctcatttaccgncatccaccgagggccactggtctccagacaggttcaggtggcggtgtaagtttgggaactagtacgttttcnctcacctatccagccgaccctaanaggagtagaaatntgttgctagtttattcngccagtactaatataattcnggtctgcgtcgacgttcggccgaacgggtacaagggtacgaaagtacgaaaagttacgttggcgctgccacgattctcgttcttc

SEQ ID NO: 395792 - DNA, 589 bp, Homo sapiens
  misc_feature: GZ8MTXP01CI3JT.21.27.C05.1.454.CMB.2.raw
  modified_base (203)..(203): a, c, t, g, unknown or other
  modified_base (300)..(300): a, c, t, g, unknown or other
  modified_base (379)..(379): a, c, t, g, unknown or other
  modified_base (463)..(463): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggctcccaggcctcctcatttaccgngccatccaccgagggccacgtggtctcccagacacggttcaggtggcggtggtaatttggggaactaggtacgttttcncgtcaccgtatcagccgtaccctacgagagtgaagtattgttagcttagtttattctacgcctagtactaaatattaattacgnggtcctggtccgtcggtaccgttccggccgtaacgggaccttaaagggtacggaaacgttaccgaaacggttacgttggttacggtcttacggtaacctagttccgttagttccgttcgttaaccg

SEQ ID NO: 395793 - DNA, 571 bp, Homo sapiens
  misc_feature: GZ8MTXP01EPGFY.21.27.C05.1.454.CMB.2.raw
  modified_base (224)..(224): a, c, t, g, unknown or other
  modified_base (471)..(471): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcgacagatcaaactacagcagtctggtccaggactggtgaggccctgcagaccctttnactcacctgtgacatctccggggaaaatgtcgctggcaaacgaatggtgaattggattaggcagtccccgtgagaggccttgagtggcttggaaggacctatatacgtccagtgtatgaagactatgacagaattctgtgagcggtcgtctcaccatcaccccagaccacgtaccaaagaactcaaggtccctaccctaccaacctaatcgtctgtccactcccgacgacacggctagtttatttgngtcaacggagggacttcgaacgtacgtttcgggttgttaaccttaaccctcctttaacgaaccgttcccgttgggggtccccgttaaggggttaacccgg

SEQ ID NO: 395794 - DNA, 558 bp, Homo sapiens
  misc_feature: GZ8MTXP01BUF1S.21.27.C05.1.454.CMB.2.raw
  modified_base (203)..(203): a, c, t, g, unknown or other
  modified_base (298)..(298): a, c, t, g, unknown or other
  modified_base (370)..(370): a, c, t, g, unknown or other
  modified_base (388)..(388): a, c, t, g, unknown or other
  modified_base (441)..(441): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaatctggccaggctcccaggctcctcatttaccgngcatcccaccgagggccacgtggtcgtcccagacaggttcagtgggcgtggaatttgggctagtagttttcnctcacatcagcgccctanagagtgaagatgttgctagtttattcgtgcctagctaaattacttaattacgnggtcctaggcgttccggtacgttccgggccgaacgggaccgaaagggtacggaaactaccgaaacggttaacgttggttcgggaacttggccaccgtattccgttcgttcctttccg

SEQ ID NO: 395795 - DNA, 521 bp, Homo sapiens
  misc_feature: GZ8MTXP01DSOV8.21.27.C05.1.454.CMB.2.raw
  modified_base (204)..(204): a, c, t, g, unknown or other
  modified_base (301)..(301): a, c, t, g, unknown or other
  modified_base (373)..(373): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctcctgcacagccagtcagtctatcgctgactggttagcctggtaccagcagaaatctggccaggctcccaggctcctcatttaccgngcatcccaccagggcccacgtggtcgtcccagacaggttcaggtggcggtggaatttgggcagtagttttcnctcaccatcagcgccctacagtagtgaagtatgttgctagtttattctgcctagctaaatataattctggcctgcgtcgacgttcggccaacgggaccaagggtaggaaatacgaaacgacgttgttaggctgcacattctgttcttc

SEQ ID NO: 395796 - DNA, 542 bp, Homo sapiens
  misc_feature: GZ8MTXP01DVDDR.21.27.C05.1.454.CMB.2.raw
  modified_base (465)..(465): a, c, t, g, unknown or other
  modified_base (488)..(488): a, c, t, g, unknown or other
  modified_base (496)..(496): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaaatgtcgctggcaacaatggtggaattggattaggcagtccccgtgagagccttgagtggcttggaaggacctattatacgtccagtggtatgaagactatgacagaatctgtgagcggtcgtctcaccatcacccagacacgtaccaagatcaggtctccctccacctaatcgtactgtaccactcccgacgacgacggctaggtttattttgngtaacaagagggtattcgaactnttcggttnacctaaccttccttgacctccgttggggtcccgaaggggttaaccg

SEQ ID NO: 395797 - DNA, 575 bp, Homo sapiens
  misc_feature: GZ8MTXP01CWLSM.21.27.C05.1.454.CMB.2.raw
  modified_base (203)..(203): a, c, t, g, unknown or other
  modified_base (250)..(250): a, c, t, g, unknown or other
  modified_base (299)..(299): a, c, t, g, unknown or other
  modified_base (324)..(324): a, c, t, g, unknown or other
  modified_base (375)..(375): a, c, t, g, unknown or other
  modified_base (396)..(396): a, c, t, g, unknown or other
tcagtcgtcgctcgcacgaccggtgctcgatttagacgcgatcgaagggtttgggggaggaactgctcagttaggacccagacggagccatggaagccccagcgtagcttctcttcctcctgcttctctggctcccagacaccactggagtgattgtgatgacgcagtctccagccaccctgtctgtgtctccgaggggggancgccaccctctcctgcacagccagtcagtctatcgctgactggttanctggtaccagcagaaatctggccaggctcccaggctcctcatttaccgngccatcccaccagggccacgtggtntcccagacaggttccaggtgggcggtggatttgggactaaggtagttttcnctcaccatcacgcgaccctanagagtgaaagatgttgctagtttatctgccaggtactaaattaataacttacgtggccttggtccgtcgtaccggttccgggaccgtaacggggaaccaaaggggttaggaaaacgttcccgaaaaaggtacgttacggttcggacgtgaccaaccattcttcgttaacttcgtaaccg

SEQ ID NO: 395798 - DNA, 613 bp, Homo sapiens
  misc_feature: GZ8MTXP01CLRUW.21.27.C05.1.454.CMB.2.raw
  modified_base (205)..(205): a, c, t, g, unknown or other
  modified_base (215)..(215): a, c, t, g, unknown or other
  modified_base (251)..(251): a, c, t, g, unknown or other
  modified_base (304)..(304): a, c, t, g, unknown or other
  modified_base (602)..(602): a, c, t, g, unknown or other
tcagtcgtcgctcgcacgaccggtgctcgatttagacgcgatcgaagggtttgggggaggaactgctcagtttaggacccagacggagtccatggaagccccagcgcagcttctcttcctcctgcttcgtctggctcccagacaccactggagtgattgtgatgacgcagtctccagccaccctgtctgtgtctccgagggggancgccaccctntcctgcacagccagtcagtctatcgctgactggtancctggtaccagcaagaaatctggccaggctcccaggtctccgtcatttaccgngcatcccaccgagggcccaacgtggtacgtaccccagtacctagggtttccaggtgggccggttgggaaagttttcgggggaacagggtacggtttttccacgtccaaccctatccgaagccgtaccccttagaggagttaggaaagtattggttagactaggttttattcgtagtcctagacctaaattactaaagttccgtaggcccttggccgttcgaaccggtttccggccgtaacggggaccagggtacgaaactaccgaaacgttacgttcggttcggcctggccaaccctnttctcgttctc

SEQ ID NO: 395799 - DNA, 569 bp, Homo sapiens
  misc_feature: GZ8MTXP01CGYX0.21.27.C05.1.454.CMB.2.raw
  modified_base (201)..(201): a, c, t, g, unknown or other
  modified_base (378)..(378): a, c, t, g, unknown or other
  modified_base (390)..(390): a, c, t, g, unknown or other
  modified_base (396)..(396): a, c, t, g, unknown or other
  modified_base (553)..(553): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcaagaaatctggccaggcctcccaggctccctcatttaccggccactcccaccgagggcccacgtggtctccccagactacggttcaggtggcggtggaatttgggctagtagttttcnctcacatcagcnccctanagagtgaagattgttgctagttttattctgaccagtactaaattaattaaattacgtggtccttaggccgttcggtaccggttccgggaccgaacggggaaccaaagggtacgaaactacgaaaacggttacgttggttcgggtctgccaaaccgtnttcgttcgttcgtaac

SEQ ID NO: 395800 - DNA, 537 bp, Homo sapiens
  misc_feature: GZ8MTXP01D5SQP.21.27.C05.1.454.CMB.2.raw
  modified_base (411)..(411): a, c, t, g, unknown or other
  modified_base (468)..(468): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggtggaattggattaggcagtccccgtgagagccttgagtggcttggaagacctatatacgtcccagtggtatgaagactatgacagaatctgtgagcggtcgtctcaccgatcacccagacacgtaccaagaatcagtccnccctacacctaatgtctgtcactcccgacgacacggctagtttatttgtgaacaagngggtattcgactattcgggttcaccttaacctccgttgacctccgaggggtccgttaagggtttaaccg

SEQ ID NO: 395801 - DNA, 516 bp, Homo sapiens
  misc_feature: GZ8MTXP01A6EET.21.27.C05.1.454.CMB.2.raw
  modified_base (203)..(203): a, c, t, g, unknown or other
  modified_base (299)..(299): a, c, t, g, unknown or other
  modified_base (371)..(371): a, c, t, g, unknown or other
  modified_base (389)..(389): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggctcccaggctcctcatttaccgngcatccaccagggccacgtggtcgtcccagacaggttcaggtggcggtggaatttgggaactgtagttttcnctcacatcagcgccctanagagtgaagatgtgctagtttattctgccagctaatataattactggcctgcgtcgacgttcggccaacgggaccaaggtaggaaactacgaaaacgacttggttaggctgcaccattctgttcttc

SEQ ID NO: 395802 - DNA, 536 bp, Homo sapiens
  misc_feature: GZ8MTXP01B75RV.21.27.C05.1.454.CMB.2.raw
  modified_base (203)..(203): a, c, t, g, unknown or other
  modified_base (303)..(303): a, c, t, g, unknown or other
  modified_base (383)..(383): a, c, t, g, unknown or other
  modified_base (418)..(418): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtagcctggtaccagcagaaatctggccaggcctcccgggctcctcattttacccgngcactcccaccaggggcccacgtgggtcgtccccagacaggttccaggtgggcggtggagtttgggactggtagttttcncacaccatcagcgccctacagagtgaagattgttnctagtttattctgccaggctaattataattactggcctgcgtcgtacgttcgccgacgggaacaagggttgaaattcgaaacgacttggttggctggcaaccatcttgtccttctaac

SEQ ID NO: 395803 - DNA, 524 bp, Homo sapiens
  misc_feature: GZ8MTXP01D2P7U.21.27.C05.1.454.CMB.2.raw
  modified_base (203)..(203): a, c, t, g, unknown or other
  modified_base (249)..(249): a, c, t, g, unknown or other
  modified_base (300)..(300): a, c, t, g, unknown or other
  modified_base (371)..(371): a, c, t, g, unknown or other
  modified_base (388)..(388): a, c, t, g, unknown or other
  modified_base (440)..(440): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtancctggtaccagcagaaatctggccaggcctcccaggctcctcatttaccgngcatcccaccagggccacgtggtctcccagacaggttcaggtggcggtggaatttgggctagtagttttcnctcacatcagcgcctanagagtagaagtatgtgactagtttattctgccaagtctaaattataattacnggacctgcgtcgacgttcgccgaacgggacaaggtcggaaatacgaaaacgacgttgttaggctcggcaccattctcgttcttc

SEQ ID NO: 395804 - DNA, 528 bp, Homo sapiens
  misc_feature: GZ8MTXP01ECPJL.21.27.C05.1.454.CMB.2.raw
  modified_base (358)..(358): a, c, t, g, unknown or other
  modified_base (411)..(411): a, c, t, g, unknown or other
  modified_base (463)..(463): a, c, t, g, unknown or other
  modified_base (518)..(518): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggcttggaaggacctattatacgtcccagtggtatgaagactatgcagnttctgtgagcggtcgtctcaccatcaccccagacacgtccaagaatcaggtcnccctccacctaatgtctgtcactcccgacgacacggtctagtttacttttgngcaagagggattcgactattcggttgactaacctcttcgactccgttggggtccnggggttaacg

SEQ ID NO: 395805 - DNA, 602 bp, Homo sapiens
  misc_feature: GZ8MTXP01DSK2T.21.27.C05.1.454.CMB.2.raw
  modified_base (198)..(198): a, c, t, g, unknown or other
  modified_base (245)..(245): a, c, t, g, unknown or other
  modified_base (265)..(265): a, c, t, g, unknown or other
  modified_base (295)..(295): a, c, t, g, unknown or other
tcagtcgtcgctcgcacgaccggtgctcgatttagacgcgatcgaagggtttggggaactgctcagttaggacccagacggagccatggaagcccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatcnggccaggctcccaggctcctcatttaccgncactccacgaggccagtggtcgtccagactaggttccaggtgggcggtggtagtttaggggaactggttacgttttcctctacacctatcgacgccgtaccctagaggtagtagaagtagttgttagcttagtttacttcgtgaccaaggtactaaattaattaacttacgtcggtccttggaccggttacggtaccggttccggacccggaaccggggaaccgtaaagggttacggaaacttacgaaaacgtacgttacggttcggacgtaacgacctaaccgtattccgttcgttccttcgtaac

SEQ ID NO: 395806 - DNA, 589 bp, Homo sapiens
  misc_feature: GZ8MTXP01D44ZY.21.27.C05.1.454.CMB.2.raw
  modified_base (366)..(366): a, c, t, g, unknown or other
  modified_base (400)..(400): a, c, t, g, unknown or other
  modified_base (422)..(422): a, c, t, g, unknown or other
  modified_base (475)..(475): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagtacccttcactcacctgtgacatcgtaccggggaaatgtcgctggacaacaatggtggaattggattaggcagtccccgtgagagccttgagtggcgttaggaacggtacctattataccgtccagtggtactgaagactatgacagtnttctgtgagtcggtcgtctcaccatccaacccanacacgtaccaagatcacgtccncctacactaagtctctcgtcacctccgacgacacggtcttagtttacttttgngaactaaggagggacttcgtaaacgtacgtttaccgggttcttaacccttaaccctttaccgttcgtaacccgttccggttacggggtaaccgttaacggggttttaaacccgg

SEQ ID NO: 395807 - DNA, 621 bp, Homo sapiens
  misc_feature: GZ8MTXP01BE1NM.21.27.C05.1.454.CMB.2.raw
  modified_base (203)..(203): a, c, t, g, unknown or other
  modified_base (302)..(302): a, c, t, g, unknown or other
  modified_base (391)..(391): a, c, t, g, unknown or other
  modified_base (595)..(595): a, c, t, g, unknown or other
  modified_base (605)..(605): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggctcccgaggcctcctctatttaccgngcactcccaccgagggccctacgtggtctacccagacgtacggttccaggtcgggcggtggtaagtttggggaactaggtacgttttcncgtccactatccaggtccctaccctaacgaggtaacgtaggtaaacgtagtttggttacggtacttaagtttttactttcgtacgacctagtactaaattattaaactttcgacggtcctagggtccgtaccggtacggttccgggccgtaaaccggggaaccttaaggggtagaaacgtacgaaaacgacgttgttacggtcncgtaacaccnttacctgttcttaacc

SEQ ID NO: 395808 - DNA, 577 bp, Homo sapiens
  misc_feature: GZ8MTXP01C0EDY.21.27.C05.1.454.CMB.2.raw
  modified_base (361)..(361): a, c, t, g, unknown or other
  modified_base (477)..(477): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccgggggaaaatgtcgctggcaacaatggttggaattggattaggcagtccccgtgagaggccttgagtggcttggaaggacctattatacgtcccagtggtatgaagctatgacagnttctgtgagcggtctcgtcaccatcacccagacacgtacaagatcacggtctccctaccacctaagtcgtctgtccactcccgacgacacggtctagtttattttgtgccaaaggngggtacttcgtaacgtagtttcgggttcgaaccgttaacccttacccgtttcgaacccgttcccggttacgggggtccccgttaaggggtttaaccccgg

SEQ ID NO: 395809 - DNA, 531 bp, Homo sapiens
  misc_feature: GZ8MTXP01B2V6O.21.27.C05.1.454.CMB.2.raw
  modified_base (203)..(203): a, c, t, g, unknown or other
  modified_base (334)..(334): a, c, t, g, unknown or other
  modified_base (369)..(369): a, c, t, g, unknown or other
  modified_base (375)..(375): a, c, t, g, unknown or other
  modified_base (388)..(388): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgcccaccctctcctgcacagccagtcagtctatcgctgactggtagcctggtaccagcagaatctggccaggctccccaggcctcctcactttaccgtgcatcccaccagggccactggtctcccagacnggttcagtggcgtggaatttgggctagtagtttcnctcacntcacgcgccctanagagtgaagattgttgctagtttattctgcagtctaaatattaattactggacctggcgtcgacgttccggccgaacgggaccaagggtcgaaacgtcgaaacgacgttggttcggctggcctaccattcttgttcctttaac

SEQ ID NO: 395810 - DNA, 530 bp, Homo sapiens
  misc_feature: GZ8MTXP01C6GFZ.21.27.C05.1.454.CMB.2.raw
  modified_base (202)..(202): a, c, t, g, unknown or other
  modified_base (299)..(299): a, c, t, g, unknown or other
  modified_base (374)..(374): a, c, t, g, unknown or other
  modified_base (519)..(519): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggttagcctggtaccagcagaaatctggccaggctcccaggctcctcatttaccgngcatccaccgagggcccacgtggtcgtcccagactacggttcaggtggcggtggaatttgggctagtagttttcnctcacatcagcgcctacagagtagaagtatgttgcttagtttattctgcagtactaaatataattactggcctggcgtcgtacgttccggccgtaacggggaccaagggtacggaaatacgaaacgaacgttggttagctgcacnttctgttcttc

SEQ ID NO: 395811 - DNA, 626 bp, Homo sapiens
  misc_feature: GZ8MTXP01DM0F7.21.27.C05.1.454.CMB.2.raw
  modified_base (203)..(203): a, c, t, g, unknown or other
  modified_base (250)..(250): a, c, t, g, unknown or other
  modified_base (270)..(270): a, c, t, g, unknown or other
  modified_base (299)..(299): a, c, t, g, unknown or other
  modified_base (321)..(321): a, c, t, g, unknown or other
  modified_base (376)..(376): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatcnggccaggctcccaggctctcatttaccgncatccacgaggccacgtggtcncccagacacggttcaggtggcggtggtaagtttgggaactaggttacgttttccnctaccaacctatccgacgccgaccctaagagtagtagaaagtattgttagacttagtttacttcgtacgaccgtaagtaactaaattaacttaaattacgtcggtccttggccggttaccgtaaccggttccggaccggtaaaccggggaaccgttaaaggggtaacggaaaacgtaaaccgaaaaccggttaaacgttggttacgggtaacctacggaaccctaaccgtagttccttcgttccttaacg

SEQ ID NO: 395812 - DNA, 627 bp, Homo sapiens
  misc_feature: GZ8MTXP01A17ZS.21.27.C05.1.454.CMB.2.raw
  modified_base (202)..(202): a, c, t, g, unknown or other
  modified_base (372)..(372): a, c, t, g, unknown or other
  modified_base (379)..(379): a, c, t, g, unknown or other
  modified_base (402)..(402): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggncgccaccctctcctgcacagccagtcagtctatcgctgactggttagcctggtaccagcagaaatctggccaggctcccaggcctcctctactttaccgtgccatccaccgagggcccacgtggtctcccagacaggttcagtggcggtggtatttgggcagtagtttcnctcactntcagcgcctacagagtgaaagtntgttgacttagtttatttctgtccgtaagtactaaattaacttaaagtttaccgtacggtcccttaggtccgttaccggtaaccggtttccgggaccccgtaaacgggggtaacccgttaaaggggttaacggaaaacgttaccgaaaaacgttaacggttcggttacggggtaaccgttacggaaccctaaccctacgttaccgtttcgttcccttttaacccg

SEQ ID NO: 395813 - DNA, 607 bp, Homo sapiens
  misc_feature: GZ8MTXP01DTJN8.21.27.C05.1.454.CMB.2.raw
  modified_base (203)..(203): a, c, t, g, unknown or other
  modified_base (250)..(250): a, c, t, g, unknown or other
  modified_base (398)..(398): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcaccgccagtcagtctatcgctgactggttancctggtaccagcagaaatcgtggccaggcctcccgaggctcctcatttaccgtgccactcccaccgacggggccctacgtcggtcgtccccgagacgtaggtttcccaggtgggcggtggtagtttcggggaactggttacgttttcncctacaccatcacgccgaccctacgagagtagaagtatgttgcttagtttactttctagcctaggactaaattattaaacttacgtcggtcctggtcgtcggtaccggttcggaccgtaacggggaacctaagggttacggtaaacgttacgaaacgtaacgttggttcggttacgtcgacaactacgtacttgttccttaactaaccg

SEQ ID NO: 395814 - DNA, 712 bp, Homo sapiens
  misc_feature: GZ8MTXP01DM43I.21.27.C05.1.454.CMB.2.raw
  modified_base (201)..(201): a, c, t, g, unknown or other
  modified_base (394)..(394): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaatctggccaggcctcccaggcctcctactatttaccgtgccactcccaccgagggcccacgtcggtcgtccccagacgtacggttccaggtgggcgggtggtagtttacggggaactggttagtttttccncttaccgaaccctagtccgaacggccctaccccgtaacgaggtaggtaggtaaagtagtttggtttagtacgtttaaggtttttatttccgtacgtacccgtaagggtaacccttaaaatttaacgtttaaactttaccgtccgggttacccgttcgggtacccggtttaccggtaaccgggtttacccggggacccggtaaaccgggggaaacccggtaaaggggttaacggtaaaacgttaccgaaaacggtacgttagggttcggttaccgtaacggacctaacccgtatccgttacgttccgtttcgtaacccg

SEQ ID NO: 395815 - DNA, 691 bp, Homo sapiens
  misc_feature: GZ8MTXP01AE2B3.21.27.C05.1.454.CMB.2.raw
  modified_base (202)..(202): a, c, t, g, unknown or other
  modified_base (313)..(313): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacnccgccaccctctcctgcacagccagtcagtctatcgctgacttggttacgccgtaggtaccagacaagaaatcgtggccaggcctcccgaggcctcctctacgtttaccgngcactcccgaccgacgggccctacgtcggtcgtacccgagtaccgtacggttcgaggtcgggcgggttaggtaagtttggggaactagggttacgttttctcctaccacctataccgacgtcccgtacccgtaacgaaggtaggtaggaaagtagttcggttagtacgttaagttttactttacgtacggaccgtaagtaactaaattaacgttaaacgttacgtcggtacccgttcgggtccgttaccggtacccggttccgggacccggtaaccggggtaaccgttaaaggggtaacggttaaaacgtaaccgaaaacggttacgttcgggttacggtcgtcgaacctaccgtacgttccgttcgttccttaaccg

SEQ ID NO: 395816 - DNA, 638 bp, Homo sapiens
  misc_feature: GZ8MTXP01C32ZK.21.27.C05.1.454.CMB.2.raw
  modified_base (204)..(204): a, c, t, g, unknown or other
  modified_base (315)..(315): a, c, t, g, unknown or other
  modified_base (397)..(397): a, c, t, g, unknown or other
  modified_base (403)..(403): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggttagcctggtaccagcaagaaatcgtggaccaggcctccccgaggcctccctctaacttttacccgngaccactcccaccgacggggcccacgtggtcgtcccagacctaggttcaggtgggcggtgaagtttgggctagtagttttcnctcacntcagtccgacctagagagtagaaagtgttgttgacttaagtttactttcgtgaccgtaagtactaaattaacttaaatttaccgtcggtaccttcggtccggttaccggtaccggttccgggacccggaaacggggtaaccgaaaggggttaacggaaaacgttaaccgaaaacggttaacgttgggttacggtccttacggaacctaaccctattaccgttcgttcgtttaacc

SEQ ID NO: 395817 - DNA, 535 bp, Homo sapiens
  misc_feature: GZ8MTXP01BJJI5.21.27.C05.1.454.CMB.2.raw
  modified_base (200)..(200): a, c, t, g, unknown or other
  modified_base (362)..(362): a, c, t, g, unknown or other
  modified_base (373)..(373): a, c, t, g, unknown or other
  modified_base (393)..(393): a, c, t, g, unknown or other
  modified_base (409)..(409): a, c, t, g, unknown or other
  modified_base (486)..(486): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcagaaatctggccaggcctcccaggctcctcatttaccgtgcactccaccgagggcccacgtggctcccagacaggttccaggtggcggtggagtttgggacnggtagttttcnctcactatcagccgccctanagagtgaagtatgttnctagtttattctgccaggactaattataattacgtgcctgcgtccgtacgttcgccgacgggaacaaggaggaaacncgaaacgtacttggttcggctggccaacctagtcttcgtctttcgaacc

SEQ ID NO: 395818 - DNA, 579 bp, Homo sapiens
  misc_feature: GZ8MTXP01D8Z3W.21.27.C05.1.454.CMB.2.raw
  modified_base (202)..(202): a, c, t, g, unknown or other
  modified_base (268)..(268): a, c, t, g, unknown or other
  modified_base (302)..(302): a, c, t, g, unknown or other
  modified_base (376)..(376): a, c, t, g, unknown or other
  modified_base (396)..(396): a, c, t, g, unknown or other
  modified_base (408)..(408): a, c, t, g, unknown or other
  modified_base (558)..(558): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtccccagccaccctgtctgtgtctccgaggggggacncgccaccctctcctgcacagccagtcagtctatcgctgactggttagcctggtaccagcaagaaanctggccaggcctcccaggcctcctcatttaccgngcactcccaccagggcccacgtggtcgtcccagactaggttcaggtggcggtggatttgggaactagtgtttcnctcactatcacgcaccctanagtagtgaagtnttagttgacttagttttattcgtagacctaagtactaaattaattaacttacgtggtacctggtcggttaccggtacggttccgggacccgtaacggggaacctaaagggtaggaaactacgaaacggtacgtggttagcttagcctacngttctgttcttcttcgttccc

SEQ ID NO: 395819 - DNA, 576 bp, Homo sapiens
  misc_feature: GZ8MTXP01AS136.21.27.C05.1.454.CMB.2.raw
  modified_base (203)..(203): a, c, t, g, unknown or other
  modified_base (250)..(250): a, c, t, g, unknown or other
  modified_base (304)..(304): a, c, t, g, unknown or other
  modified_base (387)..(387): a, c, t, g, unknown or other
  modified_base (564)..(564): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggctcccgaggtcctcctcactttaccgngcactccaccgaggggcccacgtggtcgtcccagacctaggttcaggtgggcggtggtaagtttgggaactagtagttttccnctacaccatccagcgacccctagagagtagaagtatggttagcttaagtttacttcgtcgccagtactaaattataaacttcgtggcctaggccgtcgtaccggttccggccgaacggggtaaccaaggggtacgaaacgtacgaaaacgacgttgggttcgctacgcctaaccgtnttcgtcgttctc

SEQ ID NO: 395820 - DNA, 640 bp, Homo sapiens
  misc_feature: GZ8MTXP01B71SA.21.27.C05.1.454.CMB.2.raw
  modified_base (203)..(203): a, c, t, g, unknown or other
  modified_base (299)..(299): a, c, t, g, unknown or other
  modified_base (381)..(381): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaatctggccaggctcccaggctcctcatttaccgngcatcccaccgagggccacgtggtcgtcccagactaggttcaggtggcggtggtaagtttcggggaactagtagtttttccncgtccacctatccgacgccgtacccctaacgaggagttagaaagtattggtttacggacttaaggttttactttcgtacgtaccgtaagtacctaaattaattaaacttacgtcgggtccttacggtccggttccggtaccggtttccgggacccgtaaaccgggggaacccttaaaggggtacggaaaactaaccgaaaacggttaacgttgggttacggcttacggcctaaccgattccgtaacgttcctttaaccg

SEQ ID NO: 395821 - DNA, 565 bp, Homo sapiens
  misc_feature: GZ8MTXP01CTV9N.21.27.C05.1.454.CMB.2.raw
  modified_base (201)..(201): a, c, t, g, unknown or other
  modified_base (249)..(249): a, c, t, g, unknown or other
  modified_base (268)..(268): a, c, t, g, unknown or other
  modified_base (297)..(297): a, c, t, g, unknown or other
  modified_base (371)..(371): a, c, t, g, unknown or other
  modified_base (392)..(392): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttacncctggtaccagcagaatcngcaggcctccaggctcctctatttaccgncactccaccgagggcccacgtggtctccccagactaggttccgaggtggcggtggatttgggactgtagtttcnctcaccatcagccgaccctanagagtagaagtattgttgcttagtttattctgccaggactaaattaataattacgtggtcctggtaccgtcgtaccgttccggacccgaacggggaacctaaggggttacggaaattaccgaaaacgtacgttaggttcggttctggactaaccatcttagtccttcgtaacc

SEQ ID NO: 395822 - DNA, 530 bp, Homo sapiens
  misc_feature: GZ8MTXP01DPRMP.21.27.C05.1.454.CMB.2.raw
  modified_base (203)..(203): a, c, t, g, unknown or other
  modified_base (300)..(300): a, c, t, g, unknown or other
  modified_base (368)..(368): a, c, t, g, unknown or other
  modified_base (380)..(380): a, c, t, g, unknown or other
  modified_base (385)..(385): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatccaccgagggccactggtctcccagacaggttcagtggcggtggaagtttgggcagtagtttcnctcacatcagcncctanagagtgaaagtatgttgacttagtttattcgtgacctagtactaaataattaattacgtggacctggcgtcggtacgttccgggccgaacgggaccaagggtagaaagtacgaaacgacgttgttggctgcacattctgttcttc

SEQ ID NO: 395823 - DNA, 588 bp, Homo sapiens
  misc_feature: GZ8MTXP01DZCZW.21.27.C05.1.454.CMB.2.raw
  modified_base (202)..(202): a, c, t, g, unknown or other
  modified_base (298)..(298): a, c, t, g, unknown or other
  modified_base (367)..(367): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggctcccaggctcctcatttaccgngcatccaccagggccacgtggtcgtcccagacaggttcaggtggcggtgaatttgggctagtagtttcnctcacatcagcgccctacagagtgaagtatgttgctagtttatttctgcctaagtactaaattacttaaatttacgtcggtccttggtccgttcggtaacggtttccggggcccgtaacggggaacccttaaaggggtacgggaaaacttaccgaaaacggttaaacgttggttacgggcttacggaacctaacccgtattccttaacgttccttttaacc

SEQ ID NO: 395824 - DNA, 734 bp, Homo sapiens
  misc_feature: GZ8MTXP01EQ4X6.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggggacnccgcccaccctctcctgcacacgccagtcagtctatcgctgtacgttggtacgccgtacggtaccagacaagaaactcgtcggaccgacggcctacccgacggtcctcctactacgtttaccgtcgacctactacccgaaccggacgggccctacggttcggtaccgtacccgaagtacgtacggttacgagggtcgggtcgggtaggttaacgtttacgggaacgttaggttacgttttctaccgtacctaactactccgacgcccgtacccgtaagaggtaagtagtaaagttagtttaggttacgtacgttacgttttacttacgtacgaccgtaagtaacttaaagttaacgttaaacgttacgtcggtaccgttacggtaccggttaccggttaccggttacccgggaaccgggtaaacggggtaaaccgttaaagggtaaacgaaaacgtaaacggtaaaacgttacgttcggttacggtaacgtacgtaaccgtacgtacgttccgttaacgttcgttaaccg

SEQ ID NO: 395825 - DNA, 538 bp, Homo sapiens
  misc_feature: GZ8MTXP01EJHZC.21.27.C05.1.454.CMB.2.raw
  modified_base (201)..(201): a, c, t, g, unknown or other
  modified_base (268)..(268): a, c, t, g, unknown or other
  modified_base (299)..(299): a, c, t, g, unknown or other
  modified_base (374)..(374): a, c, t, g, unknown or other
  modified_base (392)..(392): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatcnggccaggcctcccaggctcctcatttaccgngcatcccaccagggcccacgtggtcgtcccagacaggttccaggtggcggtggatttgggattaagtagttttcnctcaccatcagcgcctanagagtgaagatgttgctagtttattctgccaggtactaaattattaaattactggcctgcgtcgtacgttcggccgaacgggaaccgaaaggttaggaaattacgaaaacgaacgttgttcgactgcaaccatcttgtcttctaac

SEQ ID NO: 395826 - DNA, 552 bp, Homo sapiens
  misc_feature: GZ8MTXP01CUC6H.21.27.C05.1.454.CMB.2.raw
  modified_base (378)..(378): a, c, t, g, unknown or other
  modified_base (469)..(469): a, c, t, g, unknown or other
  modified_base (484)..(484): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtggaatggattaggcagtccccgtgagaggccttgagtggcttggaaggacctagttatacgtcccagtgtatgaagactatgacagaattctgtgagcggtacgtcncacatccacccagacacgtacaagactcaggtcaccctccacctaacgtcgtctcgtccactcccgacgacgacggctagtttaattttgngaacaaggagggtancgtaacgtagttcggttgttaccttaacgtccttggacctccgttaggggcccttaaggggttaaccg

SEQ ID NO: 395827 - DNA, 572 bp, Homo sapiens
  misc_feature: GZ8MTXP01BTQKP.21.27.C05.1.454.CMB.2.raw
  modified_base (203)..(203): a, c, t, g, unknown or other
  modified_base (299)..(299): a, c, t, g, unknown or other
  modified_base (377)..(377): a, c, t, g, unknown or other
  modified_base (395)..(395): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggctcccaggctcctcatttaccgngcatcccaccgagggcccacgtggtcgtcccagacctaggttcaggtggcggtggtaatttggggctagtagttttcnctcacatcagcgccctanagagtgaagtattgttgcttagtttattctcgcctagtctaaattattaaattacgtggtacccttggccggttcggtaccggttccgggccgtaacggggaaccaaggggtacgaaacgtacgaaaacgttacgttggttcggctcggcctaccgattcgttcgttcctttaaccg

SEQ ID NO: 395828 - DNA, 519 bp, Homo sapiens
  misc_feature: GZ8MTXP01BA4QJ.21.27.C05.1.454.CMB.2.raw
  modified_base (202)..(202): a, c, t, g, unknown or other
  modified_base (299)..(299): a, c, t, g, unknown or other
  modified_base (374)..(374): a, c, t, g, unknown or other
  modified_base (498)..(498): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatcccaccagggccacgtggtcgtcccagacaggttcaggtggcggtggaatttggggaactagtagttttcnctcaccatcagcgccctacagagtgaagattgttgctagtttatttctgccagcaaatataattactggcctgcgtcgacgttcggccgaacgggacaagggtgaaagtcgaaacgacgttggnggctgcacgattctgttcttc

SEQ ID NO: 395829 - DNA, 525 bp, Homo sapiens
  misc_feature: GZ8MTXP01BFCRF.21.27.C05.1.454.CMB.2.raw
  modified_base (203)..(203): a, c, t, g, unknown or other
  modified_base (299)..(299): a, c, t, g, unknown or other
  modified_base (370)..(370): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccacctctcctgcacagccagtcagtctatcgctgactggttagcctggtaccagcagaaatctggccaggctcccaggctcctcatttaccgngcatcccaccagggccacgtggtctcccagacaggttcaggtggcggtggaatttgggctagtagttttcnctcacatcagcgccctacagagtgaaagattgttgcttagtttacttctgaccagtactaaatataattactggctgtcgtcgacgttcggccgaacgggacagggtacgaaatcgaaacgacgttggttcggctgcactagttctgttcttaac

SEQ ID NO: 395830 - DNA, 603 bp, Homo sapiens
  misc_feature: GZ8MTXP01EUD9S.21.27.C05.1.454.CMB.2.raw
  modified_base (203)..(203): a, c, t, g, unknown or other
  modified_base (299)..(299): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgtcaccctctcctgcacagccagtcagtctatcgctgactggtagcctggtaccagcagaaatctggccaggctcccaggctcctcatttaccgngcatcccaccgagggccacgtggtcgtcccagactaggttcaggtgggcggttggaagttttggggaactagggtagttttcctcgtacacctatccacgccgaccctacgagagttagaaagtattggttgacttagtttactttcgtgacctagtactaaattattaaattacgtgggtacccttggccggttccggtaccggttccgggcccgaacgggggtaaccgaaggggtacgaaacgtacgaaaacgttaaccgttggttacgggctcgctacccgtattccgtcgttccttaacc

SEQ ID NO: 395831 - DNA, 580 bp, Homo sapiens
  misc_feature: GZ8MTXP01BVOIA.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatctccggggaaaatgtcgctggcaacaatggtggaatggattaggcagtccccgtgagaggcctgagtggcttggaggacctattatacgtcccagtggtactgaagactatgactagtaattcgtgtgagcggtcgtctcaccatccacccagaccacgtaccaagaactcgacggtcctaccctaccaaccttaagtcgttctcgtccacctccccgacgacaccgggcttacgttttatttggctaacgtaaggaggtacttctaacgtagtttccgttgttaccttaaccttccgttcgtaccgtccggttcggggtaaccgttaaggggtttaacccg

SEQ ID NO: 395832 - DNA, 525 bp, Homo sapiens
  misc_feature: GZ8MTXP01CZ7U8.21.27.C05.1.454.CMB.2.raw
  modified_base (456)..(456): a, c, t, g, unknown or other
  modified_base (476)..(476): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggtggaattggattaggcagtccccgtgagagccttgagtggctggaagacctattatacgtcccagtcggtatgaagactatgcagaattctgtgagcggtcgtctcacatcacccagacacgtacaagatcagtctcctaccacctaatcgtctgtcactcccgacgacacggctagtttatttcgngcaagagggtattcgtaacntttcggttgacctaacctccttgactccgttgggccgaagggttaaccg

SEQ ID NO: 395833 - DNA, 538 bp, Homo sapiens
  misc_feature: GZ8MTXP01DG9NQ.21.27.C05.1.454.CMB.2.raw
  modified_base (470)..(470): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatctccggggaaaatgtcgctggcaacaatggtggaattggattaggcagtccccgtgagagccttgagtggcttggaaggtacctattatacgtccagtggtactgaagctatgcagaattctgtgagcggtcgtcgtcaccatcacccagacacgtacaagatcaggtctcctcacctaagtcgtactgtacactcccgacgacacggtctagttttactttgtgaacaagngggtattcgactgttcggttgaccttaacctccgttgacctccgttggggtccgaaggggtttaaccg

SEQ ID NO: 395834 - DNA, 576 bp, Homo sapiens
  misc_feature: GZ8MTXP01CCLZS.21.27.C05.1.454.CMB.2.raw
  modified_base (203)..(203): a, c, t, g, unknown or other
  modified_base (305)..(305): a, c, t, g, unknown or other
  modified_base (382)..(382): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggcctcctctactttaccgngccatcccaccgagggccacgtggtcgtcccagacacggttcaggtgggcggtggaagtttgggctagtagttttcnctcaccatcacgccgaccctacgagagtgaaagtatgttgcttagtttatttctgaccagtactaaattataaattacgtggccttggccgtccggtacggtttccgggccgtaacggggaaccgaaagggtacggaaacgttacgaaaacgaacgttggacggtctcgaactaccattcctgttccgtttaac

SEQ ID NO: 395835 - DNA, 721 bp, Homo sapiens
  misc_feature: GZ8MTXP01C5BMN.21.27.C05.1.454.CMB.2.raw
  modified_base (201)..(201): a, c, t, g, unknown or other
  modified_base (210)..(210): a, c, t, g, unknown or other
  modified_base (236)..(236): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctcgaggggggancgccacctntcctgcacagccagtcagtctatcgntgactggtagcctggtaccagcagaaatctggccaggctccccaggctcctctatttaccgtgcatcccaaccgtacgggggcccacgttgggtcgttaccccaggtaccgtagggtttccgagggttggggccggggttgggtaaacgtttttgggggaacctagggttacggttttttcctccttaccacctaattcccaacggtcccgtaccccttaacgaaggaggttaaggaaagtatttaggtttaggtaccttaagttttttaactttcgttcgggtaccctaaaggtaccttaaaaatttaacttaaactttaacgtcgggtcccttacgggtaccggttccgggtaaccgggtttccgggacccggaaaccgggggtaacccgaaaggggttaacgggaaaacttaaccgaaaacggttaaacgttgggttacgggcttacggaacctaccctagttacttcggttcctttaaccg

SEQ ID NO: 395836 - DNA, 583 bp, Homo sapiens
  misc_feature: GZ8MTXP01B874I.21.27.C05.1.454.CMB.2.raw
  modified_base (203)..(203): a, c, t, g, unknown or other
  modified_base (416)..(416): a, c, t, g, unknown or other
  modified_base (463)..(463): a, c, t, g, unknown or other
  modified_base (562)..(562): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtagcctggtaccagcagaatctggccaggcctcccgaggcctcctctactttaccgtgcctaactccccgaaccgacggggccctaacgtgggtacgtaccccaaggaccgtaagggtttcagggttgggccgggttggtaaagtttggggaactaggtacgtttttcnccgtacaccctatccgacgtccgtaccctaacgagagttagaaagtnttggttgacttagtttattcttgaccagtactaaatattaatctggactgcgtcgacgtcgcgaacggaacaggtagaaatacgaaacgcgttgcgtcngccacattcgtcttcttaacc

SEQ ID NO: 395837 - DNA, 552 bp, Homo sapiens
  misc_feature: GZ8MTXP01CUJZQ.21.27.C05.1.454.CMB.2.raw
  modified_base (358)..(358): a, c, t, g, unknown or other
  modified_base (463)..(463): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgaggccctgcagaccctttcactcacctgtgacatcgtaccggggaaaatgtcgctggcaacaatggtagaattggattaggcagtccccgtgagagccttgagtggcttggaaggactattatacgtccagtgtatgaagactaatgacagaattntgtgagcgtcgctcacatcaacccagacacgtaccaaagaatcacggtctccacaacctaagtctactagtcacctcccgacgacgacggctagtttaattttgngtaacaaaggagggtattccgaactattacgggttcttacttaaccctcctttgaacctcgttacggggcccttaaggggtttaacccg

SEQ ID NO: 395838 - DNA, 599 bp, Homo sapiens
  misc_feature: GZ8MTXP01DP0MN.21.27.C05.1.454.CMB.2.raw
  modified_base (362)..(362): a, c, t, g, unknown or other
  modified_base (495)..(495): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaatgtcgctggacaacaatggtagaattggataggcagtccccgtgagaggccttgagtggcttggaaggtactattatacgtccagtggtatgaagactatgacagtnttcgtgtagacgcggtacgtctacaccatccaaccccagacacgtaccaaaggtaactcgtacggtcctaccctaccaaccgttaatcgttctcgtaccacctcccgacgactacgcttagttttacgtttgngtaacgaaggagggtacttaccgtacgtacgttcgggttcttaccctaacctttccgttcgtacccgtccggttacggggtaaccgttaacggggtttaacccg

SEQ ID NO: 395839 - DNA, 571 bp, Homo sapiens
  misc_feature: GZ8MTXP01A973P.21.27.C05.1.454.CMB.2.raw
  modified_base (203)..(203): a, c, t, g, unknown or other
  modified_base (300)..(300): a, c, t, g, unknown or other
  modified_base (394)..(394): a, c, t, g, unknown or other
  modified_base (427)..(427): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngccatcccaccgacggggcccacgtcggtcgtccccaggactacgggttcaggtgggcgggttggtaagtttggggaactaggtacgtttttcncgtcaccatccagccgccctacagagtagaagnttgttgcttagtttattctgccagtactaaattattaaattacgtggtcctggtccgtcgtaccggttccggaccgaacggggaaccgaagggtacgaaagtacgaaacgacgttgttacggctgcacgattctcgttcttaac

SEQ ID NO: 395840 - DNA, 637 bp, Homo sapiens
  misc_feature: GZ8MTXP01DKR2D.21.27.C05.1.454.CMB.2.raw
  modified_base (205)..(205): a, c, t, g, unknown or other
  modified_base (241)..(241): a, c, t, g, unknown or other
  modified_base (251)..(251): a, c, t, g, unknown or other
  modified_base (304)..(304): a, c, t, g, unknown or other
  modified_base (380)..(380): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggggancgccaccctctcctgcacagccagtcagtctatcgntgactggtancctggtaccagcagaaatctggccaggcctcccgaggcctcctcatttaccgngcatccacgagggccacgtggtctcccagaccgtaggttcaggtggcggtggaagtttgggaactagtagttttcnctccgactagtccacgccgaccctaacgaggtacgtaggaaagtagttgttaggacttagtttactttacgtacggaccgtaaggtcctaaaagttacttaaagtttaccgtgggtaccttaggtccgttccggtaacggttccgggacccgtaacgggggtaaccttaaaggggttacggaaaacgttacgaaaaccggttaacgttcggttacgggtcttacggcctaaccgtattccgttcgttcgtttaaccg

SEQ ID NO: 395841 - DNA, 599 bp, Homo sapiens
  misc_feature: GZ8MTXP01A69F7.21.27.C05.1.454.CMB.2.raw
  modified_base (203)..(203): a, c, t, g, unknown or other
  modified_base (395)..(395): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctccccgaggcctcctctactttacccgtgccaactccccaccgacgggcccacgtggtcgtccccagacctaggttcaggtgggcggtggtaagtttggggaactaggtagttttcncgtcaccatcacgccgaccctacgagagtgaagtattgttgcttagtttattctgcagactaattaataattacgtggtcctaggtccgtcgtaccggttccggaccgtaacggggaaccgttaaggggtacggaaacgttaaccgaaaacgaacgttcgggttacggccttcggaacctacctacttcgtcgtttccttaacc

SEQ ID NO: 395842 - DNA, 645 bp, Homo sapiens
  misc_feature: GZ8MTXP01EA3FE.21.27.C05.1.454.CMB.2.raw
  modified_base (205)..(205): a, c, t, g, unknown or other
  modified_base (316)..(316): a, c, t, g, unknown or other
  modified_base (466)..(466): a, c, t, g, unknown or other
  modified_base (491)..(491): a, c, t, g, unknown or other
  modified_base (628)..(628): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacncgcccaccctctcctgcacagccagtcagtctatcgctgacttggtacgccgtggtaccagacaagaaatcgtggaccaggcctcccgaggtcctcctactactttaccgngaccactcccacgacgggcctacgtggtcgtacccagtacgtacggttcgaggtgggcggtaggtaagtttgggaactaggtttacgttttcctaccttaccaacctattacccgacgtcccgtacccctaagaagtaggtagtaaagtnttaggttagtacttagtttatttcncgtacctaagtaactaaattaattaacttacgtcgtccgtggtccgtcggtaccggttccggaccgtaaacggggtaccgaaaggggtacgaaacgtaaccggaaacgttacgttcggttacgctacgaacctaacncttcttcgttcttaacc

SEQ ID NO: 395843 - DNA, 559 bp, Homo sapiens
  misc_feature: GZ8MTXP01EKPYU.21.27.C05.1.454.CMB.2.raw
  modified_base (160)..(160): a, c, t, g, unknown or other
  modified_base (336)..(336): a, c, t, g, unknown or other
  modified_base (470)..(470): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgaggccctcgcagtaccctttcactcacctgtgacatcgtaccggggaaaatggtcgctggacaacaatggtgaattggattagcagtccccgtgagagctgagtgctggagactatatacgtccagtgtacngaagactatgacagaattctgtgagtcggtcgtctcacctataccacccagacacgtaccaaagtaatcagtcctccctacaacctaagtcgtctacgtaccacctcccgacgacacggctagtttattttcgngtcaaggagggattacgaactagttcgggttcttaccttaaccgtccttaacgactccgttcgggggaacccttaaggggtttaaccgg

SEQ ID NO: 395844 - DNA, 601 bp, Homo sapiens
  misc_feature: GZ8MTXP01BJMGS.21.27.C05.1.454.CMB.2.raw
  modified_base (204)..(204): a, c, t, g, unknown or other
  modified_base (308)..(308): a, c, t, g, unknown or other
  modified_base (403)..(403): a, c, t, g, unknown or other
  modified_base (427)..(427): a, c, t, g, unknown or other
  modified_base (585)..(585): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacncgccaccctctcctgcacagccagtcagtctatcgctgactggtagcctggtaccagcaagaaatcgtggccaggcctccccgaggcctcctctactttaccgngccactcccgaccgacgggccacgtggtcgtccccagacctacgggttcaggtcgggcgggttggtaagtttgggggaactaggttacgttttcnctacacctatcacgccgccctaangtagtagaagtatgttgacttagtttacttctcgaccagtactaaattaattaagttacgtcggtctggtccgtccggtacggttccggaccgtaacggggaaccttaaagggtacgaaataccgaaaacgttacgttggttcggctcgaaccaactnttctcgttccttaacc

SEQ ID NO: 395845 - DNA, 670 bp, Homo sapiens
  misc_feature: GZ8MTXP01AFCNM.21.27.C05.1.454.CMB.2.raw
  modified_base (203)..(203): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggcctcctcactttaccgtgcactcccaccgagggcccacgtggtcgtaccccaggtacctacgggtttcaggtcgggtcgggtggtaagttttggggaacctagggttacgtttttctccgttaccacctatccacgtcccgacccttaacgaggtagtaggaaagtagttggtttagacttagttttactttcgtacggaccctaagtacttaaattaatttaaacgtttaccgtcgggtcccttaggtccgttaccggtaaccggtttccgggacccggtaaccgggggtaaccttaaagggggttacgaaaacgttaccgaaaaacgttaccgttggttacggcctacggaacctaccgtagttccttcggttcctttaaccg

SEQ ID NO: 395846 - DNA, 575 bp, Homo sapiens
  misc_feature: GZ8MTXP01AFHMT.21.27.C05.1.454.CMB.2.raw
  modified_base (200)..(200): a, c, t, g, unknown or other
  modified_base (247)..(247): a, c, t, g, unknown or other
  modified_base (266)..(266): a, c, t, g, unknown or other
  modified_base (285)..(285): a, c, t, g, unknown or other
  modified_base (293)..(293): a, c, t, g, unknown or other
  modified_base (365)..(365): a, c, t, g, unknown or other
  modified_base (442)..(442): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttancctggtaccagcagaatcnggccaggctccagctcctnatttccgngcatccaccagggcccacgtggtctcccagacaggttccaggtggcggtggagtttgggactgtagttttcnctcacctatcagccgcctacagagtgaagattgtgctagtttacttcgtgaccaggtctaaattataaacgttacgnggtcctggccgtccgtaccggttccggacccgaacggggtaacccaaagggttacggaaaacttaccgtaaaacggaacgttggcgggaccttcggaccctaacccgtattcgttacgttccgttcgtaaccc

SEQ ID NO: 395847 - DNA, 806 bp, Homo sapiens
  misc_feature: GZ8MTXP01B6UXH.21.27.C05.1.454.CMB.2.raw
  modified_base (203)..(203): a, c, t, g, unknown or other
  modified_base (310)..(310): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcaagaaatcgtggccaggcctccccgaggtcctcctctactttaccgngccactcccaccgagggccctaacgtcggtcgtaccccgaaggaccgtacgggtttccgaggggttcggggtaccggggttaggggtaaacgtttttcggggggaacccttagggtttaacggtttttttcccgtaccctttaccgaaaccccgtattaccccgaaacggtccccggtaaccccccttaaacggacgggtaaacggttacgggtaaaacggttacggttttgggtttacggtaacccgtttaaagggttttttttaaactttccgttaccggtaaccccgtaaggttaacccttaaaatttaacgtttaaaacgtttaccggttacgggtccccgtttaggtcccggttacccggtaaccgggtttacccgggacccggtaaaccggggtaacccgttaaaggggtaacgaaaacgttaaccgaaaacggttacgttcggttacggtcgtacgaaccgtaccgtacttccgtcgtttccttaaccg

SEQ ID NO: 395848 - DNA, 513 bp, Homo sapiens
  misc_feature: GZ8MTXP01AM493.21.27.C05.1.454.CMB.2.raw
  modified_base (200)..(200): a, c, t, g, unknown or other
  modified_base (332)..(332): a, c, t, g, unknown or other
  modified_base (370)..(370): a, c, t, g, unknown or other
  modified_base (404)..(404): a, c, t, g, unknown or other
  modified_base (436)..(436): a, c, t, g, unknown or other
  modified_base (490)..(490): a, c, t, g, unknown or other
  modified_base (499)..(499): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggcctcctcatttaccgtgcatccaccgagggcccacgtggtctcccagacnggttccaggtggcggtggatttggggactgtagtttcnctcacatcagccgcctacagagtgaagtatgttnctagtttattctgccaggctaatataattacngcctgcgtcgtacgttcggccgacgggaacaaggttgaaattcgaaacgattgngctgcaacntcttgtcttctaac

SEQ ID NO: 395849 - DNA, 723 bp, Homo sapiens
  misc_feature: GZ8MTXP01B5BH7.21.27.C05.1.454.CMB.2.raw
  modified_base (203)..(203): a, c, t, g, unknown or other
  modified_base (308)..(308): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagccgtggtaccagcaagaaatctggccaggcctcccgaggcctcctctactttaccgngaccactcccgaccgacggggccctacgtcggtcgtaccccaaggaccgtacgggtttcagggtcgggacgggttgggtaaacgtttgggggaactagggttacgtttttcctacctaccgaacctagttccgacggtcccgaccccttaagaggtaaggtagtaaaggtagtttggttacgtacgttaaggtttttactttccgtacggtacccgtaaggtacttaaaattaatttaaacgtttaccggtcgggtcccttacgggtcccggttaccgggtaccggtttaccggggacccgtaaaccgggggtaaccgttaaaggggttacggaaaacttaccggaaaacggttaaccggttgggttcgggaaccttcggaacctaccgtagttccgttaacgttcctttaaccg

SEQ ID NO: 395850 - DNA, 732 bp, Homo sapiens
  misc_feature: GZ8MTXP01CGOQQ.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgcctgtgtctccgaggggggacnccgccacctctcctgacacacgccagtcagtctagtcgtctagtacgttggtacgccgtacggtaccagacaagaactcgtacggaccgacgcctccgacggtcctcctactacgtttaccgcgaccactacccgaccgacgggccctacgtcggtaccgtacccgaaggtacgtacggttcgagggtcgggtcgggttaggtaacggtttagggaacttacggtttacgttttcctacctacctaacctactaccgtacgttaccgacccgtaagtaggtaacggttaggtaaaggttagttggttacgtacgtttagttttacttcgtacgtaccgtaagtacttaaagttaacgttaacgtttacgtcggtaccgtacggtacccggttaccggtaccggttccgggaacccggtaaaccgggtaaacgttaaaggggtaaacgaaaacgtaaccgtaaacggttacgttcggttcggtaaccgtacgtaacctaccgtacgttccgttaacgttcctttaaccg

SEQ ID NO: 395851 - DNA, 745 bp, Homo sapiens
  misc_feature: GZ8MTXP01AEGQH.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccacctctcctgcacacgccagtcagtctatcgctagacgttggttacgccgtacggtaaccagacaagaaactcgtacggaccgacggccctcccgacggtcccttacccttactaacgtttacccgcgacctaacctaccccgaccgacgggccctacggtcggtacgtacccgaaggtacgtacgggttacgagggtcgggtcgggttaggtaacgtttacggggaacttaggtttacgttttcctacctactaacctactccgacgtcccgacccgtaagaggtaaggtaggaaagtagttcgttacgtacgtttagttttactttccgtacgtaccgtaagtaactaaacttaagttaaacgttacggtcggtaccgttcggtccggttaccgggtaccggttacccggggaaccggtaaaccgggggtaaaccgttaaaggggtaaacgaaaacgttaaaccggaaaaccggttacgttcgggttacggaacctacggtaacctaccgtacgttccgttcgttcccttaacg

SEQ ID NO: 395852 - DNA, 683 bp, Homo sapiens
  misc_feature: GZ8MTXP01CG6CZ.21.27.C05.1.454.CMB.2.raw
  modified_base (203)..(203): a, c, t, g, unknown or other
  modified_base (305)..(305): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcaagaaatcgtggccaggcctcccgaggcctcctctatttaccgngcatcccaccgtacgggcccacgtcggtctcccgagacgtacggttccaggtgggtcggtgggtaagtttcgggggaactagggttacgtttttcctactccaacccgtattcccgacgtcccgacccttaacgaggtaagtaggaaagtagttaggttgacttagttttattctagacccgtaagtacctaaattaacttaactttaccgtggtcccgttacggtccgggttccggttaacccggtttccgggaaccccggtaacgggggtaaacccgttaaagggggtaacggaaaacgttaaccgaaaacgggttaacgttcgggttacgggaaccttcggaaccctaccgtacgttcttaacggttcctttccc

SEQ ID NO: 395853 - DNA, 743 bp, Homo sapiens
  misc_feature: GZ8MTXP01BG5XI.21.27.C05.1.454.CMB.2.raw
  modified_base (203)..(203): a, c, t, g, unknown or other
  modified_base (240)..(240): a, c, t, g, unknown or other
  modified_base (304)..(304): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgntgactggtagcctggtaccagcagaaatctggccaggcctcccgaggctcctctactttaccgngcactcccaccgacgggcctacgtggtcgtcccagactacggttcaggtggcggtggtaagtttgggaactaggttacgtttttctaccgtcctaacccgagttcccgaacggtccgtaccccgttaacgaagggtaacggttaggtaaaaggttagtttcgggtttacgtacgtttaacggttttttaactttaccgttaccggtacctaaagggtaacccttaaaagtttaactttaaaacgtttccggtccggggtacccgtttacgggtacccggttcccgggttaaacccgggtttcccgggaccccgggtaaaccgggggtaaacccggttaaagggggtacggttaaaaacgtaacccgtaaaaacgggttaccgttaggttcgggtaacctacggaacctaaccgtattccgttaacgttccctttaaccg

SEQ ID NO: 395854 - DNA, 524 bp, Homo sapiens
  misc_feature: GZ8MTXP01BMVWF.21.27.C05.1.454.CMB.2.raw
  modified_base (203)..(203): a, c, t, g, unknown or other
  modified_base (286)..(286): a, c, t, g, unknown or other
  modified_base (295)..(295): a, c, t, g, unknown or other
  modified_base (364)..(364): a, c, t, g, unknown or other
  modified_base (384)..(384): a, c, t, g, unknown or other
  modified_base (435)..(435): a, c, t, g, unknown or other
  modified_base (496)..(496): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggcaggctccagctcnatttaccgncatccacagggccacgtggtctccagacaggttcagtggcggtggaatttgggaactagtacgttttcnctcacatcagtccgccctanagagtgaacgtattgttgcttagtttattctgcctagctaatataattacnggtcctgcgtcgacgttcgccgtaacgggaccttagggtacggaaatcgaaaacgttacgnggttacggctggcacattctcgttcttc

SEQ ID NO: 395855 - DNA, 792 bp, Homo sapiens
  misc_feature: GZ8MTXP01CAK5Z.21.27.C05.1.454.CMB.2.raw
  modified_base (200)..(200): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccacctgtctgtgtctccgagggggganccgccaccctctcctgcacagccagtcagtctatcgctgactggttagcctggtaccagcaagaaatcgtggccaggcctcccgaggtcctccgtactaacgttttacccgtgacctactaccccgaccgacgggggccctaacgttcgggtcgtacccccaaggtaccgtacgggtttcccgaagggttggggtcgggttagggtagttttacgggggaactaagggttacgtttttccctacctacaacccgtattacccgaacggcccgtacccctaacgaagggtacggtaggaaagtagttcggtttaggtaccttaaggttttactttccgtacgtacccgtaaggttaactaaaatttaacgtttaaactttaccgtcgggtacccgttaggtacccgggttaccggttaaccgggtttaccccggggaaccccggtaaaccggggggtaaaccccgtaaaagggggttaaacgggtaaaaaaccgttaacccggaaaaaaccgggttacgttacggggttcggacccttaacgggaaccctaaccgtaacttccgtttacggttaaccctttccgttaaccccg

SEQ ID NO: 395856 - DNA, 651 bp, Homo sapiens
  misc_feature: GZ8MTXP01ES50Q.21.27.C05.1.454.CMB.2.raw
  modified_base (203)..(203): a, c, t, g, unknown or other
  modified_base (239)..(239): a, c, t, g, unknown or other
  modified_base (304)..(304): a, c, t, g, unknown or other
  modified_base (384)..(384): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggtagcctggtaccagcaagaaatctggccaggcctcccgaggcctcctctatttaccgngcactccaccgagggccctacgtggtcgtcccagaccgtaggttcaggtgggcggtggtaagtttgggctagtagtttcnctacacatcacgccgtaccctagacggtagtagaagtagttggttgacttagttttacttcgtacgacctaagtactaaatttaattaaacgtttacgtcggtaccgttaggtccggtaccggtaaccggtttccgggaacccggtaaaccgggggtaaaccgttaaagggggtaacgttaaaacgtaaccgtaaaaacggttacgttgggttacggtaaccgtacgaacccgtaaccgtattaccggttcgtttccgtttaacccg

SEQ ID NO: 395857 - DNA, 551 bp, Homo sapiens
  misc_feature: GZ8MTXP01CT0PS.21.27.C05.1.454.CMB.2.raw
  modified_base (203)..(203): a, c, t, g, unknown or other
  modified_base (306)..(306): a, c, t, g, unknown or other
  modified_base (387)..(387): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcagaaatctggccaggcctccccaggcctcctctactttaccgngcactcccaccgaggggcccacgtggtctcccagactacggttcaggtggcggtggtaatttggggaactagtagttttcnctcacatcagcgccctacagagtgaagtatgttgcttagtttattctcgccagtactaaattaacttaaattacgtgggcctggccgtcgtacgttccggccgaacgggacaagggtagaaactacgaaacgacgttgttcggctcggcacgattctgttcttc

SEQ ID NO: 395858 - DNA, 681 bp, Homo sapiens
  misc_feature: GZ8MTXP01BX43X.21.27.C05.1.454.CMB.2.raw
  modified_base (201)..(201): a, c, t, g, unknown or other
  modified_base (249)..(249): a, c, t, g, unknown or other
  modified_base (435)..(435): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttancctggtaccagcagaaatctggccaggcctcccaggcctcctctatttaccgtgccatcccgacgacgggcccacgtggtctcccagacctaggttccaggtgggcggttggtaagtttggggactggttacgttttccctctaccacctatcacggccctaccctaacgaggtagtagaaaggtntttgttcgtacttaaggttttacttcgtacgcccgtaaggacttaaagttaactttaaacgttccgtcgggtcccttaggtcccgggttaccggtacccggttcccggaaccccggtaacggggtaaacccgtaaagggttacggaaaacgttaccgaaaacggttaccgttagggttcgggcccttaacggaacccctaacccggttcttaccgttaccggtttcccgtttaaccgttaaccccg

SEQ ID NO: 395859 - DNA, 620 bp, Homo sapiens
  misc_feature: GZ8MTXP01D7F0T.21.27.C05.1.454.CMB.2.raw
  modified_base (203)..(203): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggancgccaccctctcctgcacagccagtcagtctatcgctgactggtagctggtaccagcagaaatctggccaggcctcccgaggcctcctctactttaccgtgccatcccaccgacgggccacgtggtcgtcccgagactacggttcaggtggcggtgtaagttggggaactagtacgttttctctcacctatcacgcgccctacgacgatagggggggggggaatagtagttgtacttagtttatttcgtcgtacgtagtactaaattaattaattaacgtcggtccgttcgtcgttccggtaccggttccgggacccggaaccgggtaaccggttaaagggtaacggaaacgtaacgtaaaacgttaaacgttggttacggtcgtacggcctacctacgttcttcgttccgtttccg

SEQ ID NO: 395860 - DNA, 670 bp, Homo sapiens
  misc_feature: GZ8MTXP01AJTNV.21.27.C05.1.454.CMB.2.raw
  modified_base (202)..(202): a, c, t, g, unknown or other
  modified_base (303)..(303): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggcctcccgaggcctcctctactttaccgnccatcccacgtacgggcccacgtggtcgtaccccagaccgtacgggttcagggtggggcgggttggtaacgttttgggggaactagggttacgtttttctccttccgaaccattccacgcccgtacccctaacaggtagttaggaaagtatttggttagacgttagttttactttcgtagacccgtaagtacctaaatttaacttaaatttccgtcgggtccttagggtccgttaccgggtaaccggtttccgggaccccgaacgggggtaaaccgaaaggggttacggaaaacttaccggaaaaccgttaacgttgggttacgggccttacggaacctaacccgtattcctcggttcctttaaccg

SEQ ID NO: 395861 - DNA, 564 bp, Homo sapiens
  misc_feature: GZ8MTXP01BV4KT.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatctaccggggaaatgtcgctggcaacaatggtggaattggattaggcagtccccgtgagaggccttgagtggcttggaaggacctattatacgtccagtggtactgaagctatgacagaattctgtgagtcggtcgtctcaccatccacccagacacgtaccaagaactcaggtctccctacaccctaatcgtctgtcactcccgacgacacggtctagtttattttgtgaactaaggagggtacttcgactagttcggttcgttaccttaacccttcccgttcgtaccgtcccgttacgggggtcccttaacgggggttaaccg

SEQ ID NO: 395862 - DNA, 620 bp, Homo sapiens
  misc_feature: GZ8MTXP01DJSJ1.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacatggtggaattggattaggcagtccccgtgagaggccttgagtggcttggaaggacctattatacgtcccgagtggtactgaagactatgacagtaattctgtgagcggtcgtctcaccatccacccagacacgtaccaaagactctacggtcctaccctaccaacccttaaagtcgttcctcgtacccaaccttccccgaacgaccgtacgggtccttaagtttttacttttcggtcgtaaccgtaaggttacgggtacttacgaacgttcgtttaccgggttcgttaaccttaacccgttcttaaccgtaccgttccggttacgggggtccgttaacgggggtttaacccgg

SEQ ID NO: 395863 - DNA, 584 bp, Homo sapiens
  misc_feature: GZ8MTXP01AJ5T3.21.27.C05.1.454.CMB.2.raw
  modified_base (203)..(203): a, c, t, g, unknown or other
  modified_base (303)..(303): a, c, t, g, unknown or other
  modified_base (384)..(384): a, c, t, g, unknown or other
  modified_base (417)..(417): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggctcctctatttaccgngcactcccaccgagggcccacgtggtcgtcccagactacggttcaggtgggcggtggtaagtttgggctagtacgttttcnctcacatcacgcgaccctacaggagtagaagtnttgttgcttagtttattcgtgacctagtactaaattattaaacttacgtggtccttggtccgtcggtaccgttcggcccgaacggggaaccgttaaagggtacggaaacgtacgaaaacggttcgttggttcggctcgaacctacgtacttctcgttcctttaaccc

SEQ ID NO: 395864 - DNA, 565 bp, Homo sapiens
  misc_feature: GZ8MTXP01CFUFA.21.27.C05.1.454.CMB.2.raw
  modified_base (355)..(355): a, c, t, g, unknown or other
  modified_base (362)..(362): a, c, t, g, unknown or other
  modified_base (384)..(384): a, c, t, g, unknown or other
  modified_base (393)..(393): a, c, t, g, unknown or other
  modified_base (477)..(477): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtctggtccaggactggtgacggccctcgcacgtaccctttcactcacctgtgacatcgtaccggggaaatgtcgctggcaacaatggtgaattggattaggcagtcccgcgagaggccttgagtggcttggaagacctattatacgtcccagtggtatgaaagactangacagtnttctgtgagcggtcgtctcacntccacccanacacgtaccaaagatcacgtcctacccctccaacccttaagtcgtctcgtaccacctcccgacgacacggctagtttattttgngtaacaagagggtattcgaaacgtgttcgttcgttacctaacccttcgtcgtacgtcccggttaggggtcccgaaggggtttaacccg

SEQ ID NO: 395865 - DNA, 528 bp, Homo sapiens
  misc_feature: GZ8MTXP01CEWBN.21.27.C05.1.454.CMB.2.raw
  modified_base (160)..(160): a, c, t, g, unknown or other
  modified_base (353)..(353): a, c, t, g, unknown or other
  modified_base (461)..(461): a, c, t, g, unknown or other
  modified_base (467)..(467): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgaggccctgcagaccctttcactcacctgtgacatctaccgagaaaatgtcgctggcaacaatggttgaattggattaggcagtccccgtgagagccttgagtggcttggaagacctattatacgtcccagtcggtatgaagactatgcngatttctgtgagtcggtcgtctcaccatcaccccagacacgtccaaagactcagtctccctcacctaatcgtctgtccactcccgacgacacggtctagtttctttgngcaagnggatcacttagttcggacgtaacctaccttccgtgaccgttcgtcggggccgttaacgggg

SEQ ID NO: 395866 - DNA, 594 bp, Homo sapiens
  misc_feature: GZ8MTXP01DSZX1.21.27.C05.1.454.CMB.2.raw
  modified_base (352)..(352): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgactatcgtaccggggaaatgtcgctggcaacatggtggaatggattagcagtccccgtgagagctgagtggcttggagacctatatacgtccagtgtactgaagtactatgacagtntactgtagagtcgggtacgtctacacctatacccacccagaccacggtaccaagtactcgacgtcctaccctactacctaatcgtctcgtaccaccgtccgacgacctacggccttagttttaattttcgacgtaacgtaaaggaccgggtattcgtaaacgtcgtttaccgggttcttaccggttaacccttcgttaacgtacccgttcgacgggggtaacccttaagggggtttaacccg

SEQ ID NO: 395867 - DNA, 812 bp, Homo sapiens
  misc_feature: GZ8MTXP01CNPSM.21.27.C05.1.454.CMB.2.raw
  modified_base (201)..(201): a, c, t, g, unknown or other
  modified_base (215)..(215): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctccagacaccactggatgattgtgatgacgcagtctccagccacctgtctgtcgtctccggaggggggacnccgcctacctctcngacacgacgaccgtagtctagtctagtcgtcgtgtacgttggtacgcgtacggacagacaagaactcgacggaccgacgcctaccgacgtccttacctacttacgttaccgcactacctacccgacggacggtcctacggttcggtaccgtaccgaaggtacgtacggttacccggaggggttcgggtacgggttaggtaacggtttaacgggaactttaacggtttaccgttttaccacccgttaaccgaaccgtacgtaccgaccggtacccgtaaccgtaaggtaacggtacggtaagtaaacggttacgtttacggttacgttacgtttaacgttttacgttaccgtacgtaaccgttaaacggttaaactttaaagtttaacgttaacgtttaccggtcggttaccggttacggtacccgggttaacccggttaccgggttacccgggaacccgggtaaacggggtaaccggttaaacgggttaaacggttaaaaccgttaaccggtaaaaccgggttcggttacggttcggttaccgttaaccgtaccgttaaccgttacgtttccgttaccgttaaccgttccgtaaccg

SEQ ID NO: 395868 - DNA, 627 bp, Homo sapiens
  misc_feature: GZ8MTXP01CYKK4.21.27.C05.1.454.CMB.2.raw
  modified_base (299)..(299): a, c, t, g, unknown or other
  modified_base (359)..(359): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcacgaccctttcactcacctgtgacatctaccggggaaatgtcgctggacaacaatggtggaattggattaggcagtccccgtgagnggccttgagtggcttggaaggtactattatacgtcccagtggtatgaagactatgacagnttcgtgtgagcggtcgtctcaccatccacccagacacgtacaagactcaacgtcctccctaccaacccttaaagtcgttccttcgtaccacccgttaccccgaacccgtacgtaacccgggtcttaacggttttttaacgtttttcggtacgtaaccgtaaaggttaggggtacttaccgtaaacgttcgtttacgggttcttacccgttaacccgttaccgttcgaaccgttccggttacggggtaaccgttaacgggtttaaccgg

SEQ ID NO: 395869 - DNA, 843 bp, Homo sapiens
  misc_feature: GZ8MTXP01D77WR.21.27.C05.1.454.CMB.2.raw
  modified_base (206)..(206): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccaccctgtctgtgtctccgaggggggacncgccaccctctcctgcacagccagtcagtctatcgctgactggtagcctggtaccatcaagaatcgtggccaggcctccccgaggccttccctctactttaccgtcgacctactccccgaccgacgggggtcccaacggttcgggttccgtacccccgaaggtacccgttaggggttaccgtaggggttcggggtaccggggttggggttaaaaggtttttcgggggaaccttaaagggtttaacgggtttttttccctaccgttaccctaaccccgtaagttacccgaaaccggtccccggtaccccttaaaccgaacgggtaaggttaacgggtaaaaggttacgtttagggtttacggtaaccgttttaaaggtttttaacttttccgttacgggtaacccgttaaacggtaactttaaaaagtttaaacgtttaaaacgtttaaccgttcgggtcccgtttaacggtcccggttacccgggttaaaccggtttcccgggaacccggtaaaccgggggtaacccgttaaaaggggttacggttaaaacgttaaaccggaaaacggttaaaccggttggttacgggtaacctacggaaccctaccggtacttccgttaacgttccgtttaacccg

SEQ ID NO: 395870 - DNA, 540 bp, Homo sapiens
  misc_feature: GZ8MTXP01D7XBQ.21.27.C05.1.454.CMB.2.raw
  modified_base (202)..(202): a, c, t, g, unknown or other
  modified_base (238)..(238): a, c, t, g, unknown or other
  modified_base (298)..(298): a, c, t, g, unknown or other
  modified_base (357)..(357): a, c, t, g, unknown or other
  modified_base (367)..(367): a, c, t, g, unknown or other
  modified_base (384)..(384): a, c, t, g, unknown or other
  modified_base (395)..(395): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggtagcctggtaccagcagaaatctggccaggctcccaggctcctcatttaccgngcatccaccgagggccacgtggtctcccagactaggtcagtggcggtgaattgggaacngtagttttcnctcacatcagcgcctanagagtgaaagntgttgctagtttattctgccaagtctaaattactaaattactggtacccttggccgttcggacgtttccgggaccaacgggaaccgaagggtaggaaactacgaaacgttaagttgttacggctgccacattctgttcttaaccg

SEQ ID NO: 395871 - DNA, 616 bp, Homo sapiens
  misc_feature: GZ8MTXP01EX26V.21.27.C05.1.454.CMB.2.raw
  modified_base (203)..(203): a, c, t, g, unknown or other
  modified_base (309)..(309): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgtccaccctctcctgcacagccagtcagtctatcgctgactggtagcctggtaccagcagaaatcgtggccaggcctccccgaggtcctcctctactttacccgngcactcccaccgagggcccacgtggtctcccagactacggttcaggtgggcggtggtaagtttggggaactaggtagttttcctctccaccatccgagccgaccctacgagagtgaaagtattgttagcttagttttacttcgtcgtacctagtactaaattattaaacttaccgtggtaccctggtccgttcggtaccggttccgggccgtaaccggggtaaccgttaaaggggtacgaaaacgtaccgaaaacggttaacgttggttacggctggaacctacctattccgtaagtttccttaacg

SEQ ID NO: 395872 - DNA, 613 bp, Homo sapiens
  misc_feature: GZ8MTXP01DTHF5.21.27.C05.1.454.CMB.2.raw
  modified_base (362)..(362): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtctggtccaggactggtgacggccctcgcacgtccctttcactcacctgtgactatcgtaccggggaaatgtcgctggacaacagtggtggtaattggattaggcacgtcccgtgagagtctgagtgcgtggagtctatagtacgtccagtcgtatgaagtactagtgaacagtnttctaggtgacgtcggtcgtctcacactccaacccagacctacgtaccaaagtaactcgacgtcctaccctactacctaatcgtactcgtaccacgtcccgacgactacggttctacggttttatttcgtgtaacgtaaggttacgggacttactaacgtacgttaccgggttacgttacccgttaacccttcggttaaccgttccggtcccgggttacgggggtaacccgttaacgggggttttaacccg

SEQ ID NO: 395873 - DNA, 664 bp, Homo sapiens
  misc_feature: GZ8MTXP01ED3QA.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccacctgtctgtgtctccgagggggacncgccaccctctcctgcaccgccagtcagtctatcgctgactggttacgcctggtaccagacaagaaatcgtggccaggcctccccaggcctcctctactttacccgtgaccactcccaccgacgggcccacgtggtcgtcccaggactaggttccaggtggcgggtggtagtttggggaactggttacgtttttcctctacacctatcgacgcccgtccctaagaggagtagaaagtagttgttagtacttagtttacttcgtagaccctagggtaactaaatttaaattaactttacgtcggtaccgttcggaccggttaccggttaccgggttacccgggacccgggaaaccggggtaaacccggtaaaggggttacgggtaaaacttaacgaaaacgggtaacgttggttacggttcgtaacgactaacctattcgttacgtttcgttaacctcccg

SEQ ID NO: 395874 - DNA, 660 bp, Homo sapiens
  misc_feature: GZ8MTXP01BTZ57.21.27.C05.1.454.CMB.2.raw
  modified_base (204)..(204): a, c, t, g, unknown or other
  modified_base (261)..(261): a, c, t, g, unknown or other
  modified_base (305)..(305): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggtagcctggtaccngcagaaatctggccaggctccgtaggcctcctctactttaccgngcactcccaccgacggggccctacgtcgggtcgtccccgaaggtacctacgggttccagggtggggcgggtgggtaaagttttggggaactaggttacgtttttcctcgtaccaacctatccgacgtccgcccctaagaggtagtagaaagtattggttgtacttagtttactttcgtacgacctaagtactaaattaacttaaacgtttaccgtcgggtaccttcgggtaccggttccggtaaccgggtttcccggggacccggtaaaccgggggaacccgttaaagggtacgggaaactaacgaaaacgttaacgttggttacgggctgaacctaccattccgtgttcttccc

SEQ ID NO: 395875 - DNA, 505 bp, Homo sapiens
  misc_feature: GZ8MTXP01DQOQX.21.27.C05.1.454.CMB.2.raw
  modified_base (202)..(202): a, c, t, g, unknown or other
  modified_base (248)..(248): a, c, t, g, unknown or other
  modified_base (294)..(294): a, c, t, g, unknown or other
  modified_base (362)..(362): a, c, t, g, unknown or other
  modified_base (381)..(381): a, c, t, g, unknown or other
  modified_base (391)..(391): a, c, t, g, unknown or other
  modified_base (396)..(396): a, c, t, g, unknown or other
  modified_base (406)..(406): a, c, t, g, unknown or other
  modified_base (428)..(428): a, c, t, g, unknown or other
  modified_base (486)..(486): a, c, t, g, unknown or other
  modified_base (494)..(494): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccaccctgtctgtgtctccgaggggggancgccaccctctcctgcacagccagtcagtctatcgctgactggtancctgaccagcagaaatctgcaggctcccaggctcctcatttaccgngcatccacagggccacgtgtgtcccagacaggttcagtggcggtggaatttgggaactagtagtttcnctcaccatcagcgccctangatgaaagtntgtgnttagttatcngacgaagtataaatataatcgngtctgcgtcgtacgtcgcgaacggaacgaaggtagaaagtaacgaaagacgttgcgcngaacactnttctcgttctc

SEQ ID NO: 395876 - DNA, 539 bp, Homo sapiens
  misc_feature: GZ8MTXP01EXN0C.21.27.C05.1.454.CMB.2.raw
  modified_base (202)..(202): a, c, t, g, unknown or other
  modified_base (299)..(299): a, c, t, g, unknown or other
  modified_base (385)..(385): a, c, t, g, unknown or other
  modified_base (407)..(407): a, c, t, g, unknown or other
  modified_base (520)..(520): a, c, t, g, unknown or other
  modified_base (529)..(529): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaatctggccaggctcccaggctcctctatttaccgngcatccaccaggggcccacgtggtctccccagacacggtttcaggtggcggttggaaacgttttgggggaactagtagtttttccnctcaccattccagccgccctanagagtggaagattgttcgcttagtttattcgtgccgagtctaaattataattactggcctggcgtcgacgttccggccgaacgggacaagggtggaaatcgaaacgacttggngctgccacnttctgttctc

SEQ ID NO: 395877 - DNA, 529 bp, Homo sapiens
  misc_feature: GZ8MTXP01DI366.21.27.C05.1.454.CMB.2.raw
  modified_base (202)..(202): a, c, t, g, unknown or other
  modified_base (249)..(249): a, c, t, g, unknown or other
  modified_base (299)..(299): a, c, t, g, unknown or other
  modified_base (371)..(371): a, c, t, g, unknown or other
  modified_base (418)..(418): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcaccgccagtcagtctatcgctgactggttancctggtaccagcagaaatctggccaggctcccaggctcctcatttaccgngcatcccaccagggcccagtggtcgtcccagacaggttccaggtggcggtggatttgggactgtagttttcnctcaccatcagcgccctacagagtgaagattgttgctagtttattcngtccaggtctaaattataattactgcctgcgtcgtacgttcggccacgggaaccaagggttgaaacttcgaaacgacgttggttggctgacaacctatcttgtccttcaac

SEQ ID NO: 395878 - DNA, 714 bp, Homo sapiens
  misc_feature: GZ8MTXP01BA5FJ.21.27.C05.1.454.CMB.2.raw
  modified_base (203)..(203): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggacncgccaccctctcctgcacagccagtcagtctatcgctgactggtagcctggtaccagcagaaatcgtggccaggcctcccgaggtcctccctctactttaccgtgccactccccaaccgacgggccctacgtcggtcgtccccagaccgtacggttccagggttcgggcggtggtaagtttggggaactaggtacgttttcctcgtaccaaccgtatccgaacgtccgacccctaagaggtagtagaaagtgttaggttcgtacttagttttattccgtacgacctaagtaaccttaaattaacttaaacgtttccgtcgggtaccgttcgggtacccggttacccgggtaaccgggtttcccgggaaaccccggtaaccgggggtaaacccgttaaagggggtaaacgggaaaaccttaaaccgggaaaaacggttaacccgtttgggaccggggtaacccttcggaaaccctacccggtaacgtttccctaaggtttccccgttaaccg

SEQ ID NO: 395879 - DNA, 641 bp, Homo sapiens
  misc_feature: GZ8MTXP01BXRNR.21.27.C05.1.454.CMB.2.raw
  modified_base (203)..(203): a, c, t, g, unknown or other
  modified_base (269)..(269): a, c, t, g, unknown or other
  modified_base (303)..(303): a, c, t, g, unknown or other
  modified_base (393)..(393): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccacctctcctgcacagccagtcagtctatcgctgactggtacgcctggtaccagcaagaatcnggccaggctcccgaggcctcctctactttaccgngctactcccaccgagggccctacgtggtcgtcccagacgtacggttcaggtgggcgggtggtaagtttggggaactaggtacgttttccncgtaccactatcgacgccgccctaacgagtagtagaaagtagttgttgtacttagtttattcgtcgtacgtaagtactaaattaattaacgttcgtcggtccttcggtccgttccggtaccggttccgggaacccggaacgggggtaacccgttaaaggggttaacggaaaacgtaaccgtaaaacggttaacgttgggttacggtcgttcggaacctaacctacgttccgttaacgttccttaaccc

SEQ ID NO: 395880 - DNA, 558 bp, Homo sapiens
  misc_feature: GZ8MTXP01DG3YK.21.27.C05.1.454.CMB.2.raw
  modified_base (415)..(415): a, c, t, g, unknown or other
  modified_base (469)..(469): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgaccctttcactcacctgtgacatctccggggaaaatgtcgctggcaacaatggtggaattggattaggcagtccccgtgagaggccttgagtggcttggaaggacctattatacgtcccagtggtatgaaagactatgcagtaattctgtgagcggtcgtctcaccatccacccagacacgtaccaagaatcagtcnccctacacctaagtctctcgtcacctcccgacgacacggctagttttattttgngtaacaagagggtattcgaactacgttcggttgttaccttaaccttccttcgtaccgtccgttgggggtcccgaagggggtttaacccg

SEQ ID NO: 395881 - DNA, 628 bp, Homo sapiens
  misc_feature: GZ8MTXP01C380X.21.27.C05.1.454.CMB.2.raw
  modified_base (201)..(201): a, c, t, g, unknown or other
  modified_base (305)..(305): a, c, t, g, unknown or other
  modified_base (448)..(448): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgacttggttacgcctggtaccagcaagaaatctggccaggcctcccaggcctcctctatttaccgngccactcccaccgacgggcccacgtggtcgtcccagactaggttccaggtgggcggtagggagtttaggggactggttacgttttcacgtacaccatcacgccgaccctagagagtagaagtattgttgacttagtttattcngacctaaggtactaaattaactaaattaccgtcggtcccgttaggcccgtcgtaacccggttccggacccggtaaaccggggaaccgtaaaagggttacgggaaaacttaccggtaaaacggtaaccgttgggttcgacttaacgacctaacctagttccttagttcccttcgttaaccc

SEQ ID NO: 395882 - DNA, 568 bp, Homo sapiens
  misc_feature: GZ8MTXP01DPTCN.21.27.C05.1.454.CMB.2.raw
  modified_base (203)..(203): a, c, t, g, unknown or other
  modified_base (239)..(239): a, c, t, g, unknown or other
  modified_base (297)..(297): a, c, t, g, unknown or other
  modified_base (419)..(419): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacnccgccacctctcctgcacagccagtcagtctatcgntgactggtagcctggtaccagcagaaatctggccagctccaggctctctatttaccgngcactccaacgtagggcctacgtggtctcccgagacctaggttcaggtggcggttggtaagtttgggaactagtacgttttcctctacacctatcacgtccaccctagagtagtagaaagtnttgttcgacttagtttattctgacctagactaattaattaattacgcggtactggccgtcgaccggttcggaccgaacgggaacttaaagggtacgaaagtacgaaacgaacgttggttacggctgaacctacacttcgtcgttccttc

SEQ ID NO: 395883 - DNA, 515 bp, Homo sapiens
  misc_feature: GZ8MTXP01DC2ID.21.27.C05.1.454.CMB.2.raw
  modified_base (358)..(358): a, c, t, g, unknown or other
  modified_base (389)..(389): a, c, t, g, unknown or other
  modified_base (460)..(460): a, c, t, g, unknown or other
  modified_base (466)..(466): a, c, t, g, unknown or other
  modified_base (481)..(481): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggcttggaaggacctattatacgtccagtggtactgaagactatgcagnttctgtgagcggtcgtctcaccatcacccanacacgtccaagaatcagtctccctacacctaagtcgtactgtcactcccgagacacggctagtttatttgngcaagnggattcgacattcgnacgtcctctgactcgttgggtccaagggttaacg

SEQ ID NO: 395884 - DNA, 577 bp, Homo sapiens
  misc_feature: GZ8MTXP01EDWKV.21.27.C05.1.454.CMB.2.raw
  modified_base (203)..(203): a, c, t, g, unknown or other
  modified_base (249)..(249): a, c, t, g, unknown or other
  modified_base (301)..(301): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtancctggtaccagcagaaatctggccaggcctcccaggcctcctcatttaccgngcatcccacgacgggccactggtctcccagactacggttcagtggcggtggtaagtttgggctagtagttttcctctccactattccagccgaccctacgagagtaggaaagtattggttgacgttagtttactttctggacctagactaaattaagttaattacgtgtccgtgccgtcggtaccgttcgggcccgaacggggaaccgaaagggtacggaaaactaccggtaaaacgacgttggttcggcctgaacctacattctgttctttaacc

SEQ ID NO: 395885 - DNA, 721 bp, Homo sapiens
  misc_feature: GZ8MTXP01COSKL.21.27.C05.1.454.CMB.2.raw
  modified_base (200)..(200): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggcctcccagacaccactggagtgattgtgatgacgcagtctccagccacctgtctgtgtctccgagggggancgccacctctctgcacagccagtcagtctatcgctgacgtggttacgcctggtaccagacaagaaatcgtggccaggcctcccgaggtcctcctactactttacccgtgacctaactccccgaaccgacgggaccctacgtcgggtactaccccgaggaaccgtagggttcccaggttgggcggggttagggtagttttagggggaacttaagggttacgtttttcctaccttaccgaacctagttacccgaacggtccccgtaacccctaagaaggtaggttaggaaaagtagtttgggtttacgtacgtttaagtttttactttccgtacgacccgtaagtaaccttaaagtttaaacttaagttaacgttcggacccgttggtacccggttaccggtaccggttccgggacccggaacggggtaaaccgaaagggttaggaaaacttacggtaaaacgtacgttacggttcggacgtcggacctaacctaagttccttacggttcccttcttaacccg

SEQ ID NO: 395886 - DNA, 606 bp, Homo sapiens
  misc_feature: GZ8MTXP01A59MM.21.27.C05.1.454.CMB.2.raw
  modified_base (203)..(203): a, c, t, g, unknown or other
  modified_base (250)..(250): a, c, t, g, unknown or other
  modified_base (267)..(267): a, c, t, g, unknown or other
  modified_base (289)..(289): a, c, t, g, unknown or other
  modified_base (309)..(309): a, c, t, g, unknown or other
  modified_base (379)..(379): a, c, t, g, unknown or other
  modified_base (423)..(423): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtanctggaccagcagaatcnggccaggctcccgagcctcctntatttaccgccatccgaacngggcccagtggtctcccgagactaggttcaggtcggcggttgaagtttggggaactaggttacgttttcncctacacctatccgacgtccgaccctaagagtagtagaaagttnttgtgtacttagtttacttcgtcgacgtaagtaacttaaattaacgttaacgttcgtcggtaccttcggtccgttaccggtaccggttaccggaccggaacgggtaaccgaaagggtaacgaaacgtaacggaaacgttacgttcggacggtctacgaactactagttccgtcgttcttaacg

SEQ ID NO: 395887 - DNA, 814 bp, Homo sapiens
  misc_feature: GZ8MTXP01BDROP.21.27.C05.1.454.CMB.2.raw
  modified_base (203)..(203): a, c, t, g, unknown or other
  modified_base (301)..(301): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagctggtaccagcagaatctggccaggcctcccaggcctcctctactttaccgngcactcccaccgacgggcccaacgtcggtcgtccccaaggtaccgtacgggtttccagggttcggggtaccggggttgggtaaacgtttttgggggaacctagggtaacggtttttttcctccttaccgaacccctaagttcccgaacggtcccggtacccccttaacgaacgggtaacggttaggaaaacggtaagtttcgggtttagtaccgtttaaagggtttttaactttttaccgtcgggtaccccgtaaaggtaacccttaaaagtttaaacgtttaaaactttaacccgttaccggggtacccgtttcgggtacccggtttaccggggtaacccgggttttcccggggaaccccggtaaacccgggggaaacccgttaaaacgggggttaaacgggttaaaaaccgttaaacccggaaaaaaccggttaaaccggttggggttacgggaaccgttaccggtaaccaaccccggtatttacccgttcggtttaacccgtttaacccg

SEQ ID NO: 395888 - DNA, 623 bp, Homo sapiens
  misc_feature: GZ8MTXP01A0REF.21.27.C05.1.454.CMB.2.raw
  modified_base (203)..(203): a, c, t, g, unknown or other
  modified_base (239)..(239): a, c, t, g, unknown or other
  modified_base (300)..(300): a, c, t, g, unknown or other
  modified_base (381)..(381): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggttagcctggtaccagcagaaatctggccaggctcccaggctcctcatttaccgngcatcccaccgagggccacgtggtcgtcccagacaggttcaggtgggcggtggaagtttggggaactaggtacgtttttcncttcaaccctatccagccgaccccttaagagagtgaagtattgttgaccttagttttactttcgtcgacctaagtactaaattattaaacgttacgtcgggtccttcggtccggttaccggtaccggtttccgggacccgtaacggggaaacccttaaaggggttacggaaaactacgaaaacggttaacgttgggttacgggaacctggaaccaacccgtattccgttcgttcctttaacc

SEQ ID NO: 395889 - DNA, 567 bp, Homo sapiens
  misc_feature: GZ8MTXP01DQ2XD.21.27.C05.1.454.CMB.2.raw
  modified_base (415)..(415): a, c, t, g, unknown or other
  modified_base (469)..(469): a, c, t, g, unknown or other
  modified_base (475)..(475): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgtaccctttcactcacctgtgacatcgtaccggggaaaatgtcgctggcaacaatggtggaattggattaggcagtccccgtgagagccttgagtggctggaagacctattatacgtccagtggtatgaagactatgacagaattctgtgagcggtacgtctcacatccacccgagacacgtacaaagactcgagtccncctaccaccttaagtcgtctgtaccactcccgacgaccacggtcctaagttttntttcgngtaacaaggagggtattacgaacgtacgtttcggttcttaccttaacctaccgttgaccttcggttcggggtaaccgaaggggtttaacccg

SEQ ID NO: 395890 - DNA, 589 bp, Homo sapiens
  misc_feature: GZ8MTXP01A35RM.21.27.C05.1.454.CMB.2.raw
  modified_base (204)..(204): a, c, t, g, unknown or other
  modified_base (251)..(251): a, c, t, g, unknown or other
  modified_base (301)..(301): a, c, t, g, unknown or other
  modified_base (331)..(331): a, c, t, g, unknown or other
  modified_base (371)..(371): a, c, t, g, unknown or other
  modified_base (393)..(393): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctcctgcacagccagtcagtctatcgctgactggtancctggtaccagcagaaatctggccaggcctccgaggctcctcatttccgncatccacagggccacgtggtctcccagacnggttcagtggcggtggaatttgggaactggtacgttttcnctcacctatcagccgaccctanagacgtagaagtattgttgacttagttttacttctcgaccgtaagtactaaattaacttaaacttacgtcggtcctggtaccgttcggtaaccggttccggaccgaaccggggtaaccgaaagggttacggaaattaccggaaaacgttacgttggttacgggcttacggaacctacgtattcctgttaacctttc

SEQ ID NO: 395891 - DNA, 672 bp, Homo sapiens
  misc_feature: GZ8MTXP01DVHQH.21.27.C05.1.454.CMB.2.raw
  modified_base (202)..(202): a, c, t, g, unknown or other
  modified_base (307)..(307): a, c, t, g, unknown or other
  modified_base (416)..(416): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgacttggtagcctggtaccagcaagaaatcgtggccaggcctcccgaggtcctcctctactttaccgngacactcccaccgagggccctacgttcggtcgtaccccaggaccgtaggttccgagggttcgggtcggggttggtaaaggtttggggaactagggtttacgtttttccncttaccacctatccacgccgtaccctagagtagtagaagtattggttagcgttagtttattcgtcgaccgtagtactaaaattaacttaaattacgtacggtccttacggtccgttaccggtaccggtttacccgggacccggtaaaccggggtaaacccgttaaaggggtaacgttaaaacgttaaccgaaaacggttaacgttggttacgggaacttacggaacctacctagttcttaacgttccgtttaaccg

SEQ ID NO: 395892 - DNA, 666 bp, Homo sapiens
  misc_feature: GZ8MTXP01AGBK6.21.27.C05.1.454.CMB.2.raw
  modified_base (204)..(204): a, c, t, g, unknown or other
  modified_base (316)..(316): a, c, t, g, unknown or other
  modified_base (439)..(439): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggggacnccgcccaccctctcctgcacacgccagtcagtctatcgctgtacgtggtacgccgtggtaccagacaagaactcgtcggccgacggcctccgagtcctcctctacttaccgnacactccacgacgggcctacgtggtcgaccgagtacgtacggttcgaggtgggtcggtaggtaagttgggaactagttacgtttctctacactatcacgccgacctagaggtagtagtaagtnttgtacgtacgttagtttacttcgtacgtacgtagtaacttaaattaacttaacgttacgtcggtccgttcgggtcccggttacgggtaccggttacccgggacccgggtaaacggggtaaaccggttaaagggggtaaaccgttaaaacgtaaaccggtaaaacggttacgttcgggttacggtaacgtacggaacctaacccgtgttaccttcgttccttaaccg

SEQ ID NO: 395893 - DNA, 776 bp, Homo sapiens
  misc_feature: GZ8MTXP01DG7L2.21.27.C05.1.454.CMB.2.raw
  modified_base (203)..(203): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacnccgccacctctcctgacacacgccagtcacgtctacgtcgtctagtacgttgggttacgtccgtacggtaccatacgaaagtaaactcgtacggaccgacggtccctaccccgacggtcccttacccgtacgttaaccgtttacccgcgtacctaaccgtaccccgaccggtaccgggtaccctacggttcggtaccgtacccgaaggtacgtacggttacgagggttcggggtcgggtaggtaaaggtttacgggaacgttaggttttaccgttttccctactaccgtaacgtacgtccgacgtacccgtaccctaagagtaacggtagtaaagttcgttaggttacgtacgtttagttttacgttccgacgtaaccgtaagtaacttaaattaacgttaaacgttacgtcggtaccgttacggtaccggttaccggtaccggttacccgggaacccggtaaaccggggtaaaccgttaaagggtaaacgaaaacgtaaaccgaaaacggttacgttcgggttacgtcgtacgtaaccctacgtacgttaccgttccgttaaccgttaaccg

SEQ ID NO: 395894 - DNA, 612 bp, Homo sapiens
  misc_feature: GZ8MTXP01EII3S.21.27.C05.1.454.CMB.2.raw
  modified_base (203)..(203): a, c, t, g, unknown or other
  modified_base (240)..(240): a, c, t, g, unknown or other
  modified_base (273)..(273): a, c, t, g, unknown or other
  modified_base (309)..(309): a, c, t, g, unknown or other
  modified_base (399)..(399): a, c, t, g, unknown or other
  modified_base (432)..(432): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacncgcccaccctctcctgcacagccagtcagtctatcgntgactggtagcctggtaccagcaagaaactcgnggccaggcctcccgaggcctcctctactttaccgtncactcccgaccgacgggcccacgtggtcgtacccgaagacgtacggttcaggtgggcggttaggtagtttggggaactagtagttttccnctacaccatcacgccacctagagagtagaagtnttgtgtacttagtttatttcgtagaccaagtactaaattaacttaaagttacgtcggtccttaggtccgtacggtaccggttaccggaccggaacggggtaaacttaaaggggtacgttaaaacgtaccgtaaaacggttacgttgggttacgctacgccactattcgtcgttcttaacc

SEQ ID NO: 395895 - DNA, 565 bp, Homo sapiens
  misc_feature: GZ8MTXP01DQG8T.21.27.C05.1.454.CMB.2.raw
  modified_base (205)..(205): a, c, t, g, unknown or other
  modified_base (241)..(241): a, c, t, g, unknown or other
  modified_base (310)..(310): a, c, t, g, unknown or other
  modified_base (552)..(552): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacncgccaccctctcctgcacagccagtcagtctatcgntgactggttagcctggtacagcagaaatctggccagggcctccccgaggtcctccctctactttaccgngacactcccaccgcgggccacgtggtctcccagctacggtcaggtggcggtggaagtttgggctaggtacgttttctctcactatcagcctccctacagagtgaagattgtgtcttagtttattctgccagtactaaattataattaccgtggtcctaggtccgtcggtacgttccgggccgtaacgggtaaccttaggggtacgaaagtacgaacgttaacgttgttagctagctaacctnttctgttcttaac

SEQ ID NO: 395896 - DNA, 543 bp, Homo sapiens
  misc_feature: GZ8MTXP01AYC3R.21.27.C05.1.454.CMB.2.raw
  modified_base (300)..(300): a, c, t, g, unknown or other
  modified_base (406)..(406): a, c, t, g, unknown or other
  modified_base (417)..(417): a, c, t, g, unknown or other
  modified_base (456)..(456): a, c, t, g, unknown or other
  modified_base (465)..(465): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggttgaattggattaggcagtccccgtgagnggctgagtggctggaagactattatacgtccagtgtactgaagactatgacagaattctgtagagcggtcgtctcacatccacccagacacgacaagatcagtccncctacactaancgtctcgtcactcccgacgacacggtctagtttatttgngtaacaagnggtacttcgaacgtacgttcggttcacgttaacccttccgttaagtcctccggttcgggtcccgaagggtttaaccgg

SEQ ID NO: 395897 - DNA, 664 bp, Homo sapiens
  misc_feature: GZ8MTXP01BJA44.21.27.C05.1.454.CMB.2.raw
  modified_base (202)..(202): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccacccctctcctgccacagccagtcagtctatcgctgacttggttacgcctggtaccagcagaaatcgtggccaggcctcccgaggtcctcctctactttaccgtgctactcccaccgagggcccacgtcggtcgtaccccgagtacgaggttccgaggtggcggtggtagtttaggggactaaggttacgtttttcctcgtaccacctatcgacgcccacccgtagacggagtagaagtagttgttagtcttaagtttacttcgtagacctaaggtactaaattaacttaacgtttacgtcggaccttggtaccggttccggtaccggttccgggaccgtaaccgggggtaaacccgtaaaggggttacggtaaaacgttacgaaaaccggtaacgttagggttcggttaccgtaacggaccctaaccgtacttcgttacgttcctttcgtaacccg

SEQ ID NO: 395898 - DNA, 602 bp, Homo sapiens
  misc_feature: GZ8MTXP01DXQF2.21.27.C05.1.454.CMB.2.raw
  modified_base (301)..(301): a, c, t, g, unknown or other
  modified_base (550)..(550): a, c, t, g, unknown or other
  modified_base (576)..(576): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggaccgccacctctcctgcacagccagtcagtctatcgctgactggtagcctggtaccagcagaatctcggccaggcctccaggtcctcctctactttaccgngactactccgaccgcgggccctacggtcggtcgtaccgaggtaccgtacggttaccgaggttcggggcggttaggtaacgtttacgggaactagttacgttttccactaccactactcacgtcgacctagagtacgtagaagtattggttcgtacttagtttattcgtagtacaagtataaattacttaagttacgtcgtcgtacgtccggtcgtaccggttcggaccgaacgggtaacttaggggtanaaacgtacgaacgttacgttgacggntcgaacacgtattctgttcttaaccg

SEQ ID NO: 395899 - DNA, 609 bp, Homo sapiens
  misc_feature: GZ8MTXP01ENOA9.21.27.C05.1.454.CMB.2.raw
  modified_base (202)..(202): a, c, t, g, unknown or other
  modified_base (391)..(391): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatcgtggccaggcctccccgaggcctcctctatttaccgtgccactcccaccgagggcccacgtggtctccccagactaggttcaggtgggcgggtggtaagtttggggaactaggtagtttttccncttaccgacattcacgccgcccctaagagtagtagaaagtattgttgcttagtttattctgacctagtactaaattataaattacgcggtcctggtccgtcggtaaccggttccgggccggtaacggggaaccgttaaaggggtacggaaaatacgaaaacgttaacgttggttacggtaactcggaacctaccgtacttcgttcgttcctttaaccg

SEQ ID NO: 395900 - DNA, 635 bp, Homo sapiens
  misc_feature: GZ8MTXP01EG1YY.21.27.C05.1.454.CMB.2.raw
  modified_base (304)..(304): a, c, t, g, unknown or other
  modified_base (443)..(443): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggaccgccaccctctcctgcacagccagtcagtctatcgctgactggtagcctggtaccagcagaaatctggccaggcctcccgaggcctcctctactttaccgngcactccaccgacgggccacgtggtcgtcccagaccacggtttcaggtcgggcggttggtaagtttggggaactaggttacgttttcctactaccaacctattccgagcccgtaccctaacgaggacgttagaaaagtnttggtcgtacttaaggttttacttcgtacgacctaagtactaaattaacttaaactttacgcggtccttggaccgtcggtaaccgttcgggacccggtaacggggtaccgaaagggtagaaacgttaaccgaaacgttaaccgttggttacgggtcctacggaacctaccctatttccgtcgttctttaacc

SEQ ID NO: 395901 - DNA, 662 bp, Homo sapiens
  misc_feature: GZ8MTXP01BN2T0.21.27.C05.1.454.CMB.2.raw
  modified_base (203)..(203): a, c, t, g, unknown or other
  modified_base (239)..(239): a, c, t, g, unknown or other
  modified_base (250)..(250): a, c, t, g, unknown or other
  modified_base (300)..(300): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggttancctggtaccagcagaaatctggccaggctcccaggctcctcatttaccgnctatcccaccgagggccacgtggtctacccgagacaggttcaggtggcggtggtaaagtttggggaactaggttacgtttttccaccttacaaccctatcccaagtcccgtccccttaaacgaggtaaggtagaaagtagttggttcgacgttaagttttactttacgttggaccctaagtacttaaattaactttaaagtttacctcgggtccttacgggtccgttaccgggtaaccggtttcccgggaccggtaaccgggggtaacccttaaaggggtacgggaaaacttaccggaaaacggttaacggttgttacgggtaacctcgaacctaccgagttccttaacgttctttaacccg

SEQ ID NO: 395902 - DNA, 659 bp, Homo sapiens
  misc_feature: GZ8MTXP01B5A00.21.27.C05.1.454.CMB.2.raw
  modified_base (201)..(201): a, c, t, g, unknown or other
  modified_base (302)..(302): a, c, t, g, unknown or other
  modified_base (387)..(387): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgacttggttacgcctggtaccagcagaaatctggccaggctcccaggcctcctcatttaccgngccactcccaccgagggcccacgtggtcgtcccagacgtaggttcccaggtggcggtggtagtttagggactggtagtttttccncgttccacctatccacgtccgtccctacgaggtagtagaagtagttggttagtacgttagttttacttcgtacgtacccaggtacttaaattaattaactttacgtggtacccgtggtacccggttcggtacccggttaccggacccggtaaccggggaaacccgtaaagggttacgggtaaaacttaccgaaaacggtaacgttcgggttacgggaccttaacgggccctaaaccgtcgttacttacggtttccgtttaaccgttaacccg

SEQ ID NO: 395903 - DNA, 528 bp, Homo sapiens
  misc_feature: GZ8MTXP01DJX0Z.21.27.C05.1.454.CMB.2.raw
  modified_base (359)..(359): a, c, t, g, unknown or other
  modified_base (464)..(464): a, c, t, g, unknown or other
  modified_base (519)..(519): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccgggggaaaatgtcgctggcaacaatggttggaattggattaggcagtccccgtgagaggccttgagtggcttggaaggacctattatacgtcccagtggtatgaagactatgcagnttctgtgagcggtcgtctcaccatcaccccagacacgtccaagaatcaggtctccctccacctaagtgtctgtcactcccgacgacacggctagtttattttcgngtcaagagggattcgacattcggttgactaacctccttgactccgttggggtccngggtaaccg

SEQ ID NO: 395904 - DNA, 610 bp, Homo sapiens
  misc_feature: GZ8MTXP01D1SCJ.21.27.C05.1.454.CMB.2.raw
  modified_base (203)..(203): a, c, t, g, unknown or other
  modified_base (270)..(270): a, c, t, g, unknown or other
  modified_base (302)..(302): a, c, t, g, unknown or other
  modified_base (380)..(380): a, c, t, g, unknown or other
  modified_base (413)..(413): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgacttggtagcctggtaccagcagaatcnggccaggctcccaggcctcctctatttaccgngaccatcccaccgagggccacgtggtctcccagactacggttcaggtggcggtggaagtttgggaactagtgttttcnctcaccatcacgccgccctagagagtgaaagtnttggttgcttagtttatttacgtcgtacctaagtactaaattaacttaaacgttactcggtccgttaggtccggttccgtacgggtttcccggccggaacgggtaaccggaaaggggtaacggaaacgttaaacgaaaacggttaacgttcggttacgggccttaggaacctaccgtattcttcggttccgttaacc

SEQ ID NO: 395905 - DNA, 579 bp, Homo sapiens
  misc_feature: GZ8MTXP01AY19F.21.27.C05.1.454.CMB.2.raw
  modified_base (204)..(204): a, c, t, g, unknown or other
  modified_base (241)..(241): a, c, t, g, unknown or other
  modified_base (559)..(559): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctcctgcacagccagtcagtctatcgntgactggtagcctggtaccagcagaaatctggccaggcctcccgaggcctcctctactttacccgtgccactcccaccgacgggcccacgtggtcgtcccgagaccgtacggttccaggtgggcggtgggtaagttttggggaactaggtacgtttttcctcctcaacctatccagccgtaccctacgagtagtagaagtattgttgacttagtttattctgccgtagtactaaatattaattacgtggtcctgcgtcgtacggttcggccgaacgggaccaagggtacgaaagtacgaaacgttacgttggttcggntcgcaccattctcgttcttc

SEQ ID NO: 395906 - DNA, 680 bp, Homo sapiens
  misc_feature: GZ8MTXP01EJOB7.21.27.C05.1.454.CMB.2.raw
  modified_base (202)..(202): a, c, t, g, unknown or other
  modified_base (311)..(311): a, c, t, g, unknown or other
  modified_base (403)..(403): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtcgtccgagggggganccgccaccctctcctgccacagccagtcagtctatcgctgactggttacgccgtggtaccagcaagaatcgtggtcaggccctccgaggtccttcctctactttaccgngcactcccacgacgggcccacgttcggtacgtcccgagacgtacggttccaggtgggtcggtaggtacgtttgggactggttacgttttccnctaccacatcacgtcccgacctaacgaggacgtagaaagtacgttggttacgtacgttagtttattcgtacgacctaagggtaactaaatttaacgttaacgttacgtccgtcgttacggtacccgttcggtaccggttaccggacccggtaaccgggggtaaaaccctaaggggttaaacggtaaaacgttaccgtaaaaaaccggtcggttacggttcggttacgtaacggtacctaacctacgttccgttacgttcctttaaccggttaacccg

SEQ ID NO: 395907 - DNA, 612 bp, Homo sapiens
  misc_feature: GZ8MTXP01D3M84.21.27.C05.1.454.CMB.2.raw
  modified_base (203)..(203): a, c, t, g, unknown or other
  modified_base (307)..(307): a, c, t, g, unknown or other
  modified_base (383)..(383): a, c, t, g, unknown or other
  modified_base (408)..(408): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacnccgccaccctctcctgcacagccagtcagtctatcgctgacttggtagcctggtaccagcaagaaatctggccaggcctcccgaggcctcctctactttaccgngcactcccaaccgagggccacgtggtctcccagactaggttcaggtggcggtggaagtttgggctagtagttttcncgtacaccgatcacgcgtaccctanagagtagaagtattgttgcttagtttacttcgtcgtaccaagtactaaatttaagttaaaacttcgtcggtccctggtaccggttccgtacggtttccggaccgtaaaccggggaaccgttaaaggggttaagaaaacgttacgaaaaaccggacgttgttacgggtctacggcctaaactcttacgttcgttccgtttaaccg

SEQ ID NO: 395908 - DNA, 687 bp, Homo sapiens
  misc_feature: GZ8MTXP01DVHXZ.21.27.C05.1.454.CMB.2.raw
  modified_base (300)..(300): a, c, t, g, unknown or other
  modified_base (361)..(361): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaaatgtcgctggacaacaatggtggaattggattaggcagtccccgngagagcctgagtggcttggaagacctattatacgtccagtggtatgaagactatgacagtnttcgtgtgagcggtcgtcgtcaccatccacccagacacgtaccaaagaatcaggtcctccctaccaaccttaagtcgttccgttagtaccctaccgttacccccggaacgtaacccgtaaccgggggttacccttaaggttttttaacgttttttacgggtcgggtaaacccgtaaacgggttagggggtaaacctttacctaaaccgttacggttttaccgggttccggttaaaccctttaacccctttacccgtttaacggttaaccccgttcccgggttaacggggggtaaccccgttaaacggggggtttttaaacccccgg

SEQ ID NO: 395909 - DNA, 609 bp, Homo sapiens
  misc_feature: GZ8MTXP01B9WEP.21.27.C05.1.454.CMB.2.raw
  modified_base (203)..(203): a, c, t, g, unknown or other
  modified_base (299)..(299): a, c, t, g, unknown or other
  modified_base (383)..(383): a, c, t, g, unknown or other
  modified_base (405)..(405): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtagcctggtaccagcagaatctggccaggctcccaggctcctcatttaccgngccatcccaccgagggcccacgtggtctccccagaccgtaggttcaggtggcggtggtaagtttggggaactagtacgttttcnctcacctatcacgccgccctanacgagtagaagtattgttgacttagttttaactttctcggccaagtactaaattattaaattaccgtcggccttaggccgttcgtaccggtttccgggacccgtaacggggacccttaaaggggtacggaaaacgttaaccgaaaacggttaaccgttggttacggtcgtacgaaccaaccgtacttcttcgttcctttaaccg

SEQ ID NO: 395910 - DNA, 546 bp, Homo sapiens
  misc_feature: GZ8MTXP01AJP9C.21.27.C05.1.454.CMB.2.raw
  modified_base (203)..(203): a, c, t, g, unknown or other
  modified_base (300)..(300): a, c, t, g, unknown or other
  modified_base (401)..(401): a, c, t, g, unknown or other
  modified_base (412)..(412): a, c, t, g, unknown or other
  modified_base (416)..(416): a, c, t, g, unknown or other
  modified_base (429)..(429): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatcccacgtacgggccacgtggtcgtcccagtacacggttcaggtgggcggtggaagtttggggaactagtagttttctctcaccatcagcgaccctanagagtgaaagntgtncttagtttattcngccagtctaatataattacgtgactgcgtcgtacgttcggccgaacgggacaagggtacgaaagtacgaaacgttacgttggttacggctcggcaccgtattctaacgttcttaacg

SEQ ID NO: 395911 - DNA, 601 bp, Homo sapiens
  misc_feature: GZ8MTXP01CIKUU.21.27.C05.1.454.CMB.2.raw
  modified_base (517)..(517): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcacgtaccctttcactcacctgtgacatcgtaccggggaaatgtcgctggacaacatggtgaattggattaggcagtccccgtgagaggcctgagtggcttggaagactattatacgtccagtggtatgaagactatgacagtaattctgtgaggtcggtacgtctacaccgactaccaccctagaccgacgtaccaaacgactcgacggttcctacctaccactaagtcgtactcgtaccactcccgacgaccgacggtcttagtttattttgtgaacgtaacggagggtacttacgtaacgtntttaccgggttcttacccttaaccgttccttaacggtaaccgtcccggttacgggggtaacccgttaacggggttttaacccgg

SEQ ID NO: 395912 - DNA, 568 bp, Homo sapiens
  misc_feature: GZ8MTXP01CRLHO.21.27.C05.1.454.CMB.2.raw
  modified_base (223)..(223): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttnactcacctgtgacatcgtaccggggaaaatgtcgctggacaacaagtggtaggaattggattaggcagtccccgtgagaggccttgagtggctggaagactattatacgtccagtggtactagaaagactatgacagaattcgtgtagagcggtcgtcgtcaccatccacccagaccacgtaccaaagaatcacggtcctaccctaccaacctaagtcgtctgtccactcccgacgacacggtctagtttatttcgtgctaaggaggtacttcgtaacgtacgtttcggttcacccttaacctccgttgtaccgtcggttacggggtccttaaggggttaacccg

SEQ ID NO: 395913 - DNA, 719 bp, Homo sapiens
  misc_feature: GZ8MTXP01EG745.21.27.C05.1.454.CMB.2.raw
  modified_base (214)..(214): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggcccgccacctctcngcacagccagtcagtctatcgctgacttggtacgccgtaggtaccagacaagaactcgtcggaccacggcctcccgaggtcctccctactacgtttaccgcactactcccgaccgacgggccctacggttcggtccgtacccgaaggtaccgtaccgggttacgagggttcggggtacggggttaggttaaacggttttacggggaacgttaggtttaccgtttttaccacccgttaccaaccgtactaccgaccgtcccgtaccccgtaagaacggtaaggtaagaaagtacgttggttacgtacgtttagttttaacttcgtacgtacgtaagtaacttaaattaattaacgttcgtcgtaccgtacggtaccgttcggtaccggttccgggacccggtaacggggtaaccgttaaagggtaaacggttaaacgtaacggaaacgttacgttcggttacggtcctacgtaacctaaccgtagttccgtttcgttccgttaacg

SEQ ID NO: 395914 - DNA, 664 bp, Homo sapiens
  misc_feature: GZ8MTXP01CW2QQ.21.27.C05.1.454.CMB.2.raw
  modified_base (203)..(203): a, c, t, g, unknown or other
  modified_base (241)..(241): a, c, t, g, unknown or other
  modified_base (301)..(301): a, c, t, g, unknown or other
  modified_base (387)..(387): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgcccaccctctcctgcacagccagtcagtctatcgntgactggtagctggtaccagcagaatctgccaggctcccgagcctcctctactttaccgngcactcccaccgacgggccacgtggtcgtacccgagacgtacggttcgaggtgggcggtggtaagtttgggaactagtagttttcnctcacatcacgccgtaccctagagagtagaagtagttgttgacgttagtttattcgtacgaccgtagtactaaattaattaaacttacgtggtccgttacggtccggttaccggtaaccgggtttcccgggaaccccgggtaaaccgggggtaaacccgttaaagggggtaaacggttaaaacgtaaacccggtaaaacggttaaaccggttgggttacgggtaacccgttacggaacccgtaacccctagttccctttcggtttccgtttaacccg

SEQ ID NO: 395915 - DNA, 663 bp, Homo sapiens
  misc_feature: GZ8MTXP01AEDZI.21.27.C05.1.454.CMB.2.raw
  modified_base (201)..(201): a, c, t, g, unknown or other
  modified_base (306)..(306): a, c, t, g, unknown or other
  modified_base (388)..(388): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggccttccctctactttacccgngccactcccaccgaggggcccacgtggtcgtccccagactaggttcccaggtgggcggtggagtttgggactgtagttttcnctcacctatcacgccgacctacagtagtagaagtattgttacgtacgttagttttactttcgtacgacctaagggtactaaatttaattaaacgtttacgtcgggtcccttagggtcccggttaccggtacccggtttccggggaccccgtaaccgggggtaacccgaaaggggttacgggaaaaacgttaaccggaaaaaccggtaaccggttgggttcggttaccgtcggacctaacccctagttcccttacgttccctttaacgtaaccccg

SEQ ID NO: 395916 - DNA, 610 bp, Homo sapiens
  misc_feature: GZ8MTXP01DJMO2.21.27.C05.1.454.CMB.2.raw
  modified_base (203)..(203): a, c, t, g, unknown or other
  modified_base (304)..(304): a, c, t, g, unknown or other
  modified_base (388)..(388): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctcccgaggcctcctctactttaccgngacactcccaccgacgggccacgtggtcgtcccagactacggttcaggtggcggtggtaagtttgggaactaggtacgttttcnctacacctatcacgccgaccctaacgagagtagaagtattgttgacttagtttattcgtcgaccgtaagtactaaattaattaaagtttacgtcggtccgttaggtccgttccggtaccggttccgggacccgaacggggaaccgttaaaggggtacgaaagtaccgaaacggttaacgttggttacggcttacgcctacgtacgttcgtcgttcttaaccg

SEQ ID NO: 395917 - DNA, 627 bp, Homo sapiens
  misc_feature: GZ8MTXP01E5CPH.21.27.C05.1.454.CMB.2.raw
  modified_base (319)..(319): a, c, t, g, unknown or other
  modified_base (345)..(345): a, c, t, g, unknown or other
  modified_base (361)..(361): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccgggggaaaatgtcgctggacaacaagtggttaggaattggattaggctacgtccccgtgagaggcctgagtggntggaagactatatacgtccagtgtangaagactatgacagtnttcgtgtcgagcggtcgtactcgaccatccaacccagaccacgtaccaaagactcagtcctaccactacctaagtgtctcgtaccaccgtcccgacgaaccgtacggtcttaacgttttagttttcggaggtaaccgtaaagggacgggtaacttccgaaaccgttacgtttccggggttacttaaccccgtttaacccttccccgtttaacggacccgttcccgggttacggggggtaaccccgttaagggggtttaaaccccgg

SEQ ID NO: 395918 - DNA, 628 bp, Homo sapiens
  misc_feature: GZ8MTXP01B3AF3.21.27.C05.1.454.CMB.2.raw
  modified_base (389)..(389): a, c, t, g, unknown or other
  modified_base (515)..(515): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtgtcctgtcacagatacaaactacagcagtctggtccaggactggtgacggccctcgctacgtaccctttcactcacctgtgacatcgtacgggaaatgtcgctgcaacaagtggtaggaattggagttaggctacgtccccgtgagacggtccgttgagtggcgttagggaaaggtaccttagttactaccgtcccgtagtcggtataggaaagtactagtgaactagtnttcgtgtgacgtcggtctctccacgactacccacccagaccacgtaccaaagactcgacgtccctaccctccaacctaacgtcgtctcgtacaccgtccgacgacgtacgtcttagtttagtttgngtaacgaaggttagggtacttcgtaacgttacgttcgggttacttaccgttaacccttccgttcgtaacccgttccggttccgggggtaaccgttaacggggtttaaccccgg

SEQ ID NO: 395919 - DNA, 654 bp, Homo sapiens
  misc_feature: GZ8MTXP01AKTL8.21.27.C05.1.454.CMB.2.raw
  modified_base (201)..(201): a, c, t, g, unknown or other
  modified_base (302)..(302): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttacgcctggtacagcagaaatctggccaggctcccgaggcctcctctactttaccgngcactcccaccgagggcccacgtggtcgtcccagacgtaggttccaggtggcgggtggagtttagggaactggtacgttttctctacaccatcgacgcccgccctagagagtgaaagtattgttgtacttagtttacttcgtacgtccctaagggtaacctaaattaacttaaacgtttacgtcgggtcccttacggtccggttaccggtaccgggttacccggaccccggtaaaccgggggaaccgtaaaggggttacgggaaaaacttaccggtaaaaacggtaaccgttgggttcgggacttaacggacctaaccgtacttccgttacggtttcccttcgttaaccccg

SEQ ID NO: 395920 - DNA, 557 bp, Homo sapiens
  misc_feature: GZ8MTXP01EMGGD.21.27.C05.1.454.CMB.2.raw
  modified_base (202)..(202): a, c, t, g, unknown or other
  modified_base (377)..(377): a, c, t, g, unknown or other
  modified_base (412)..(412): a, c, t, g, unknown or other
  modified_base (545)..(545): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgatttgtgatgacgcagtctccagccaccctgtctgtgtctccgagggggancgccaccctctcctgcacagccagtcagtctatcgctgactggtagcctggtaccagcagaaatctggccaggctcccaggctcctcactttaccgtgcatcccacgacgggccacgtggtcgtcccagacaggttcaggtcggcggtggtaatttggggaactagtagttttcnctcaccgtatcagcgacctacgagagttgaaagtnttgtgcttagtttattcgtgacgagtactaaattaattaacttacgtgtcttgtcgtcgtacggtcggaccgaacgggtaacgaagggtacgaaacgtaacgaaacgttagttcggttacgctgaacctactnttcttcgttctc

SEQ ID NO: 395921 - DNA, 609 bp, Homo sapiens
  misc_feature: GZ8MTXP01EBMC8.21.27.C05.1.454.CMB.2.raw
  modified_base (318)..(318): a, c, t, g, unknown or other
  modified_base (367)..(367): a, c, t, g, unknown or other
  modified_base (412)..(412): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaaatgtcgctggacaacaagtggtggaatggataggcacgtccccgtgagaggtccttgagtggngttggaaggtactattatacgtcctagtgtactgaagactatgacagtnttcgtgtgagtcggtcgtctcacactacacccagacacgtacaanactcgacgtccctcctacctacctaacgttctactctaccaccgtacccgacgacgtacggtacttagttttatttcgtgtaacgtaaggttacgggtacttacgtaacgttgttacgggttcgttaacccttcccttaccgttaacgttccggtcccggttacggggtaacccgggttaacggggttttaacccgg

SEQ ID NO: 395922 - DNA, 611 bp, Homo sapiens
  misc_feature: GZ8MTXP01BV7BD.21.27.C05.1.454.CMB.2.raw
  modified_base (250)..(250): a, c, t, g, unknown or other
  modified_base (301)..(301): a, c, t, g, unknown or other
  modified_base (376)..(376): a, c, t, g, unknown or other
  modified_base (382)..(382): a, c, t, g, unknown or other
  modified_base (407)..(407): a, c, t, g, unknown or other
  modified_base (414)..(414): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggaccgccaccctctcctgcacagccagtcagtctatcgctgactggtanctggtaccagcagaatctggccaggctcccgaggcctcctctatttaccgngacactcccacgagggccacgtggtctccagacgtacggttcaggtggcggtggaagtttgggctagtagtttcnctcacntcacgcgcctagagagtagaaagtnttggttnacgttagtttatttcgtacgtaccgtaagtactaaattaattaaacgttaacgtcgggtccttacggtccggttaccggtaaccggtttccgggacccggtaaacggggaacccgttaaaggggtaacgaaaacgtaccgaaaacgttaaccgttggacggtaactcgaacctactattccgttaacgttcttaacc

SEQ ID NO: 395923 - DNA, 585 bp, Homo sapiens
  misc_feature: GZ8MTXP01DMXG4.21.27.C05.1.454.CMB.2.raw
  modified_base (358)..(358): a, c, t, g, unknown or other
tcagtcgtcgctcgcacgaccggtgctcgatttagacgcgatcgaagggtttggggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgacggccctcgcacgtaccctttcactcacctgtgacatcgtacgggaaatgtcgctggcaacaatggtggaattggattaggcagtccccgtgagagcctgagtggctggaagacctattatacgtccagtgtactgaagactatgacagtnttctgtgagcggtcgtctcaccataccacccagaccacgtaccaaagatacgacgtcctcccctaccaaccttaaagtcgttacctcgtaccaccttccccgacgaccgaccggtacctagttttattttcgagtaacaaggagggacttcgaactcgtttacggttcttaccttaaccttccgttcgtacccgtccgttacgggggtccttaaggggtttaacccg

SEQ ID NO: 395924 - DNA, 593 bp, Homo sapiens
  misc_feature: GZ8MTXP01AO9H8.21.27.C05.1.454.CMB.2.raw
  modified_base (204)..(204): a, c, t, g, unknown or other
  modified_base (251)..(251): a, c, t, g, unknown or other
  modified_base (306)..(306): a, c, t, g, unknown or other
  modified_base (390)..(390): a, c, t, g, unknown or other
  modified_base (423)..(423): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggtancctggtaccagcagaaatcgtggccaggcctcccgaggcctcctctatttaccgncactcccacgacgggccacgtggtctcccagaccgtaggttcaggtgggtcggtggtaagtttggggaactaggtacgttttcnctacacatcagccgaccctagagagtagaagtnttgtgacttagttttattcgtcgacctagtactaaattattaaacttcgtcggcctggtccggtcggtaccggttccgggaccgtaaccggggaaccttaagggtaacgaaacgtaaccgaaacgttacgttggttcggctcgaacctaccgattcctcgttccttaacc

SEQ ID NO: 395925 - DNA, 629 bp, Homo sapiens
  misc_feature: GZ8MTXP01BI7JW.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacatggtggaatggattaggcagtccccgtgagaggcttgagtggcttggagacctattatacgtccagtgtatgaagctatgacagtaattctgtgagtcggtacgtctcgaccatccaaccccgagaaccaccggttaccaaaggtaactccgaacggtccctacccgtaccaccgttaaatcgttactcgtacacctcccgacaccgacggtctaggttttacttttgcgtaacgtaaaggaggggtacttaccgtaactaacggttttaccgggttacgttacccgtttaacccgttaccgtttcgggaacccgtttcccggttacggggggtaacccgttaacgggggtttaaacccggg

SEQ ID NO: 395926 - DNA, 617 bp, Homo sapiens
  misc_feature: GZ8MTXP01AO6B9.21.27.C05.1.454.CMB.2.raw
  modified_base (203)..(203): a, c, t, g, unknown or other
  modified_base (241)..(241): a, c, t, g, unknown or other
  modified_base (271)..(271): a, c, t, g, unknown or other
  modified_base (309)..(309): a, c, t, g, unknown or other
  modified_base (404)..(404): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccacctgtctgtgtctccgagggggggacnccgccaccctctcctgcacacgccagtcagtctatcgntgacttggtacgcctggacagcagaatcgnggaccacggcctcccgaggtcctcctctactttaccgngaccactcccaccgacgggcccacgtggtcgtacccagtacgtacggttcagggtcgggcggttaggtaagtttgggaactaggttacgttttcnctaccaccatcgacgccgtaccctaacgaggtagtagaagtagttcgttagtacgttagttttattcgtcgaccgtaagtactaaattaattaacgttacgtcggtccgtcggccgttccggtaccggttcgggacccgaacgggacgttaagggtacgaaacgtacgaaacgttacgttggttacgctgaaccactacttcgtcgttcctcg

SEQ ID NO: 395927 - DNA, 702 bp, Homo sapiens
  misc_feature: GZ8MTXP01CVW8X.21.27.C05.1.454.CMB.2.raw
  modified_base (203)..(203): a, c, t, g, unknown or other
  modified_base (403)..(403): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgcccaccctctcctgcacagccagtcagtctatcgctgactggtagcctggtaccagcagaatctggccaggcctcccgaggcctcctctactttaccgtgacctactcccaccgacgggccctacgtggtcgtacccgagtaccgtacgggttcaggtggcgggtaggtaagtttggggaactaggttacgttttcnctacacctataccacgccgtccctaacgaggtacgtaggaaagtgttgttacgtcgttagttttctttacgtcgaccgtaagtacttaaattacgttaaacgttacgtcggtaccttacggtccggttaccggtaccggtttacccgggacccggtaaaccgggggtaacccgttaaagggggttaaccggaaaacgttaaacccgaaaacgggttaaccggttcgggttaccgggtaacccgttacgggaacccgttaacctacgtttacccgtttcggttaacccgttttaaccccg

SEQ ID NO: 395928 - DNA, 671 bp, Homo sapiens
  misc_feature: GZ8MTXP01CAX20.21.27.C05.1.454.CMB.2.raw
  modified_base (203)..(203): a, c, t, g, unknown or other
  modified_base (250)..(250): a, c, t, g, unknown or other
  modified_base (306)..(306): a, c, t, g, unknown or other
  modified_base (390)..(390): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtancctggtaccagcagaaatcgtcggccaggcctcccgagcctcctctactttaccgngcactcccaccgagggccaggtcggtcgtccagacgtacggttcaggtcgggcggtggaagtttgggaactaggtacgttttcnctaccgactatcagccgaccctagagtagtagaagtatgttgacttagttttattcgacgtacctaagtacttaaattaattaaacgtttaccgtgggtacccgtttagggcccggtttaccgggtaaccgggtttcccgggaaccccgggtaaacgggggtaaaccccgttaaaagggggtaacgggttaaaacttaaacccggaaaacggttaaacccggttgggttcggtaacccgtggtaaccctaaccctagttaccgttccgtttccgtttcccg

SEQ ID NO: 395929 - DNA, 598 bp, Homo sapiens
  misc_feature: GZ8MTXP01CQMY6.21.27.C05.1.454.CMB.2.raw
  modified_base (368)..(368): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaatgtcgctggacaacaagtggttaggaagttggagttaggcagtccccgtgagaggccttgagtggcgttggaaggtactattatacgtccagtggtatagaagactatgacagtnttctgtgaggtcggtcgtctacacctataccaacccctagaccacgtacaaagtaactcgacgttcctccctaccacctagtcgtctacgtaccacctcccgaacgacgtaacggtcttagtttactttcgtgaacgtaaggaggtacttcgtaactgttaccgttcgttaaccttcccgttaccgttcgtaccgtccggttacggggtaaccgttaagggtttaacccg

SEQ ID NO: 395930 - DNA, 600 bp, Homo sapiens
  misc_feature: GZ8MTXP01BGDHB.21.27.C05.1.454.CMB.2.raw
  modified_base (200)..(200): a, c, t, g, unknown or other
  modified_base (209)..(209): a, c, t, g, unknown or other
  modified_base (451)..(451): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctcgagggggancgccacctntcctgcacagccagtcagtctatcgctgactgttagctgtacagcagaatctggccaggcctcccgaggcctcctctactttccgtgcactccaccgacgggccacgtggtcgtcccagacgtacggttcaggtcgggcgggtggtaagtttggggaactaggtacgttttctccgtacaccattccgacgtcccggacccctaagaggtagtagaaagtagttggttagtcgttaagtttnttacgtcgacctagtactaaattaattaacttacgtcggtcctggtccgttccggtacgttccggccggaacgggtaaccgaaagggttacgaaacgtacgaaaacgttacgttggttacgggctagccaccgtattctcgttcttccg

SEQ ID NO: 395931 - DNA, 632 bp, Homo sapiens
  misc_feature: GZ8MTXP01CTNHW.21.27.C05.1.454.CMB.2.raw
  modified_base (201)..(201): a, c, t, g, unknown or other
  modified_base (301)..(301): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggcctcccaggctcctctatttaccgngcactcccaccgaggcccacgtggtcgtcccagactaggttccaggtgggcggtggtagtttaggggactggtagtttttcctcttacacctatcacgtccgaccctacgagtagtagaagtattgttgcttagtttattctgccaggtactaaattattaacttacgtggacccgttggtaccgtcggtaccggttccgggacccgaacgggggtaacccgtaaaggggttacggtaaaacgttaccgtaaaaacggtacgttagggttcgggaccgttaaggacccgtaacctaacgttccgttaccgttcctttaaccgttaaccccg

SEQ ID NO: 395932 - DNA, 634 bp, Homo sapiens
  misc_feature: GZ8MTXP01DB8QG.21.27.C05.1.454.CMB.2.raw
  modified_base (206)..(206): a, c, t, g, unknown or other
  modified_base (243)..(243): a, c, t, g, unknown or other
  modified_base (253)..(253): a, c, t, g, unknown or other
  modified_base (311)..(311): a, c, t, g, unknown or other
  modified_base (394)..(394): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggggacnccgccaccctctcctgcacagccagtcagtctatcgntgactggtancctggtaccagcaagaaatcgtggccaggcctccccgaggcctcctctactttaccgngcactcccacgacgggccacgtggtcgtcccagacgtacggttcaggtgggcggtggtaagtttgggaactagtacgttttcnctcacctatccacgtccgaccctagagtagtagaagtagttgttgtacttagttttattcgtacgtacctagtaactaaattaacttaaattacgtcggtccgttcggaccgttcggtaccggttccggaccggtaaacggggtaaaccgaaaggggttaacggaaaacgttaccgaaaaccggttagttcggttacggtaactacggaacctaacctagttcgttaacgttcctttaac

SEQ ID NO: 395933 - DNA, 908 bp, Homo sapiens
  misc_feature: GZ8MTXP01A8WGJ.21.27.C05.1.454.CMB.2.raw
  modified_base (203)..(203): a, c, t, g, unknown or other
  modified_base (309)..(309): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacncgccaccctctcctgcacagccagtcagtctatcgctgacttggttagcctggtaccagacaagaaatctggccaggcctcccgaggcctcctctacgtttaccgngcctactcccgaccgacggggccctacgtcggtcgtaccccgaaaggaccgtaacggggtttccgaaggggttcggggtaccggggttaggggtaaacgtttttacggggggaacccttaagggtttaaccggttttttttccccgtacccgttaacccgaacccgttaacgttacccggaacccggtaccccggtaaccccgttaaacgggtaacgggttaaacgggttaaacgggtaaaacggtttacggttttacgggtttaccggttaacgttttaacggttttttaaccgttttaccggttaccggtaacccggttaaacggttaaacctttaaaaagttttaaacgttttaaaccgtttaccggttccgggttacccgtttacggggttacccgggtttacccgggttacccggggtttaccccggggaaaccccggggtaaacccgggggttaaacccgggttaaagggggttaaaccggttaaaaccgttaaacccgggtaaaaccggttaacggtttcggggttaccggtaaccgttaccggtaaccctaaccgttacgtttacccgtttaacgtttaacccgtttcccg

SEQ ID NO: 395934 - DNA, 664 bp, Homo sapiens
  misc_feature: GZ8MTXP01AKT0A.21.27.C05.1.454.CMB.2.raw
  modified_base (204)..(204): a, c, t, g, unknown or other
  modified_base (403)..(403): a, c, t, g, unknown or other
  modified_base (429)..(429): a, c, t, g, unknown or other
  modified_base (445)..(445): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccacctgtctgtgtctccgaggggggacnccgccaccctctcctgcacagccagtcagtctatcgctgacttggttacgccgtggtaccagacaagaaactcgtcggccaggcctcccgaggtcctcctctactttaccgcgacactccacgacgggccctacgtggtccgtaccagacgtacggttcgaggtcgggcggtggtaagtttgggaatagtacgttttcnctacacatcacgtcgaacctaaaggngtagaagtattgttancttagttactttcgagtacctaaggtacttaaatttactaaacgtttcgtcggtaccgttcggtaccggttaccggtaaccggttcccggaacccgggtaaaccggggtaaaccgtaaacggggttaaacgggtaaaacttaaccgggtaaaaaccgtaacgttgggttcgggaccttaacggacctaaccgttatcgttacgttccttaacgtaaccc

SEQ ID NO: 395935 - DNA, 562 bp, Homo sapiens
  misc_feature: GZ8MTXP01B8DI1.21.27.C05.1.454.CMB.2.raw
  modified_base (296)..(296): a, c, t, g, unknown or other
  modified_base (470)..(470): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaatggtcgctggcaacaatggtgaattggattaggcagtccccgngagaggccttgagtggcttggaagactattatacgtccagtcggtatgaagactatgcagtaattctggtgaggtcggtcgtcgtcaccatccacccagaccacgtaccaaagatcgacggtctaccctacctacctaagtcgtctcgtcactcgcgacgacacgtctagtttnttttgcgtacaaggtgggactcgtaacttacgttcgttacgtaaccgtaccccttgtacctccgttacggggccgttaaggggtttaacccg

SEQ ID NO: 395936 - DNA, 576 bp, Homo sapiens
  misc_feature: GZ8MTXP01DNYXE.21.27.C05.1.454.CMB.2.raw
  modified_base (355)..(355): a, c, t, g, unknown or other
  modified_base (361)..(361): a, c, t, g, unknown or other
  modified_base (472)..(472): a, c, t, g, unknown or other
  modified_base (509)..(509): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtgtcctgtcacagatacaaactacagcagtctggtccaggactggtgacggccctgcacgtaccctttcactcacctgtgacatcgtaccggggaaatgtcgctggcaaacaagtggttaggaattggattaggcacgtccccgtgagaggcctgagtggcgtggaagactatatacgtccagtgtatgaagactangacagnttctgtgagcgtcgtctcaccatccacccagacacgtacaagactcgacgtcctccctactacctaagtcgtctcgtccacgtcccgacgacacggtctagttttatttgngtaacgaagacgggtattcgaacgtagttaccggttnttacccttaacccttccgttcgtaaccgtccggttacgggggtaaccgttaacggggtttaacccgg

SEQ ID NO: 395937 - DNA, 545 bp, Homo sapiens
  misc_feature: GZ8MTXP01DTZX9.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaatgtcgctggcaacaatggttggaattggattaggcagtccccgtgagaggccttgagtggcttggaggacctattatacgtccagtggtatgaagactatgacagtaattctgtgagcggtcgtctcaccatcacccagacacgtaccaagatcaggtctccctaccaaccgtaatcgtctgtccacctcccgacgacacggctagttttactttgtgtaacaagagggtattcgaactgttcgttcgacctaactccttgtactccgttcggggtccgaagggtttaaccg

SEQ ID NO: 395938 - DNA, 667 bp, Homo sapiens
  misc_feature: GZ8MTXP01B2DRW.21.27.C05.1.454.CMB.2.raw
  modified_base (203)..(203): a, c, t, g, unknown or other
  modified_base (310)..(310): a, c, t, g, unknown or other
  modified_base (418)..(418): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtcgtcggagggggacnccgccaccctctcctgacacagccagtcagtctatcgctgacttggtacgcgtggtaccagcaagaatcgtgccaggcctcccgaggtcctacctctactttaccgngacaactcccgaaccgacgggcctacgtcggtctacccgaggtaccgtagggtcgagggtcgggtacgggtggttaagtttacgggaactagggtttacgtttttccncctacctaaccgacgttccaccggtacccgtacccgttaagaggtaagttaggaaagttagttcgggttagtaccgtttagtttacttcgtacgtacctaagtaaccttaaattaagttaaacttcggtccggtccttacggtccggtaccggtaccgttccgggaacccgaacgggtaaccgaaggggttaacgaaaccgtaaacgaacgttacgttcgacggtcacgtcaacgtcttctcgttctcc

SEQ ID NO: 395939 - DNA, 607 bp, Homo sapiens
  misc_feature: GZ8MTXP01DWXFE.21.27.C05.1.454.CMB.2.raw
  modified_base (382)..(382): a, c, t, g, unknown or other
  modified_base (417)..(417): a, c, t, g, unknown or other
  modified_base (504)..(504): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggactgggtcgacgggcccctcgcctacgtacccctttcactcacctggtagactatcgtaccggggaaaatcgtcgctggacaacaatggtaggaattggattaggcacgtccccgtgagaggcctgaggtggcgttggaaggtacctattatacgtccagtcgtactgaagactatgacagtnttctgtgagtcggtcgtctcaccacgtcaacccanacacgtacaagaactcgacggtccctccctacaacctaagtcgtctcgaccacctcccgacgacctacggtcttagtttacttttgngtaacgaaagagggtacttacgaactacgttcggttcgttaaaccttcccttcccttaaggaccctcggttaccggggtaaccgttaacggggtttaaccccg

SEQ ID NO: 395940 - DNA, 558 bp, Homo sapiens
  misc_feature: GZ8MTXP01EVMYP.21.27.C05.1.454.CMB.2.raw
  modified_base (361)..(361): a, c, t, g, unknown or other
  modified_base (473)..(473): a, c, t, g, unknown or other
  modified_base (504)..(504): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggacaacaatggtggaattggattaggcagtccccgtgagaggccttgagtggcttggaagacctattatacgtcccagtggtatgaagactatgacagtnttctgtgagtcgtacgtctacacatcacccagacacgtacaagaatcaggtcctaccctaccacctaagtcgttctcgtcacctcccgacgacacggtctagtttactttgngaactaagagggtattcgagtagttcggttnttaaccgttcctccgttaagactccgttcggggtaaccgttaaggggttaaccg

SEQ ID NO: 395941 - DNA, 653 bp, Homo sapiens
  misc_feature: GZ8MTXP01BNDZR.21.27.C05.1.454.CMB.2.raw
  modified_base (388)..(388): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctcccatgggtgtcctgtcacagatcaaactacagcagtctggtccaggactggtgacggccctcgcacgtaccctttcactcacctgtgacatcgtaccggggaaatgtcgcgtgcaacaagtggtagaagttggattaggctacgtccccgtgagaggtccttgagtggtcgttagggaaacggtaccttagttactaccgtcccgtaggttacggtaataggaaagactatgaacagtnttctggtgagtcggtcgtctacaccataccacccgagaccgacgtaccaaagtactcgacgtccctaccctacctaacctaagtcgttccgtcgtacctaccgtcccgacgaccctacgggtcttaaggtttttactttccggagtaaccgtaaaggttacgggtattaccgaacttacgttccggttacgttacccgttaaccttcccgttaagtacccgttaccgggttaccgggggtaaccgttaacggggttttaacccgg

SEQ ID NO: 395942 - DNA, 641 bp, Homo sapiens
  misc_feature: GZ8MTXP01D7QN2.21.27.C05.1.454.CMB.2.raw
  modified_base (161)..(161): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtntcctgtcacagatacaaactacagcagtctggtccaggactggtgacggccctcgcacgtaccctttcactcacctgtgactatacgtaccggggaaatcgtcgctggacaacgaagtggttaggaattggattaggcgacgtccccgtagagaggtccgttgaggtggtcgttagggaacggtaccttattacgtacgtccgaggtcggtaagtagaaagtactagtcgtaacagtaattctggtaggtaggcggttacgtctacctaccacgtaccacccgacgacacgttaccaaagtatccgacgtcctaccctacctacttaactcgtctcgtaccacctaccgacgactacggtcttagtttagtttgcgtaagaaacggaggtacttacgtaacttacgttcggttcgttaaccttccgttaccgtaacgttccgtaccggttacggggtaaccgttaacgggtttaacccgg

SEQ ID NO: 395943 - DNA, 574 bp, Homo sapiens
  misc_feature: GZ8MTXP01AUB71.21.27.C05.1.454.CMB.2.raw
  modified_base (203)..(203): a, c, t, g, unknown or other
  modified_base (304)..(304): a, c, t, g, unknown or other
  modified_base (377)..(377): a, c, t, g, unknown or other
  modified_base (389)..(389): a, c, t, g, unknown or other
  modified_base (395)..(395): a, c, t, g, unknown or other
  modified_base (405)..(405): a, c, t, g, unknown or other
  modified_base (409)..(409): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtagcctggtaccagcagaaatctggccaggcctcccgaggcctcctcactttaccgngcatcccaccgagggcccacgtggtctcccagacaggttcaggtggcggtggtaatttgggcaggtagtttcnctcacatcagcncctagngagtgaaagntgtnctagtttactctgccagtactaaatattaaattacgtcggtcctaggtccggttaccggtaccggtttccgggacccgtaacggggaaccgttaaggggtacgaaaacgtacgaaaacggttacgttggttacggctacggcctaacattcctgttccttaaccg

SEQ ID NO: 395944 - DNA, 578 bp, Homo sapiens
  misc_feature: GZ8MTXP01DAJ7W.21.27.C05.1.454.CMB.2.raw
  modified_base (349)..(349): a, c, t, g, unknown or other
  modified_base (367)..(367): a, c, t, g, unknown or other
  modified_base (385)..(385): a, c, t, g, unknown or other
  modified_base (491)..(491): a, c, t, g, unknown or other
  modified_base (516)..(516): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagtaccctttcactcacctgtgacatcgtaccggggaaaatgtcgctggacaacaatggttagaattggattaggcagtccccgtgagagccttgagtggcgttaggaaggtacctattatacgtccagtggtanagaagactatgaacagtnttctgtgagcggtcgtcncaccataccacccagaccacgaccaaagtatcacgtcctacccctacactaagtcgtcgtcaccactcccgacgaccgacggcttagttttattgtgaacaacggngggacttcgtaactgtttcgggttnttacccttaaccttccttcgtaccgtccggttacggggtaacccgttaaggggtttaacccg

SEQ ID NO: 395945 - DNA, 629 bp, Homo sapiens
  misc_feature: GZ8MTXP01C4JPZ.21.27.C05.1.454.CMB.2.raw
  modified_base (203)..(203): a, c, t, g, unknown or other
  modified_base (213)..(213): a, c, t, g, unknown or other
  modified_base (250)..(250): a, c, t, g, unknown or other
  modified_base (398)..(398): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctntcctgcacagccagtcagtctatcgctgactggttanctgtaccagcagaatctggccaggcctcccgaggtcctccctactactttaccgtgccaactccccgaccgacggggcccacgtggtcgtcccaggtactacggttcaggtgggcggtggtaagtttgggaactaggtacgttttccncgtccactatcacgccgaccctacgaggtagtaggaaagtgttagttcgacgttagttttatttcgtcgtaccaagtactaaattattaaattacgtcggtaccgttggtcgtccggtacgttccgggaccgtaaccggggaacgaaaggggtaacgaaacgtaaccggtaaacgttaacgttcggttacggtcctacggcaaccgtacttcgttaacgttcctttaaccg

SEQ ID NO: 395946 - DNA, 584 bp, Homo sapiens
  misc_feature: GZ8MTXP01DIIJY.21.27.C05.1.454.CMB.2.raw
  modified_base (203)..(203): a, c, t, g, unknown or other
  modified_base (303)..(303): a, c, t, g, unknown or other
  modified_base (387)..(387): a, c, t, g, unknown or other
  modified_base (424)..(424): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccacctgtctgtgtctccgaggggggancgccaccctctcctgcacagccagtcagtctatcgctgactggttagctggtacagcagaaatctggccaggcctcccaggcctcctctacttttaccgngcatcccaccacggggcccacgtggtcgtcccagacgtacggttcaggtggcggtggtaacgtttgggaactgtacgttttccnctccactatccacgccgaccctagagtagtagaaagnttggttgacttagtttacttctcggacctaagtactaaattaacttaaattacgtgtacctggtccgtcgtacgttcggaccgtaacgggacaagggtacggaaatacgaaaacgttcgttgttacgggtcctagccacctagttcttcgttctttaacc

SEQ ID NO: 395947 - DNA, 597 bp, Homo sapiens
  misc_feature: GZ8MTXP01ALQT7.21.27.C05.1.454.CMB.2.raw
  modified_base (357)..(357): a, c, t, g, unknown or other
  modified_base (480)..(480): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaatgtcgctggcaacaatggtgaattggattaggcagtccccgtgagaggcctgagtggcttggaagacctatatacgtccagtgtatgaagactatgacagtnttcgtgtgagtcggtcgtctcacctactaccacccagaccacgtacaagactcgacgtcctccctacctaacctaagtcgtctcgtaccaccgtcccgacgacacggtcttagttttatttgngtaacgaaggacgggtacttcgtaacgtacgtttccgggttcgttacccttaacccgttcccgttaacggtacccgttccgggttacggggtaacccgttaacggggtttaacccgg

SEQ ID NO: 395948 - DNA, 552 bp, Homo sapiens
  misc_feature: GZ8MTXP01A7CLF.21.27.C05.1.454.CMB.2.raw
  modified_base (201)..(201): a, c, t, g, unknown or other
  modified_base (376)..(376): a, c, t, g, unknown or other
  modified_base (390)..(390): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcagaaatctggccaggcctcccaggcctcctcactttaccgtgcactcccaccgagggcccacgtggtctcccagacaggttccaggtggcggtggatttgggactgtagttttcnctcactatcacgcncctacagagtagaagattgttgctagtttattctagccaggactaattaattaattactggtcctggcgtcgtcggttccggaccgtacgggaaccaagggttagaaacttacgaaacgtagttggttcggactcgcaactactcttacgttcttcgtaacc

SEQ ID NO: 395949 - DNA, 630 bp, Homo sapiens
  misc_feature: GZ8MTXP01DL9Q9.21.27.C05.1.454.CMB.2.raw
  modified_base (203)..(203): a, c, t, g, unknown or other
  modified_base (309)..(309): a, c, t, g, unknown or other
  modified_base (408)..(408): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctcctgcacagccagtcagtctatcgctgaccttggtacgcctggtaccagcaagaaatcgtggcaggcctcccgaggtcctcctctactttaccgngactactcccacgacgggcctacggttcggtccgtaccgagacgtacggttcagggtcgggtcgggtaggtaagtttgggaactaggttacgttttccnctaccactatcgacgcccgtaccctagaggtagtaggtaagtgttgtacgtacttagtttcttacgtcgactaagtactaaattacttagttacgtcggtaccgtcggtaccgttcggtaccggtccgggacccggtaacgggaaccgttaagggtacgaaacgtaacgaacgttaacggttggttacgtctacgtaactacctgttcttcgttaacttccg

SEQ ID NO: 395950 - DNA, 612 bp, Homo sapiens
  misc_feature: GZ8MTXP01CVUK4.21.27.C05.1.454.CMB.2.raw
  modified_base (204)..(204): a, c, t, g, unknown or other
  modified_base (306)..(306): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggttagcctggtaccagcagaaatctggccaggcctcccaggcctcctctactttaccgngcactcccaccgagggcccacgtggtcgtccccagacgtacggttcaggtgggcgggtggtaagtttgggaactagtagttttctctcacatcagcgacctacgagagtgaagtattgttcgacgttagtttactttcgtcgacctaaggtacttaaattaacttaaactttaccgtggtccttggtccgtcggtaccggtttccgggacccggtaaccggggaaccgttaaaggggtacgaaagttaaccgaaaacgttaacgttggttacggctacggccacgtattacgttgttaactttccg

SEQ ID NO: 395951 - DNA, 725 bp, Homo sapiens
  misc_feature: GZ8MTXP01ALQHH.21.27.C05.1.454.CMB.2.raw
  modified_base (202)..(202): a, c, t, g, unknown or other
  modified_base (312)..(312): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccggagggggganccgcccaccctctcctgcacagccagtcagtctatcgctgactggttacgccgtggtaccagacaagaaatcgtggccaggcctcccgaggtcctcctctactttaccgngacactacccgaccgacgggccctacgtggtccgtacccgaggtacgtaggttcgaggtgggtcgggtaggtagtttacggggaacttggttacgtttttcctaccgtaccgtaacctacgtaccgacgtcccgtaccccttaagaacgggtaagggttaacggaaagttagtttacggtttacgtacgttttaaggttttactttccgtacggtaccctaagggtaacttaaagtttaacgttaaacgtttccgtcggtcccgttcggttacccggtccggttacccgggttaccggacccggaaaccgggggtaaccgaaaggggttaacggaaaacttaacggaaacgtacggttggttcggttacctaaggtaccctaacgtacgttcgttacgttccttcgtaacccg

SEQ ID NO: 395952 - DNA, 539 bp, Homo sapiens
  misc_feature: GZ8MTXP01EDQC7.21.27.C05.1.454.CMB.2.raw
  modified_base (201)..(201): a, c, t, g, unknown or other
  modified_base (301)..(301): a, c, t, g, unknown or other
  modified_base (382)..(382): a, c, t, g, unknown or other
  modified_base (395)..(395): a, c, t, g, unknown or other
  modified_base (523)..(523): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcagaaatctggccaggctcccaggcctcctctatttaccgngcactcccaccgaggcccacgtggtctcccagacaggttccaggtggcggtgagtttgggactgtagttttctctcacctntcagccgccctanagagtgaagattgttgctagtttattctagcctaggactaattattaacttactcggctagcgtcgtacgtcggccgacgggaacaaggttagaaacttacgaaacgtaagttgttgactgacaaccntcttgttcttctaacc

SEQ ID NO: 395953 - DNA, 597 bp, Homo sapiens
  misc_feature: GZ8MTXP01CDEYQ.21.27.C05.1.454.CMB.2.raw
  modified_base (493)..(493): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactgggtgaggccctcgcagtaccctttcactcacctgtgacatcgtaccggggaaatgtcgctggcaacaatggtggaattggattaggcagtccccgtgagaggccttgagtggcttggaaggtactattatacgtcccagtggtatggaagactatgacagtaattcgtaggtgtagcgggtcgtctacgaccactccgaccccagaccacgtaccaacgaatcgacgtcctccctaccacctaagtcgtctcgtccaccgtcccgacgactacgtcttagtttacgttttgngaacgtaagagggtacttacgtaacgtgttcggttcttaccgttaacccttccgtttaacgaccgttccgggttcggggtaacccgttaaggggtttaacccgg

SEQ ID NO: 395954 - DNA, 765 bp, Homo sapiens
  misc_feature: GZ8MTXP01EMOKL.21.27.C05.1.454.CMB.2.raw
  modified_base (204)..(204): a, c, t, g, unknown or other
  modified_base (217)..(217): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccacctgtctgtgtctccgaggggggacnccgccacctctcngcacacgcagtcagtctatcgctgtacgttggtacgcgtacggtaccagacaagaactcgtacggaccgacggtccctacccgacggtcccttacctactacgtttaccgtcgacctacgtaccccgaaccggacgggtaccctacggttcggttaccgtaccccgtaaggtaccgtacgggttacggtaggggtcggggtcggggttagggttaaacggtttacggggaacgttagggtttacgttttccctaccgtacccgtaacgtacgtaccgacgtacccgtaacccgtaagaaggtaggtaaggtaaagttagttaggttacgtacgtttagttttacgttacgtacgtaccgtaagtaactaaattaacgttaacgttcgtcggtccgttacggtccgttaccggtaccggttacccggaaccggtaaacgggaacggttaaagggtaaacggttaaaaccgtaaaccgtaaaacggttacgttcggttacggaaccgtacgaaccgtaaccgtacgttaccgttaacgtttccttaaccg

SEQ ID NO: 395955 - DNA, 765 bp, Homo sapiens
  misc_feature: GZ8MTXP01DPO6X.21.27.C05.1.454.CMB.2.raw
  modified_base (205)..(205): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggggacnccgcccaccctctcctgcacagccagtcagtctatcgctgacgttggtacgccgtaggtaccagacaagaactcgtcggaccacggcctacccgaggtccttcctactacgtttaccgtcgacctacgtacccgaccgacgggtccctacggttcggtaccgtacccgaaggtaccgtacgggttaccgtagggttcggggtacgggttagggttaacggtttacggggaacgttaagggtttaccgtttttccgtacctaccaaccgtacgtacccgacggtcccgtaaccccgtaagaacggtaagttaaggtaaaggttagtttaggttacgtacgtttaagttttactttcgtacgtaccggtaagtaacttaaaagttaacgtttaaacgttaccgtacggtccgttacggtccgttaccggtaccgggttacccgggacccggtaaaccggggtaacggttaaaggggtaaacggttaaaacgtaaccggtaaacggttaacgttcgggttacgtcgtacgtaacctacgttactttcgttcgttccgttaacg

SEQ ID NO: 395956 - DNA, 749 bp, Homo sapiens
  misc_feature: GZ8MTXP01E4TRT.21.27.C05.1.454.CMB.2.raw
  modified_base (243)..(243): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgcctgtgtctccgagggggggacccgcccaccctctcctgcacacgccagtcagtctatcgntgtactggtacgccgtaggtaccagacaagaaactcgtcggaccgacggccctacccgacggtccctccctactacgtttaccgcgacctacctaccccgaaccgacgggaccctacggtcggtaccgtacccgaacggtaccgtaccgggtttaccgaggggtcggggtccggggttagggtaaacggtttacggggaacgttacgggtttacgttttccctacctacctaacctacttaccgtacggttaccgtacccctaagaaggtaaggtagtaaaggtagtttggttacgtacgttacgttttacttcgtacgtaccgtaagtaacttaaagttaacgttaaacgtttccgtcggtccctacggtccggtaccgggtaccggttccgggacccggtaaccggggtaaacgttaaagggtaacgttaaaacgtaaaccgtaaaacgttacgttcggttacggtaacgtacgaaccaacctacttcgttaacgttcgtaacg

SEQ ID NO: 395957 - DNA, 716 bp, Homo sapiens
  misc_feature: GZ8MTXP01CA9LX.21.27.C05.1.454.CMB.2.raw
  modified_base (206)..(206): a, c, t, g, unknown or other
  modified_base (243)..(243): a, c, t, g, unknown or other
  modified_base (315)..(315): a, c, t, g, unknown or other
  modified_base (401)..(401): a, c, t, g, unknown or other
  modified_base (408)..(408): a, c, t, g, unknown or other
  modified_base (421)..(421): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcgtccggaggggggacnccgccaccctctcctgcacagccagtcagtctatcgntgacttggtacgcctggtaccagacaagaaatcgtcggccaggcctcccgaggccttcctctactttaccgngacctactcccgacgacgggcctacgtcggtcgtaccgagacgtacggttcaggtggcggtggtaagtttgggctagtacgtttcnctacacntcacgccacctanagagtagaagtagttgtacgtcgttagtttcttacgtacgtaccggtaataacgttaaaatttaacgtttaaatttccggtacggttacccgtttacggggtcccggttaaccggggttaaccgggttacccggggtaaccccgggtaaaaccgggggtaaacccggttaaaagggggttaaacggttaaaaaacgttaaacccggtaaaacggttaaacccgttgggttacggggtaaccttcgggaaccctaacccggtatttccggttaaccgtttaacccgttttaacccg

SEQ ID NO: 395958 - DNA, 644 bp, Homo sapiens
  misc_feature: GZ8MTXP01ESJDA.21.27.C05.1.454.CMB.2.raw
  modified_base (310)..(310): a, c, t, g, unknown or other
  modified_base (357)..(357): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaatgtcgctggacaacaagtggttaggaattggattacggctacgtccccgtgaggnggtccttgagtggcttggaagaccttatatacgtccagtgtataganactatgacagtaattctaggtgagtacggtcgtctacaccgtatcccaacccagacacgtaccaaagtactacgacggttcctaccccgtaccaaccttaagtcgttacctcgtacctaccgtaccccgacgacccgtacggtcttagttttactttttcggagtaaccgtaaaggttacgggtaacttacgtaacgtacggtttcggttacgttacccgtttaaccgttccgtttaacgtaccgttacccggttcgggggtaaccttaacgggggtttaaacccgg

SEQ ID NO: 395959 - DNA, 652 bp, Homo sapiens
  misc_feature: GZ8MTXP01DBA8A.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaaatgtcgctggacaacaatggtgaattggattaggcagtccccgtgagaggcctgagtggcttggaagactattatacgtccagtggtactgaagactatgacagtaattctgtgagcgtcgtctcactatcacccagacacgtacaagtaactcgacggtcctccctacctaacccttaagttcgtccttacggtaccctacccgttccccgaacgaccgtaaccggtccttaagtttttacgtttttcggtacggtaacgtaaacggacgggggtaacttaccgtaaacgttacgtttaaccgggttcgttaaacccgtttaaccccttacccgtttaacggtaacccgttccccgggttacgggggtaaccccgttaagggggttttaaaccccggg

SEQ ID NO: 395960 - DNA, 622 bp, Homo sapiens
  misc_feature: GZ8MTXP01B8IGD.21.27.C05.1.454.CMB.2.raw
  modified_base (200)..(200): a, c, t, g, unknown or other
  modified_base (248)..(248): a, c, t, g, unknown or other
  modified_base (304)..(304): a, c, t, g, unknown or other
  modified_base (390)..(390): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttancctggtaccagcagaatctggccaggcctcccgaggcctcctctacttttacccgngccactcccaccgagggcccacgtcggtctcccagtacgtaggttccaggtgggcggtggtagtttggggactggttagttttccncgttacacctatcgacgccgaccctacgaggtagtagaagtattggttgacttagtttattctagccaggtactaaattacttaattaccgtgcccgttaggtccgtccggtaccggttccggacccgaaccggggtaacccgtaaagggttacggaaacttaccgaaaacggtacgttcggttcggttacctcggacctaacctagttccgttacgttcctttcgtaaccg

SEQ ID NO: 395961 - DNA, 808 bp, Homo sapiens
  misc_feature: GZ8MTXP01EO4S3.21.27.C05.1.454.CMB.2.raw
  modified_base (200)..(200): a, c, t, g, unknown or other
  modified_base (236)..(236): a, c, t, g, unknown or other
  modified_base (312)..(312): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtgtctccgaggggganccgccacctctcctgcacagccagtcagtctatcgntgacttggtagcctggtaccagcaagaaatcgtcggaccaggcctccccgaggtcctccgtactacgttttaccgngacactcccgaaccgacgggccctaacgttcggtccgtaccccgaagtaccgtacggggtttccgaagggtcggggtacgggttagggtaaacggttttacgggggaaccgtttaagggtttaacggttttttccctaccgtttaccccaaccctaacgttacccgaaacggtccccggtaacccccttaaaggaacgggttaaacggttaaggaaaacggtttacgtttgggtttacggtaaccgttttaaggttttttaactttccgtacggtacccgtaaaggttaaccttaaaatttaaatttaaacgtttaacccgtcgggtaacccgttacgggtcccggttaacgggttaacccggtttcccgggaacccggaaaccggggtaaaccgttaaaggggtaacggttaaaactaccggtaaaaacggttaccgttggttacgggtaacctcgaaccctaacgtacgttccgttaacgtttccgtttaaccg

SEQ ID NO: 395962 - DNA, 574 bp, Homo sapiens
  misc_feature: GZ8MTXP01AK5RL.21.27.C05.1.454.CMB.2.raw
  modified_base (355)..(355): a, c, t, g, unknown or other
  modified_base (491)..(491): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtggggccctcgcagaccctttcactcacctgtgacatcgtaccggggaaatgtcgctggcaacaatggttaggaattggattaggcagtccccgtgagaggccttgagtggcttaggagacctattatacgtcccagtggtatagaagactangcaagtattctgtgagcggtcgtctcacgactccgacccagaccacgtaccaaagaactcgacgtcctcccctaccacttaatcggtctgtcctaacccgtccccgaacgaccacggtacttagttttattttcgngactaaggaggactcacgtgttcgggttgttaccttaccttccgtgtaaccttcggcggggacctaagggttaacgttttccg

SEQ ID NO: 395963 - DNA, 527 bp, Homo sapiens
  misc_feature: GZ8MTXP01EJZI8.21.27.C05.1.454.CMB.2.raw
  modified_base (357)..(357): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggtggaattggattaggcagtccccgtgagaggccttgagtggcttggaaggacctattatacgtcccagtgtatgaagactatgacagnttctgtgagcggtcgtctcacatcacccagacacgtacaagaatcaggtcctcctacacctaagtgtctgtcacctcccgacgacacggtctagtttattttgtgctaagagggattcactattcgttgactcctcgttgtacgtcgttgggtccgttaagggttaaccg

SEQ ID NO: 395964 - DNA, 652 bp, Homo sapiens
  misc_feature: GZ8MTXP01C2JQM.21.27.C05.1.454.CMB.2.raw
  modified_base (202)..(202): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctcggagggggacnccgccacctctctgacacgacgccagtctagtctatcgtctagtacgttggtacgccgtacggacagacaagtaactcgcggaccgacggtcctccgacgtcctcctactacgtttaccgcaccactcccgaccgacggcctacgtcggtaccgtaccgagtacgtacggtcgaggtcggtggtaggtaagttacggaacttacgttcgtttcactacactatccgacgtcctaccagagtagtagaagtgttgtacgtacttagtttacttacgtagacgtaaagtaactaaattaattaacgttaccgtcggtaccgttacggtccgtaccgggtaccggtacccgggaaccggtaaacgggtaaacggttaagggtaaacgaaacgtaaaccgtaaacgttacgttcggcgtcgtacgaacctacgtacttcgttccgttcgttaac

SEQ ID NO: 395965 - DNA, 646 bp, Homo sapiens
  misc_feature: GZ8MTXP01DN0HB.21.27.C05.1.454.CMB.2.raw
  modified_base (204)..(204): a, c, t, g, unknown or other
  modified_base (225)..(225): a, c, t, g, unknown or other
  modified_base (310)..(310): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgcccaccctctcctgcacngccagtcagtctatcgctgacttggttagcctggtaccagcagaaatcgtggccaggcctcccgaggcctcctctactttaccgngctactcccaccgacgggccctacgtggtccgtacccgaggacgtacggttcgaggtgggcgggtaggtaagtttaggggaactaggtttacgtttttcctacgtaccacctatccacgcctaccccgtagaggtagtagaaagtgttagttgacttagtttattctagacctagtactaaattacttaattacgtcggtccttacggtccggttaccggtaccggttcccgggaccggtaaccggggtaaccgttaaaggggtaacgaaacgtaaccgaaacggttacgttcgggttacggtctacgcctacctacgttctcgtttccttaaccc

SEQ ID NO: 395966 - DNA, 750 bp, Homo sapiens
  misc_feature: GZ8MTXP01AU467.21.27.C05.1.454.CMB.2.raw
  modified_base (200)..(200): a, c, t, g, unknown or other
  modified_base (247)..(247): a, c, t, g, unknown or other
  modified_base (305)..(305): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttanctggtacagcagaaatcgtggccaggctcccgaggccttccgtactattttacccggngacctactccccaccgacggggacccctaacgttcgggtacgtacccccaaggaacccgtaggggtttacccccaggggttcggggcggggttagggtaacgtttttaagggggaaccttaagggttacgttttttcctacccttccgaaccctagttccgaaacgtccccgtacccctaaacgaaggagttaggaaaggtagtttggttacgtacttaaggttttacttcgttgaccctaagggacttaaagttaactttaaagttacgtcggtacccgttgggtacccggttaccgggtaccgggtttaccccggacccggaaacccgggggtaaccgtaaaacggggttagggtaaaacttaacccggaaaaccggttaaacgttgggttcgggaccttaacggacctaacccgtattaccgttcgttccgtttcctaaccg

SEQ ID NO: 395967 - DNA, 802 bp, Homo sapiens
  misc_feature: GZ8MTXP01EHEJ2.21.27.C05.1.454.CMB.2.raw
  modified_base (200)..(200): a, c, t, g, unknown or other
  modified_base (206)..(206): a, c, t, g, unknown or other
  modified_base (213)..(213): a, c, t, g, unknown or other
  modified_base (218)..(218): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccacctgtctgtgtctccgagggggacnccgccncctctcngcacncgcagtcagtctatcgctagtacgtggtacgcgtaggacagacaagaactcgacggaccgacggtcctacccgacggtccttacccgtacttacgtttaccgcgtacctaccgtacccgaaccggtacggtaccctacggttcgggtaccgtacccgaaggtaccgtacggttacccggagggttcggggtacgggttaggttaacggtttaacgggaaccgttaaggtttaccgtttttaccctaccgttacccgtaaccgtacgtaccgaaccggtacccgtaacccgtaaggtaaggtaagtaacggtaaaggttacgtttacggtttacgttacgtttaagttttacttacgtacgtaaccgtaaacggtaacttaaagtttaacgtttaaaccgttaccgtccggtacccgttacggtaccggttacccggtacccgggttaccgggaaacccgggtaaacgggtaaaccggtaaacgggttaaacggtaaaacgttaaaccggtaaacgtaacggttcggttcggttaccgtaacgaccgtaaccgttacgttccgttacgttaaccgttcgtaaccg

SEQ ID NO: 395968 - DNA, 591 bp, Homo sapiens
  misc_feature: GZ8MTXP01AINAN.21.27.C05.1.454.CMB.2.raw
  modified_base (317)..(317): a, c, t, g, unknown or other
  modified_base (379)..(379): a, c, t, g, unknown or other
  modified_base (502)..(502): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaatgtcgctggacaacaatggtggaattggattaggcacgtccccgtcgaggaggtccgttagnggtggtcgttaggaaggtacctagttactacgtccctagtcggtatgaagtactatgacagnttctgtgagtcggtctcgtcacatccacccagaccacgtaccaaagactcgacgtcctccctacctaacctacgtacgtcctcgtaccacctccgacgacacggtcttagttttacgtttcgngaactaagggaggtacttcgactagttcggttacgttaccttaaccctcgttcgtaccgtccggttcgggtaaccgttcgggttaaccg

SEQ ID NO: 395969 - DNA, 735 bp, Homo sapiens
  misc_feature: GZ8MTXP01DML3H.21.27.C05.1.454.CMB.2.raw
  modified_base (204)..(204): a, c, t, g, unknown or other
  modified_base (721)..(721): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccgaggggggacnccgccacctctcctgcacacgccagtctagtctagtcgctagtacgttggtacgccgtacggtaccagacaagtaactcgtacggaccgacggtccctaccccgacggtcccttacccgttacttaaccgtttacccggtcgacctaccgtaccccgaaccggaccgggtaccctacggttcggtaccgtacccgaaggtaccgtacggttacggtagggtcggggtacgggttagggttaacggtttacgggaacgttaggtttaccgttttcctaccgtaccgtaacctacgtacccgacgtacccgtaacccgtaagaggtaaggtaaggtaaagttacgttaggttacgtacgtttagtttacttcgtacgtacgtaagtaacttaaattaacttaacgttacgtcggtccgtacggtccgttaccggtaccggtaccggaaccggtaacgggtaacgttaaagggtaacgaaacgtaccggaaacgttacgttggttcgtctacgcctactnttccgttcgttctc

SEQ ID NO: 395970 - DNA, 533 bp, Homo sapiens
  misc_feature: GZ8MTXP01AOWSG.21.27.C05.1.454.CMB.2.raw
  modified_base (203)..(203): a, c, t, g, unknown or other
  modified_base (250)..(250): a, c, t, g, unknown or other
  modified_base (296)..(296): a, c, t, g, unknown or other
  modified_base (317)..(317): a, c, t, g, unknown or other
  modified_base (364)..(364): a, c, t, g, unknown or other
  modified_base (374)..(374): a, c, t, g, unknown or other
  modified_base (381)..(381): a, c, t, g, unknown or other
  modified_base (387)..(387): a, c, t, g, unknown or other
  modified_base (393)..(393): a, c, t, g, unknown or other
  modified_base (517)..(517): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggtanctgtacagcagaatctggccaggcctccgagctcctcatttaccgngcatccacagggccagtggtntcccagactacggttcaggtggcggtggaatttgggcagtagtttcnctcacatcancgcctanagagtnaaagtntgtgactagtttacttcgtgaccagctaaataagttaattacgtgtctgccggtcgtacggttcggaccgaacgggaaccagggtacggaaactacgaaacgacgttggttggctgaaccaacngttactgttcttaacc

SEQ ID NO: 395971 - DNA, 756 bp, Homo sapiens
  misc_feature: GZ8MTXP01BWNZH.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgcccaccctctcctgcacacgccagtcagtctatcgctgtacttggtacgccgtggtacagacaagtaactcgtacggaccgacggtcctcccgacggtcccttacccgttacttaacgtttacccggcgacctaaccgtccccgaaccggacgggccctacggttcggtaccgtacccgaggtaccgtacggttcgagggttcggggtcgggttaggtaacggtttacggggaacttaggtttacgtttttccacctaccaacctacgtccgacgtacccgtacccctaagaaggtaggttaggtaaagttacgtttaggttacgtacgtttaagttttacgtttcgtacggtaaccgtaagtaactaaaagttaacgtttaaacgttacggtcggtaccgttacgggtacccggttaccgggtaacccgggttccgggaacccggtaaaccggggtaaaccgttaaaggggtaacgaaaaccgtaaaccgaaacggttacgttggttaccggtctacgtaacctaaccgtcttaccgttcgttccgtc

SEQ ID NO: 395972 - DNA, 742 bp, Homo sapiens
  misc_feature: GZ8MTXP01BMUG7.21.27.C05.1.454.CMB.2.raw
  modified_base (204)..(204): a, c, t, g, unknown or other
  modified_base (217)..(217): a, c, t, g, unknown or other
  modified_base (240)..(240): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtcgtctccgaggggggacnccgccacctctcngcacacgccagtcagtctatcgntagtacgttggtacgccgtacggacagacaagaatcgtacggaccacggtcctccgacgtcctacctacgtactttaccgcgacctacgtacccgaaccgacgggtcctacggttcggtaccgtaccgaggtacggttacgggtttaggtcggggtacgggttaggttaacggtttaacgggaacgttcggtttacgttttccctaccgtaccctaaccgtactaccgacgtaccctacccgtaagaacggtaacgtaggtaagtagtttacggttactacgtttacgtttacttcgtacgtacctaaggtaacttaaacgttaacgttaaacgttcgtcggttaccgttacggtacccgggttaccggtaaccggttaccgggaaccggtaaccggggtaaaccgtaagggttaaacgtaaacgttaaaccggtaaaacggtacgttacggttcgaccgtaacgtacctaacgttacgttcgttacttccgttcgtaaccg

SEQ ID NO: 395973 - DNA, 587 bp, Homo sapiens
  misc_feature: GZ8MTXP01DX6PZ.21.27.C05.1.454.CMB.2.raw
  modified_base (160)..(160): a, c, t, g, unknown or other
  modified_base (357)..(357): a, c, t, g, unknown or other
  modified_base (466)..(466): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgaggccctgcagaccctttcactcacctgtgacatcgtaccggggaaaatgtcgctggcaacaatggtgaattggattaggcagtccccgtgagaggccttgagtggcttaggaagacctattatacgtccagtgtatgaagactatgacagtnttctgtgagcggtcgtctcacatcaccctagacacgtacaagtactcagtcctccgtacactaatcgtctcgtacacctccgacgacacggtctacgttttattttcgngtaactaaaggagggtacttacgtaacgttacgttccgggttacgttacccttaacccgttccgttaacggtaacccgttccggttacgggggtaaccccgttaagggggttttaacccgg

SEQ ID NO: 395974 - DNA, 652 bp, Homo sapiens
  misc_feature: GZ8MTXP01EA0W3.21.27.C05.1.454.CMB.2.raw
  modified_base (160)..(160): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggccttccatggggtntcctgtcacagatcaaactcagcagtctggtccaggactggtcgacggccctcgcacgtaccctttcaacctcacctgtacgactatacgtaccgggggaaaatcgtcgcgtggacaacgaagtggttaggtaattggagttacggcgacgtccccgtagagacggtccgttgagttggcgttaggaacggtacttattagtaccgtaccgagtggtactaggaagtactatgaactagtaattctaggtgagtcggtcgtctacacctatccaacccagacacggtaccaagtactcgacgtccctacctactaaccttaatcggttactcggtacctaccgtcccgacgacgtaacgggtctttaacggttttacttttggccgtaacgtaaaggttacgggtacttacgtaacgttcgttacgggttacttaccgttccttcgttcgtaaccgtccggttacgggtaacccgttaagggtttaacccgg

SEQ ID NO: 395975 - DNA, 555 bp, Homo sapiens
  misc_feature: GZ8MTXP01BZ7XS.21.27.C05.1.454.CMB.2.raw
  modified_base (357)..(357): a, c, t, g, unknown or other
  modified_base (473)..(473): a, c, t, g, unknown or other
  modified_base (496)..(496): a, c, t, g, unknown or other
  modified_base (505)..(505): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacaatggtggaattggattaggcagtccccgtgagaggccttgagtggcttggaagacctattatacgtcccagtgtactgaagactatgcagtnttctgtgagcggtcgtctcaccatccacccagaccacgtaccaagaactcaaggtcctaccctccacctaagtcgtctgtaccacctcccgagaccacggtcctagtttattttgngctaaaggagggtattcgaactnttcgggttnaccttaacctccttgaccttccgttacggggtccgttaaggggttaaccg

SEQ ID NO: 395976 - DNA, 654 bp, Homo sapiens
  misc_feature: GZ8MTXP01BNMT1.21.27.C05.1.454.CMB.2.raw
  modified_base (200)..(200): a, c, t, g, unknown or other
  modified_base (314)..(314): a, c, t, g, unknown or other
  modified_base (426)..(426): a, c, t, g, unknown or other
  modified_base (634)..(634): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccacctgtctgtgtctccgagggggganccgccaccctctcctgcacacgccagtcagtctatcgctgactggttacgccgtggtaccccagcaagaaatcgtcggccaggcctcccgaggccttccctctactttacccgngctactcccgaccgacgggcccacgttcgggtcctacccgaagtacgtacggtttccgagggttgggtcggggtaggtagttttaagggggacctaaggttacgtttttccncgtaccaaccgtatccgacgcccgtaccctaacgaggagtaggaagtagttggttgtacttagtttacttcgtacgaccaggtaactaaattaacttaacgttacgtcggtaccttcggtaccgtccggtacccggttccggacccggaacgggtaaccgtaaagggttacgaaacttacgaaacgtattcggttcgctgcctaactnttacgttcttccttcgtccc

SEQ ID NO: 395977 - DNA, 747 bp, Homo sapiens
  misc_feature: GZ8MTXP01DTMRX.21.27.C05.1.454.CMB.2.raw
  modified_base (202)..(202): a, c, t, g, unknown or other
  modified_base (320)..(320): a, c, t, g, unknown or other
  modified_base (724)..(724): a, c, t, g, unknown or other
tcagtcgtcgctcgcacgaccggtgctcgatttagacgcgatcgaagggtttgggggaggaactgctcagttaggacccagacggggccatggaagccccagcgcagcttctcttcctcctgcttctctggcctcccagacaccactggagtgattgtgatgacgcagtctccagccacctgtctgtgtctcgagggggganccgccaccctctcctgcacagccagtcagtctatcgctgacgttggttacgccgtggtaccagacaagaaatcgtggccaggccctacccgaggccttccctactacgttttacccgngaccctacgtaccccgaaccgtacggggacccctaaggttcgggtccgtaccccgaggtaaccgtacgggtttccaggggttcggggacggggttaggttaacggtttaacggggaactaagggtttacgtttttccacccgttaccgaacctactaccgaccggtcccgtacccgtaaagacggtaagtagtaaaaggtagtttcggttgtacgtttaagttttacgttctacgtacctaaagggtaacttaaattaacgtttaaacgttcgtcgggtacccgttaggtacccgggtttaccgggtaccggttacccgggaacgggtaaacccgggggaaacgtaaggggttaacggaaaacttaacgaaacggtacgttcggttggacctaagactaacctnttacgttcttccgttaacgtccg

SEQ ID NO: 395978 - DNA, 671 bp, Homo sapiens
  misc_feature: GZ8MTXP01A3BSV.21.27.C05.1.454.CMB.2.raw
  modified_base (201)..(201): a, c, t, g, unknown or other
  modified_base (305)..(305): a, c, t, g, unknown or other
  modified_base (394)..(394): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgcccaccctctcctgcacagccagtcagtctatcgctgactggttagcctggtaccagcaagaaatcgtggccaggcctcccaggcctcctctatttaccgnccactcccaccgagggcccacgtggtcgtcccagtactagggttcccagggtgggcggtggtagtttagggactaaggttagttttccnctcaacctagtcgaacgcccgtaccctaacgaggtaacgtagtaaagtagttggtttcgtacgtttagtttttactttccgttagaccctaagggtaactaaagtttaattaaaactttcgtcgggtcccttagggtacccggttccggtaaccgggtttccgggaccccggaaacggggaaaccccgtaaaggggttaacgggaaaacttacccgaaaaacggtacgttggttcggacgtcgacctaaccattccgttcgttaacctttcgtcccg

SEQ ID NO: 395979 - DNA, 638 bp, Homo sapiens
  misc_feature: GZ8MTXP01DJ1C7.21.27.C05.1.454.CMB.2.raw
  modified_base (207)..(207): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcgtccggagggggggacnccgcccaccctctcctgcacacgccagtcagtctatcgctgtacgttggtacgccgtaggaccagacaagaaactcgcggaccacggccctcccgacgtcctcctactacgtttaccgcgtacctactacccgaccgacgggacctacgttcggtccgtaccagtacgtacggttcgagggtcgggtcgggttaggtaagttagggaacgtaggtttacgttttcctcctaccacctactccacgcccgtacctaagagtagtagaagtgttgtcgtacttagtttactcgtacgacgtatataattacttaagttcgtcgtccgtcgtccgttcggtaccggttccggaccggtaacgggaacgaagggtaacgaaacgtacgaaacgttacgttggttacgtcgtactaactctacttcttcgttctcg

SEQ ID NO: 395980 - DNA, 670 bp, Homo sapiens
  misc_feature: GZ8MTXP01AGPQV.21.27.C05.1.454.CMB.2.raw
  modified_base (200)..(200): a, c, t, g, unknown or other
  modified_base (300)..(300): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcaagaatctggccaggcctcccaggcctcctctatttaccgngccatcccaccgagggcccacgtggtcgtccccagactaggttcccaggtggcggtggtagtttggggaaccttaaggtacgtttttccgtctaccgaacctagttccgaacgcccgtacccctacgaaggtagtagaaagtagttggtttagacgttagttttacttcgtacgtacctaaggtactaaagtttaattaaacgtttaccgtgggtcccttaggtacccgttcggtaccggtttacccgggacccgtaacccggggtaaaccgtaaacggggttaaacgtaaaacgttaccgaaaaaccggtaacgttggttaccggcgtaacggaccaacctagttccgttacgttccttccgtaacccg

SEQ ID NO: 395981 - DNA, 835 bp, Homo sapiens
  misc_feature: GZ8MTXP01A9GG5.21.27.C05.1.454.CMB.2.raw
  modified_base (201)..(201): a, c, t, g, unknown or other
  modified_base (305)..(305): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggtagcctggtaccagcaagaaatctggccaggcctcccgaggtcctcctctacgtttaccgngccaactccccaccgacgggcccaacgttcggtcgtccccaaggaccgtaacgggtttccgaagggttcggggacggggttagggtaaacgtttttacgggggaaccttagggtttaacgttttttcccgtacccgttacccgtaaacccctagttacccgaacgtccccggtaccccccgtttaaaggaacggtaacggttaaggtaaaacgggttagttttagggttttacggtaccttttagggtttttaacttttccgttacgggtacccgttaaaggttaacccttaaaagttttaaagtttaaaacgttttacccggtcggggttaccccgtttagggtacccgggtttacccggggtaaacccgggttttacccgggggaccccggtaaaacccgggggtaaacccggttaaaagggggttaaaccgggttaaaaacgtacccggtaaaaaaccggttaccggtttgggttacggggtcttacgggaacctaacccgtattccgtaacgtttcctttaacccg

SEQ ID NO: 395982 - DNA, 678 bp, Homo sapiens
  misc_feature: GZ8MTXP01EINH3.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatttctgtctccttcctcatcttcctgcccgtgctgggcctcccatggggtgtcctgtcacagatacaaactacagcagtctggtccaggactggtgacggccctcgcacgtaccctttcactcacctgtgacactcgtaccggggaaatgtcgcgtgcaaacagtggttaggaattggattaggcacgtcccgtgagaggtcttgagtggacttaggaacgtacttaattacgtacgttccgagtggtatagaacgtatagtgactaaagtatttcgtgggtacggtaggtccgggttactctaccgtaacccactacccaccccaaggacctaaccgtaccaaaggtaacttcgaaccgttcctacccctacctaacgttacgtcggggttacttcggttaccacctaccccgaacgaccgtaacggtgtttacgttttacgtttagcgtacgaaaggtcggttactacgttacgtaacgtttacggttccgttaacctttaccgtcctttaggaacccgtttacggggtacggggttaccgttaacggggtttaaccgttttcccgg

SEQ ID NO: 395983 - DNA, 614 bp, Homo sapiens
  misc_feature: GZ8MTXP01B1GTC.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagtaccctttcactcacctgtgacatcgtaccggggaaatgtcgctggcaacatggtggatggattaggcagtccccgtgagaggccttgagtggcttggagacctattatacgtccagtgtatgaagactatgacagtaattctgtgagtcggtacgtctcaccagtaccacccagaccacgtaccaagaactcgacggtcctcccctaccaacccttaatcgttacgtcgtaccaccctacccgaccgacgtaccggtcttagttttaacttttcggagtaacctaaagggttagggtacttaccgacgtacgtttcgggttacgacctttaacccgttccgtttaacgtaacccgttccggttacgggggtaacccgttaacgggggtttaacccgg

SEQ ID NO: 395984 - DNA, 662 bp, Homo sapiens
  misc_feature: GZ8MTXP01BCKHJ.21.27.C05.1.454.CMB.2.raw
  modified_base (200)..(200): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtgtctccgagggggancgccacctctcctgcacagccagtcagtctatcgctgacttggttagcctggtaccagcaagaaatcgtaggccaggcctccccgaggctcctcactttaccgcgcactcccaccgacgggccctacgtcggtcgtcccagtacacggttcaggtgggcggtggtaagtttgggaactagtacgtttcctcgtacaccattcacgccgtaccctagacggtagtaggtaaacgtattggttacgtacgttaaggttttactttactcggtaccgtaagtacctaaaatttaacgttaaacttaccgtggtcccttacggtccggttacccggaaccggtttccgggacccgtaaacgggggtaaacccgttaaagggttaaacgggaaaacgtaccggtaaaacggttacgttcggttacggggcttacgcgtaaccctagttcgttaacgttctttaaccg

SEQ ID NO: 395985 - DNA, 717 bp, Homo sapiens
  misc_feature: GZ8MTXP01D73PC.21.27.C05.1.454.CMB.2.raw
  modified_base (203)..(203): a, c, t, g, unknown or other
  modified_base (240)..(240): a, c, t, g, unknown or other
  modified_base (307)..(307): a, c, t, g, unknown or other
  modified_base (470)..(470): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgntgactggtagcctggtaccagcaagaaatcgtggccaggcctcccgaggcctcctctactttaccgngcactcccaccgacgggcccacgtggtcgtaccccgaagaccgtacgggttcagggtcgggcgggttggtaaacgtttggggaacctagggtttacgtttttcctaccttaccaacctattccgaacgcccgtaccccttaacgaggtaagttaggaaaagtntttggttcggtacttagttttactttacgtcgacccgtaagtacctaaagttaacttaaacgttaccgtcggtccgttcgggtccggttacccggtaccgggtttcccgggacccggtaaaccggggtaaacccgttaaagggggttaaacgaaaacgttaaaccgaaaaacccggttaaggttcggttacgggtaaccgttacggaaccgtaaccgtacttccgtttaaccgttccgtttaacccg

SEQ ID NO: 395986 - DNA, 706 bp, Homo sapiens
  misc_feature: GZ8MTXP01C72D3.21.27.C05.1.454.CMB.2.raw
  modified_base (240)..(240): a, c, t, g, unknown or other
  modified_base (307)..(307): a, c, t, g, unknown or other
  modified_base (417)..(417): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccgaggggggacccgccaccctctcctgcacagccagtcagtctatcgntgactggtagcctggtaccagcagaatcgtggccaggcctcccgaggtcctccctctactttaccgngctactcccaaccgacgggccctacgttggtccgtacccgagtaccgtagggttcagggttgggtcgggttagggtaaacttttgggggaactaggtttacgtttttccnccgtacaacctatcgacgtcccgtaccccttaagaaggtagttaaggaaagtagtttggttacgtacgttaagttttacgtttcgtacggtacctaaaggttaccttaaaagtttaacttaaacgtttaccggttcgggtaccgttcgggtcccggttaaccgggttacccgggtttacccgggacccggaaaccgggggtaaccgttaaaggggtacgttaaaacgtaaccgaaaacgttacgttggttacggtctacgaactacgtattcgttaacgttctttaacc

SEQ ID NO: 395987 - DNA, 592 bp, Homo sapiens
  misc_feature: GZ8MTXP01A5S04.21.27.C05.1.454.CMB.2.raw
  modified_base (203)..(203): a, c, t, g, unknown or other
  modified_base (304)..(304): a, c, t, g, unknown or other
  modified_base (441)..(441): a, c, t, g, unknown or other
  modified_base (563)..(563): a, c, t, g, unknown or other
  modified_base (576)..(576): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctccctgcacagccagtcagtctatcgctgactggtagcctggtaccagcagaaatcgtgccaggcctcccaggctcctctactttaccgngacactcccacccgagggacccacgtcggtcgtacccagtaccaggttccaggtgggccggtggtaagtttggggaactaggttacgttttctctcactactcagtccgaccctaacgagaagttagaagtatgttnacttagtttaacttcgtagaccaagtactaaattataaacttacgcggtctgcgtacgtacgttccggacgtaacgggaccgaaaggtagaaacgtacgaaaacgttacgttggttacggcngtaacctaaccgngttctgttccttaacc

SEQ ID NO: 395988 - DNA, 748 bp, Homo sapiens
  misc_feature: GZ8MTXP01EW0ID.21.27.C05.1.454.CMB.2.raw
  modified_base (208)..(208): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtcgtcgtccggagggggggaccnccgaccctaccctctccgtcgaccaccgctacgtctagttctactcgtctagtacgttggtacgccgtacggacagacaagtaactcgacggaccgacggtccctacccgacggtccttacctacgttaccgtttaccgacgtacctaccgtacccgaccggaccggtaccctacggttcggtaccgtaccgaagtacgtacggtccgtagggtcgggtacggttaggtacggttaacgggaacgttcgtttaccgtttacctaccgtacctacgtacgtacgaccgtaccgtaccgtaagacggtagtagtaagttacgttgttacgtacgtttacgtttacttacgtacgtacaaggttaacttaaacgttaacttaacgttcgtccggttaccgttacggtaccggttccggtaccggttacccggaccggtaaacgggtaacgtaaacgggttaacgtaaacttaaccggaaacggtacgttcggttcgttaccgtaacgaccttaacgttcgttcttacgttccgttccgtaacg

SEQ ID NO: 395989 - DNA, 590 bp, Homo sapiens
  misc_feature: GZ8MTXP01DNYF1.21.27.C05.1.454.CMB.2.raw
  modified_base (356)..(356): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggacaacaatggtggaattggattaggcagtccccgtcgagaggccttgagtggcttggaggactattatacgtccagtgtatgaagactatgacagnttctgtgagcgtcgtctcaccatcaccccagaccacgtacccaaagaactcacggtcctccctacctaccctaaagtcgttctacgtccacctccccgacgaccacgggtccttagttttattttcgtgtaactaaggacggggtattcgtacgtagtttccggttcgttaccgttaacccttccgttcgtaccgttcccgttcgggggtaaccgttaacggggtttaacccgg

SEQ ID NO: 395990 - DNA, 671 bp, Homo sapiens
  misc_feature: GZ8MTXP01B6DKU.21.27.C05.1.454.CMB.2.raw
  modified_base (241)..(241): a, c, t, g, unknown or other
  modified_base (310)..(310): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacccgcccaccctctcctgcacagccagtcagtctatcgntgactggttagcctggtaccagcaagaaatcgtggccaggcctccgaggtcctcctactactttaccgngacactcccgaccgacgggccctacgttcggtaccgtacccgagtacgtacggttcgaggtcgggtcggtaggtaagttgggaactaggttacgttttccacttaccaacctataccgacgcctacccctagagtagttagaagtagttggttcgacttagtttacttcgacgtaccggtataacttaaattaacttaacgttacgtcggtcgttacggccgttaccggtaccggttccgggaacccggaacggggtaaccgttaaaggggttaacgaaactaaaccggtaaacgttaacggttcggttacggtaacctacggtaacctaccgttacttcggttcgttccgtttaaccccg

SEQ ID NO: 395991 - DNA, 614 bp, Homo sapiens
  misc_feature: GZ8MTXP01A1P8Y.21.27.C05.1.454.CMB.2.raw
  modified_base (159)..(159): a, c, t, g, unknown or other
  modified_base (383)..(383): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtntcctgtcacagatcaaactacagcagtctggtccaggactggtgacggccctcgcacgtacccttcactcacctgtgacatcgtaccggggaaatgtcgctggacaacaatggttaggaattggattaggcgtacgtccccgtacgagaggtccttgagtggtcgttaggaacggtacctattacgtacgtaccaggtcggtataggaagtactatgaacagtnttcgtgtgagtcggtcgtctcacactccacccagacacgtacaagactcgaacgtcctaccctactacctaagtcgttactcgtacgacctcccgacacgtacggtcttaaggttttactttcggtgtaacgtaaaggagggtacttccgaacgttacgttcggttacttacccttaaccgttccgtcgtacccgtccggttacggggtcccgttaacggggtttaacccg

SEQ ID NO: 395992 - DNA, 568 bp, Homo sapiens
  misc_feature: GZ8MTXP01DOR1F.21.27.C05.1.454.CMB.2.raw
  modified_base (364)..(364): a, c, t, g, unknown or other
  modified_base (405)..(405): a, c, t, g, unknown or other
  modified_base (416)..(416): a, c, t, g, unknown or other
  modified_base (463)..(463): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaaactacagcagtctggtccaggactggtgacggccctcgcacgtaccctttcactcacctgtgacatcgtaccggggaaatgtcgctggacaacaatggttagaattggattaggcagtccccgtgagagccttgagtggcttggaaggacctatatacgtccagtgtatgaaagactatgacagtntctgtgagcggtctctcacatcacccagacacgtacaagancagtcctcccncactaagtgtctgtccactcccgacacacggtctacgtttattttgngaactaaggagggtacttacgtaacgtagtttacgggttcttaacccttcccttaccgttcgtaaccgttcccggttacggggtccgttaacggggtttaacccg

SEQ ID NO: 395993 - DNA, 602 bp, Homo sapiens
  misc_feature: GZ8MTXP01CA3UP.21.27.C05.1.454.CMB.2.raw
  modified_base (238)..(238): a, c, t, g, unknown or other
  modified_base (241)..(241): a, c, t, g, unknown or other
  modified_base (389)..(389): a, c, t, g, unknown or other
  modified_base (502)..(502): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtctggtccaggactggtgacggccctcgcacgtaccctttcactcactgtnacntcgtaccgggaaatgtcgctggacaacaagtggtagtaagttggagttaggcgtacgtccccgtgagacggtccgttgacggtggtcgttaggaacggtaccttagttactacgtccgaggtggtacgtaggaagtactatgacagtnttctgtgagtcgtcgtctacaccactccacccagacacgtacaagactcgacgtcctaccctacaactagtcgtctcgtacactcccgacgactacggtcttagtttatttgngtaacgaagttacgggtacttcgaacgtgttccggttacttacctaaccgttcgttcgtaccgtccggttacggggtaacccgttaacggggtttaaccg

SEQ ID NO: 395994 - DNA, 701 bp, Homo sapiens
  misc_feature: GZ8MTXP01CUER7.21.27.C05.1.454.CMB.2.raw
  modified_base (204)..(204): a, c, t, g, unknown or other
  modified_base (313)..(313): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctcctgcacagccagtcagtctatcgctgactggtacgcctggtaccagcaagaatcgtggccaggcctccccgaggtccctcctctaacgtttaccgngacctactccccgaccgacggggcccacgttgggtcctaccccgagtaccgtacgggttcaggggttcgggtcgggttaggtaagttttaggggaacctagggtttacgtttttccaccgtaccaacccgtattaccgacggtcccgtacccctaagaggtacggtaaggaaagttagtttgttagtacttagttttactttcgtacgtaccgtaagtacttaaattaacttaaacgttacgtcggtccttacgggtccgtaccggtaccggttccgggacccggtaaaccggggaaccgttaaaggggtaacgttaaacgtaaaccgtaaacgttacgttgggacggtaacgtacgaacctacctattccgttcgttcctttaaccg

SEQ ID NO: 395995 - DNA, 753 bp, Homo sapiens
  misc_feature: GZ8MTXP01CGIO1.21.27.C05.1.454.CMB.2.raw
  modified_base (204)..(204): a, c, t, g, unknown or other
  modified_base (218)..(218): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtactccgaggggggacnccgccacctctccngacacacgccagtcagttctagtcgtcttaggtacgttggttacgccgtacggaaccagacaagtaacgtcgtacggaccgtacggtccctacccgaggtcccttacccttacgtaacgtttaccgacgtacctaaccgtaccccgaaccggtacgggtaccctacggttcggtaccgtacccgtaagtaccgttaccggttacggtacgggtggggtcgggttaggttaacgggtttacgggtaacgttaggtttacgtttccctacctaccgtacctagtacccgaccgtacccgtaacctaaggtaacggtaaggttaacggtaagttacgttaggttacgtacgtttagtttaacttcgacgtacgtaagttaaacttaaattaacgttaacttacgtcggtaccgtacggtcggtaccggtaccggtacccggaccggtaaacgggtaacggttaaaggtaaacgaaacgtaaccggtaaacgttcgttggcgtaaccgtacgaacctactcgttccgttcgttccgtcg

SEQ ID NO: 395996 - DNA, 623 bp, Homo sapiens
  misc_feature: GZ8MTXP01B4TIT.21.27.C05.1.454.CMB.2.raw
  modified_base (381)..(381): a, c, t, g, unknown or other
  modified_base (451)..(451): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacccgccaccctctcctgcacagccagtcagtctatcgctgactggtagcctggtaccagcagaaatctggccaggctcccaggctcctcactttccgtgcatccccacgagggccacgtggtctaccccagactacggttcaggtgggcggtggtaacgtttgggctagtagtttttcnctactacctatcctacgccgtccctaacgaggtaagttaggaaagtagttgttcggtacttaacgttttnttcttcggtacctaggtaactaattaaataacgtttacgtcggtaccgttcggtccgttccggtacggtttccgggcccggtaacgggaacccgttaagggtacggaaacgttaccgaaaacgacgttcggttacggtcctggaacctacgacttcgtcgttccgtttaacc

SEQ ID NO: 395997 - DNA, 710 bp, Homo sapiens
  misc_feature: GZ8MTXP01B1MHS.21.27.C05.1.454.CMB.2.raw
  modified_base (203)..(203): a, c, t, g, unknown or other
  modified_base (322)..(322): a, c, t, g, unknown or other
  modified_base (417)..(417): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgcccaccctctcctgcacagccagtcagtctatcgctgacgttggtacgcctggtaccagacaagaaactcgtcggccgacggcctaccccgaggtcctaccctctactttacccgngacctactcccgaccgtacgggacctacgtcggtcgtacccgagacgtacggttcggaggtgggcggtggtaagttcgggcgtagtacgttttcnctacaccacgtccacgccgaccctaagacgtagtagtaacgtagttgttcgtacgttagtttaactttcgtacgtaccgtacgtaacgttaaattaacgtttaaacgttccggtaacggttcccgttacgggtacccggttacccgggttaccggtttacccgggggacccgtaaaccgggggtaaccggttaaacggggtaaacggttaaaacgtaaaccgtaaaacgggttacgttcgggttaccggtaactacggaactaaccgtcttacgttcgtttaaccgtttcccg

SEQ ID NO: 395998 - DNA, 669 bp, Homo sapiens
  misc_feature: GZ8MTXP01D67E5.21.27.C05.1.454.CMB.2.raw
  modified_base (199)..(199): a, c, t, g, unknown or other
  modified_base (270)..(270): a, c, t, g, unknown or other
  modified_base (308)..(308): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtcccagccacctgtctgtgtctcggagggggacncgccacctctctgcacagccagtcagtctatcgctgacgtggtacgccgtggtaccagacaagaaactcgnggccagggcctcccgaggtcctcctactactttaccgngacactacccgacgacgggcctacgttcggtacgtacccgagtaccgtagggttcacgggtgggtcggtaggtagtttcggggaaactaggttcgttttcacctacacctatcgacgtcccgacctacgaggtagtagaaagtgtttaggttcgtacgtttagtttacgttccgtaggtaacctaagtacttaaattaactttaacttacgtcggtccgtcggtcggttaccggtaccggttaccggacggtaaaccgggaacgtaaagggtaaacgaaactaaccgaaacggtaacgtcggttacggttcttacggtaaccacgtaacttcgttcgttacttaaccgttaacgttccccg

SEQ ID NO: 395999 - DNA, 665 bp, Homo sapiens
  misc_feature: GZ8MTXP01AUSNP.21.27.C05.1.454.CMB.2.raw
  modified_base (315)..(315): a, c, t, g, unknown or other
  modified_base (415)..(415): a, c, t, g, unknown or other
  modified_base (460)..(460): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacccgccaccctctcctgcacagccagtcagtctatcgctgacttggtacgcctaggtaccagcaagaaactcgtggccgacggcctcccgaggtcctcctactactttaccgngacactccaccgacgggcctacgtggtcgtacccgagaccgtaggttcagggtcggacgggttggtaaaggtttcggggaactagggttacgtttttccncttacacctatccgacgccgtacccctaagacgtagtagaaagtnttagttcgagttaagttttacttcgtcgacgtaacgtactaaattaacttaacgttacgtcggtaccgtcggtcccggttaccgtacccgggtttacccggacccggtaaccgggtaacccgttaaaggggtaccgaaacgtaaccgaaaacggttacgttggttacggcctacggaacacctattccgtaacgttccgttaacc

SEQ ID NO: 396000 - DNA, 618 bp, Homo sapiens
  misc_feature: GZ8MTXP01DMZRY.21.27.C05.1.454.CMB.2.raw
  modified_base (497)..(497): a, c, t, g, unknown or other
tcagtcgtcgctcgcacgaccggtgctcgatttagacgcgatcgaagggtttgggggcagagccctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggtggaattggattaggcagtccccgtgagaggccttgagtggcttggaaggacctattatacgtccagtcggtatgaagactatgcagaattctgtgagcggtcgtctcgaccatccacccagacctaacgtaccaagtaatccgaggtcctccccttaccacccttaaagttcgttcttacgtaccgaccttccccgacgtacaaccggtcctagttttattttcgngtaaccgaaaggagggtacttaccgtacgtacgtttacgggttcgttaccttaacccgttcctttcggtacccgttcccggttacgggggtaacccgttaacgggggttttaaaccccggg

SEQ ID NO: 396001 - DNA, 696 bp, Homo sapiens
  misc_feature: GZ8MTXP01BVN0M.21.27.C05.1.454.CMB.2.raw
  modified_base (202)..(202): a, c, t, g, unknown or other
  modified_base (305)..(305): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgacttggtagcctggtaccagcagaaatctggccaggcctcccgaggtcctcctctactttaccgngccactcccaccgagggcccacgtggtcgtcccagacgtacggttcaggtcgggcggtggtaagttttggggaacctagggttacgttttcctccgttaccacctatccgaacgcccgtaccccttaagaggtaggttagaaaacgtgttggttcggtacttagttttactttcgtacggtacctaaggtaccttaaaagttaacttaaacgtttaccgtcggggtaccctttagggtacccggttcccggtaaccgggtttccgggacccggtaaaccgggggtaaacccgttaaagggggtaaccggttaaaacttaacgaaaaaccggttaaccgttgggttcggccgttacggcctacccgtattccgtttaacgttcctttaaccg

SEQ ID NO: 396002 - DNA, 605 bp, Homo sapiens
  misc_feature: GZ8MTXP01B34D0.21.27.C05.1.454.CMB.2.raw
  modified_base (204)..(204): a, c, t, g, unknown or other
  modified_base (301)..(301): a, c, t, g, unknown or other
  modified_base (459)..(459): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgcctgtgtctccgaggggggancgccaccctctcctgcacagccagtcagtctatcgctgactggtagctggtacagcagaatctggccaggcctcccaggcctcctctactttaccgngccactcccaccgacgggccacgtggtcgtcccagactacggttcaggtgggtcggtggtaacgtttggggaactaggtacgtttttcctcgtacacctatccacgtccgccctaagagtacggtagaaagtattggttgtacgttagttttatttcncgtacctagtactaaattattaattacgtggtacctaggtccgttacggtaccgttccgggcccgaacggggtaccaaaggggtacgaaagtaccgaaacgttacgttggttacgctacgcctacctagttcttcgttaacgttcc

SEQ ID NO: 396003 - DNA, 730 bp, Homo sapiens
  misc_feature: GZ8MTXP01CEHFI.21.27.C05.1.454.CMB.2.raw
  modified_base (203)..(203): a, c, t, g, unknown or other
  modified_base (239)..(239): a, c, t, g, unknown or other
  modified_base (301)..(301): a, c, t, g, unknown or other
  modified_base (393)..(393): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgntgactggttagcctggtaccagcagaatctggccaggcctcccgaggctcctcatttaccgngcactccaccgagggcccacgtggtcgtcccagactacggttcagggtgggcgggttggtaagttttgggggaactaggttacgtttttccnctccaccctatccgacgtcccgacccctaacgaggtagtaggaaacgtagttggttagtaccgttaggttttactttccgtacggtaccccgtaaggtaaccttaaagtttaaactttaaacgtttaacccgttcgggtacccgtttacggggtcccggtttacccgggtaaccgggttttcccggggaaccccggtaaccgggggtaaacccgttaaagggggttaacggttaaaaccgttaaccggaaaacggttaaaccggttgggttaccgggtaaccgttacgggaacctaaccccgttacgttccgtttaacggtttcccgttttaacccg

SEQ ID NO: 396004 - DNA, 588 bp, Homo sapiens
  misc_feature: GZ8MTXP01E0JTP.21.27.C05.1.454.CMB.2.raw
  modified_base (203)..(203): a, c, t, g, unknown or other
  modified_base (240)..(240): a, c, t, g, unknown or other
  modified_base (252)..(252): a, c, t, g, unknown or other
  modified_base (316)..(316): a, c, t, g, unknown or other
  modified_base (387)..(387): a, c, t, g, unknown or other
  modified_base (403)..(403): a, c, t, g, unknown or other
  modified_base (409)..(409): a, c, t, g, unknown or other
  modified_base (568)..(568): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacnccgccaccctctcctgcacagccagtcagtctatcgntgactggttacncctggtaccagcagaaatctggccaggcctcccgaggcctcctctatttaccggcactccacgngggcctacgtggtctcccagactacggttcaggtggcggtaggtaagtttggggaactagggtacttttcncgttacacatcacgcnccctanagagtagaagattgttgacttagtttacttcgtacgacctaagtactaaattataaacgttcgtcgggtcctgtaccgtccggtacgttcccgggacctaacggggaacaaggggtacgaaatacgaaaacgttaacgttggttacggctgcctaactnttcgttaacgttcttaaccg

SEQ ID NO: 396005 - DNA, 709 bp, Homo sapiens
  misc_feature: GZ8MTXP01B9Y9F.21.27.C05.1.454.CMB.2.raw
  modified_base (203)..(203): a, c, t, g, unknown or other
  modified_base (309)..(309): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgacttggtagcctggtaccagcaagaatcgtggccaggcctcccgaggtcctcctactactttaccgngacctactcccgaccgacgggccctacgtcggtcgtaccccgtagaccgtacgggttccgagggtcgggtcgggtgggtaagtttcgggggaactaggttacgttttcctacctaccaaccctagttaccgacggtacccgtaccccgtaagtaggtaagttaggaaacgttagttcggtttagtacgtttacgttttaactttccgtacgacccgtaagtacttaaaactttagttaaacttaccgtcgggtccttaggtacccggttccggtaaccggttcccgggacggtaaacccgggggtaacttaaaggggttaacggaaaactaccggaaaacgttaccgttgggacccggtaatcggtaacctacctaggttccttaacggttccttaaccc

SEQ ID NO: 396006 - DNA, 663 bp, Homo sapiens
  misc_feature: GZ8MTXP01EP1ZK.21.27.C05.1.454.CMB.2.raw
  modified_base (204)..(204): a, c, t, g, unknown or other
  modified_base (312)..(312): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccaccctgtctgtgtctccgagggggacncgccaccctctcctgcacagccagtcagtctatcgctgactggttacgccgtggtaccagcaagaaatcgtggccaggcctcccgaggtcctcctactactttaccgncactcccaccgacgggcctacgtggttccacccgagacgtacggtcaggtgggcggtggtaacgtttgggaacttagttacgtttcctctacgtaccattccgacgcctaccctagagtagtagtaaagtcttggttacgtcgtttagttttacttcgtacggtaccgtaataacttaaattaacttaaacgtttaccgcggttaccgtcggtaccggtaccgggtacggttaccgggaacgtaaccggggtaaaccgttaaaggggtaacgttaaaacgtaaccgtaaaacggttaccgttggacggtaaccgtcgaacctccgtattcccttaacgtttccttaacccg

SEQ ID NO: 396007 - DNA, 629 bp, Homo sapiens
  misc_feature: GZ8MTXP01AGP19.21.27.C05.1.454.CMB.2.raw
  modified_base (316)..(316): a, c, t, g, unknown or other
  modified_base (369)..(369): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactcagcagtctggtccaggactgggtgacggcccctgccacgtaccctttcactcacctgtagactagtcgtaccggggaaatgtcgctggacaacagtggtggaagtggatacggcacgtcccgtgagtaggcctagngtggcgtggaagtactattatacgtcaggtgtactagagtactgtagctagtnttcgtaggtgacggtcggtctcgtaccaccgtactcccaacccgaggaaccacggaccaagtactaccgacgtccctaccctactaactacgttcgtcgttcgtacccaccgttcccgaaccgtaccgtaccggtactttacgttttactttcggtcgaacgtaaggttacgggtacttacgtacgttacgttacgggttcttaccttaacccgttcgtaacgtaccgtcggttacgggaaccgttaacgggttaacccg

SEQ ID NO: 396008 - DNA, 666 bp, Homo sapiens
  misc_feature: GZ8MTXP01CSPZG.21.27.C05.1.454.CMB.2.raw
  modified_base (205)..(205): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtcgtccggagggggaccnccgcctacctctccgcgacacgacgacctagtctacgtctacgtcgtcgtacggtacgttggtacgtccgtacgacagacgaacgtaacgtcgcgacgacgtccaccgcgtcctcgtactactcgcacctacaccgacgacggctacgtcgtccgaccgagtacgtcggtacggaggtcggtcggtaggtaagttacggtaacgttacgtttacgtttcctactaccacgtacgtacgaccgtaccgtaccgtaagagtagtagtaagttgttacgttacgtacgtttacgtttcgtacgtacgtaacgtaagttaaattaaacttaacgttaacgttcgtcgttccgtacggtccgtaccggtaccggtacccggaacggtaacggtaacgttaaagtaaacgttaaacgtaacgtaagttcgttcgcgtaactcgcctactcttacgttcgttccttcg

SEQ ID NO: 396009 - DNA, 592 bp, Homo sapiens
  misc_feature: GZ8MTXP01A2T0X.21.27.C05.1.454.CMB.2.raw
  modified_base (311)..(311): a, c, t, g, unknown or other
  modified_base (397)..(397): a, c, t, g, unknown or other
  modified_base (409)..(409): a, c, t, g, unknown or other
  modified_base (424)..(424): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcgtccgaggggggacccgcccaccctctcctgcacagccagtcagtctatcgctgacttggtagcctggtacagcaagaaatcgtacggccaggcctcccgaggcctcctctactttaccgngcactcccacgacgggcctacgtggtctaccagaccgtaggttccaggtggcggtggtaacgtttgggctagtagtttcactcacntcagccacctangagtagaatattgtnacttagtttattcgacgaccgtagtaactaaagttaacttaacgttcgtacgtccgttcggtaccgttaccgggtaaccggttccgggaaccggtaaccgggaacgttaagggtaacgaacgtaacgaaacgttagttggacgtcacgtcacgtattctcgttctccg

SEQ ID NO: 396010 - DNA, 656 bp, Homo sapiens
  misc_feature: GZ8MTXP01BXCTR.21.27.C05.1.454.CMB.2.raw
  modified_base (203)..(203): a, c, t, g, unknown or other
  modified_base (313)..(313): a, c, t, g, unknown or other
  modified_base (403)..(403): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgacgttggttagccgtggtaccagacaagtaaatcgtcggccaggcctcccgaggcctcctctactttacgngcactccgaccgacgggccacgtcggtcgtacccagacgtaggttcaggtgggtcggttggtaagtttgggaactaggttacgttttccncgtccactcgtacacgtccgacctaacgaggtaagtagaaacgttgttagttacgtacttagttttactttacgtcgactagtaacttaaattaacttaacgtttacgtcggtacctcggtccggtaccggtacggttccgggacccgtaaccgggaacggttaaagggtacgttaaagtaccgaaaacggttacgttcggttacgggccttacggaaccctaaccgtgttcccgttgtttcccgttaacccg

SEQ ID NO: 396011 - DNA, 647 bp, Homo sapiens
  misc_feature: GZ8MTXP01AZOFL.21.27.C05.1.454.CMB.2.raw
  modified_base (162)..(162): a, c, t, g, unknown or other
  modified_base (237)..(237): a, c, t, g, unknown or other
  modified_base (441)..(441): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctcgggcctcccagtggggtntcctgtcacagatacaaactacagcagtctggtccaggactggtgacggccctgcacgtacccttcactcactgnacagtacgtacgggaaatgtcgctggacaacgagtggttaggaagttggaattaggcgacgtccccgtacgaggtacggtccgttgagtggcttaggaacggtaccttattacgtaccgtaccgtagtaggtactacggaagtacgtagtcgaactagtgttcgtagtcgacggtcggtcgtctcgacctactaccaccccganaccgacgtaaccaagtaactcgacgtacctaccctacctactaagtcgtacgttcacctaccgtacccgtacgaaccgtacgtactttaggttttaactttcgagtaagtaacggaggtacttacgtacgtacgttccggttagttacccttaacgtcgttaaccgtaccgtcgggttacggggtccgttaagggttttaacccgg

SEQ ID NO: 396012 - DNA, 616 bp, Homo sapiens
  misc_feature: GZ8MTXP01BOJ1J.21.27.C05.1.454.CMB.2.raw
  modified_base (203)..(203): a, c, t, g, unknown or other
  modified_base (305)..(305): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtacgcctggtaccagcaagaatctggccaggcctcccgaggcctcctctactttaccgngcactccaccgacgggccacgtggtcgtccccagtacctacggttccaggtgggcggtaggtaagtttgggaactaggtacgttttctcgtcaccatcacgccgaccctagagtagtagaaagtagttgttgcttagttttacttacgtgaccgtagtactaaattattaattacgtggtaccttggccgttccgtaccggttccggacccggtaacggggtaacccgaaggggttaacggaaacgtaaccgtaaaacgttaccgttggttacggaactcgaaccttacagttcctaacgttccttaaccg

SEQ ID NO: 396013 - DNA, 660 bp, Homo sapiens
  misc_feature: GZ8MTXP01A97YS.21.27.C05.1.454.CMB.2.raw
  modified_base (237)..(237): a, c, t, g, unknown or other
  modified_base (357)..(357): a, c, t, g, unknown or other
  modified_base (369)..(369): a, c, t, g, unknown or other
  modified_base (436)..(436): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtctggtccaggactggtgacggccctcgcacgaccctttcactcacctgngacatcgtacggggaaatgtcgctggacaacatggtaggaagttgagttagcacgtcccgtgagaggcttgagtggcgttaggaaggtacctagttactacgtccgagtaggtatagganactatgacagtnttcgtggtagagtcggtacgtctaccgaccactccaccccgacgaaccgacgtaaccgaacgtaacncgtaacgtccctaccctacctaaccctagtcgttctcgtacctaccgtacccgacgaccgtaccggtcttaacgttttaggtttttacgcggtaaccgtaaagggttacgggtacttaccgtaacgttaacgttccgggttcgttacccgttaacccgttcccgtttaacggtacccgttaccgggttaccgggggtaaccggttaacggggtttaaccccggg

SEQ ID NO: 396014 - DNA, 698 bp, Homo sapiens
  misc_feature: GZ8MTXP01AJGMZ.21.27.C05.1.454.CMB.2.raw
  modified_base (317)..(317): a, c, t, g, unknown or other
  modified_base (467)..(467): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccggaggggggacccgccaccctctcctgcacagccagtcagtctatcgctgacgtggttacgccttggtaccagcaagaaactcgtcggccagggcctcccgaggtccttcctctactttaccgngcactcccaccgacgggccctacgtggttccgcccgagtacgtacggttccgaggtcgggcgggttaggtaacgtttaggggaacgtaggttacgttttctacctaccacctatccgacgcccgtacctaacgaggtacgtagaaacgtnttcggtacgtcttaagtttcttacgcgtaccaagtacctaaattaacgttaaacgttcggtcggtaccgtcggtccggttacccggtaacgggtttccccgggaccggaaaccggggtaaccttaaagggggtaaacgttaaaccgttaaacgaaaaccggttacggttcggttacggttaacccgacggtaacccctaacgttacgttccgtttcgttccctttaacccg

SEQ ID NO: 396015 - DNA, 757 bp, Homo sapiens
  misc_feature: GZ8MTXP01BIUY2.21.27.C05.1.454.CMB.2.raw
  modified_base (206)..(206): a, c, t, g, unknown or other
  modified_base (255)..(255): a, c, t, g, unknown or other
  modified_base (322)..(322): a, c, t, g, unknown or other
tcagtcgtcgctcgcacgaccggtgctcgatttagacgcgatcgaaggggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccggagggggacnccgcccaccctctcctgcacagccagtcagtctatcgctgacttggtancctggtaccagcaagaactcgtggaccaggcctccccgaggtcctcccgtactaacgtttacccggngaccactaccccgaacccgtacgggggacccctacggttcgggttaccgtacccccgaaggtaccgtacgggtttccaggggttcggggtaccgggggttaggttaaacgtttacgggggaaccttagggtttacggtttttcctcccgttacctacctagttcccgaacggtcccgtaaccccgttaacgaggtaacgttaggaaaacgtgttcgttagtacgttagttttaactttccgtagtacccgtaaagtacttaaaagttaacgtttaaacgttccgtacggtccgttacggtccggttaccggtaaccgtttcccggggaaccgaaccgggggtaaccgttaaagggttaacggaaactaaccgtaaaacggttaccgttggttacggtcctcggaacctacccgatttccgtcgtttccttaaccg

SEQ ID NO: 396016 - DNA, 582 bp, Homo sapiens
  misc_feature: GZ8MTXP01AYMW5.21.27.C05.1.454.CMB.2.raw
  modified_base (204)..(204): a, c, t, g, unknown or other
  modified_base (308)..(308): a, c, t, g, unknown or other
  modified_base (395)..(395): a, c, t, g, unknown or other
  modified_base (477)..(477): a, c, t, g, unknown or other
  modified_base (552)..(552): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacncgccaccctctcctgcacagccagtcagtctatcgctgactggttagcctggtaccagacagaaatctggccaggcctcccgaggtcctcctctactttaccgngacactccacgacgggcctacgtggtcgtccagacgtacggttcaggtgggtcggtggtaagtttgggaactaggttacgttttccnccttcacctatcacgccgaccctagagagtagaagtagtgttgacttgtttattctagtcagtactaaataactaattacgnggtcctggtccgtcgtacggttccggccgaacgggaacgaaggtacgaaagtacgaaacggttacgttggttcgngtacgaaccactattcgttcgttccttaac

SEQ ID NO: 396017 - DNA, 649 bp, Homo sapiens
  misc_feature: GZ8MTXP01ET9F2.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaaatgtcgctggacaacaatggttggaattggattaggcagtccccgtgagacggccttgagtggcgttggaagtactattatacgtccagtggtactgaagtactatgacagtaattctggtgagtcggttcgtcttcacctagtccacccagaccacgttaccaagtaactcaggttccctccctacccaaccttaatcgttctcggtaccaccgttaccccgacgtaccgaccggtcttaacggttttatttttcggcggtaacgtaaacgggttaggggaacttaccgaacgttaacgttcggggttacttaacccgtttaaccccttacggtttaacgtaacccgttccggggttaccgggggtcccgttaaagggggttttaaccccggg

SEQ ID NO: 396018 - DNA, 711 bp, Homo sapiens
  misc_feature: GZ8MTXP01BHEZV.21.27.C05.1.454.CMB.2.raw
  modified_base (355)..(355): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatctcctgccgtgctggcctccatgggtgtcctgtcacagatcaaactacagcagtctggtccaggactggtgacggccctcgcacgtaccctttcactcacctgtgactatcgtaccggggaaatgtcgctggacaacaatggtagtaattggattaggcacgtccccgtagagaggccgttgaggtggtcgttaggaacggtacttagttatacgtccagtggtacnggaagactatcgaacagtaagttcgtggtgtacggtcggttacgtctaccaccatacccaaccccgaaggaaccaaccgttaccaaaagtaactacccgacggttaccctacccctaaccctaaccttaaaggttccgttacgtacgtacccaacccgttaccccggaaccgaaccgtacccgggttacttaacggtttttactttttcggacgtaaccggtaaaggttaacggggtacttaccgtaacgttaacggtttaccgggttccgttaaccctttaacccgttacccgttaacggttaaccccgttcgggttacccgggggtccgttaaaccggggggtttttaaccccg

SEQ ID NO: 396019 - DNA, 600 bp, Homo sapiens
  misc_feature: GZ8MTXP01BJSZA.21.27.C05.1.454.CMB.2.raw
  modified_base (299)..(299): a, c, t, g, unknown or other
  modified_base (354)..(354): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaatgtcgctggcaacagtggtggaatggataggcagtcccgtgagnggctgagtgcttggaagtactatatacgtccagtggtatgaagactatgacagtnttcgtgtgagcggtcgtctcacactaccacccagaccacgtacaagactcgacgtcctcccgtaccactaacgtcgttcctacgtccaccgtccccgacgtaccgaaccggtcttagttttatttcggtgtaaccgtaaggagggtacttacgtaacgttacgtttaccgggttcgttacccttaacccgttcccgttcggtacccgttccggttacgggggtcccgttaacggggtttaacccgg

SEQ ID NO: 396020 - DNA, 716 bp, Homo sapiens
  misc_feature: GZ8MTXP01AWD5W.21.27.C05.1.454.CMB.2.raw
  modified_base (203)..(203): a, c, t, g, unknown or other
  modified_base (218)..(218): a, c, t, g, unknown or other
  modified_base (323)..(323): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacnccgccaccctctccngcacacgccagtcagtctatcgctgacgttggttacgccgtggtaccaggacaagaaactcgtacggccacggtcctcccacggtcctcctctactttaccggtnctactcccacgtacgggcctacgtcggtcgtacccgaggtacgtacggttcgagggtcgggtcgggttggtaagtttcggggaacttagggtttacttttcctacctactaaccgtactaccgacgtcccgtaacccctaagaagggtaggtacgtaaaggttagttacggttacgtacgtttagtttacttcgtacgacgtaagtaacttaaacttaacgttaacgttcgtcggtaccgttacggtcccgggttacccggtacgggttcccgggaacccggtaaaccggggtaaacggaaacgggttaaacgaaacgtaaaccggtaaaacgttcggttcggacggtaacctacgtaacctaaccgttacgtttccgttaacgttccttccc

SEQ ID NO: 396021 - DNA, 900 bp, Homo sapiens
  misc_feature: GZ8MTXP01DPD2O.21.27.C05.1.454.CMB.2.raw
  modified_base (206)..(206): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccggaggggggacnccgcccaccctctcctgaccacagcccagtcagtctatcgctgacttggtacgcctggtaccagcgaagaaactcgtcggaccgacggtccctaccccgaggtcccttccctactaacttttacccgtcgacctaacgttccccgaacccgtacgggaccctacgttcggttccgtaccccgagtaaccgtacggggtttcgaacgggttgggggtacccgggttagggggtttaaacgttttacggggggtaacccgtaagggttttaaaccggtttttttcccgtaccctttaacccggaacccttaaacgggttacccgaacccgggtaccccggtaaccccctttaaaccgggaaagggtaacggttaaacgggtaaaaacggttagttttcgggtttacggtttaaccgttaaacgggttttttttaaacctttcggttaaccgtacccgggttaaaggttaacctttaaaaaggtttaactttaaaacgtttccgtcgggtaacccgtttcggtaccggttacccgggttaccgggtttacccgggcccggttaaaaccgggggaaacccgttaaacggggtaaacgttaaaacccggtaaaccgtaaaacgggttaaacccggtttggttaccgggtaacctcggaacccttaccgtaacggtttccttaagtttccccgtttaacc

SEQ ID NO: 396022 - DNA, 614 bp, Homo sapiens
  misc_feature: GZ8MTXP01B549J.21.27.C05.1.454.CMB.2.raw
  modified_base (204)..(204): a, c, t, g, unknown or other
  modified_base (383)..(383): a, c, t, g, unknown or other
  modified_base (424)..(424): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctcctgcacagccagtcagtctatcgctgactggtagcctggtaccagcagaatctggccaggctcccaggctcctcatttaccgtgcaactcccaccgagggcccactgggtctccccagacctaggttcagtgggcggtggtaagtttggggctaggtacgtttttcncgtcaacccattccagccgtccctacgagtagttgaaagtnttgttgacttagtttattctgcctagtacctaattaattaattaccgtggtacctggtccgttcggaccggtttccggacccgtaaccgggggaaccttaaagggggttaacggaaatacccgtaaaacgttaaccgttgggacgggtctacgggcctaacccctattccttaacggtttcctttaaccg

SEQ ID NO: 396023 - DNA, 635 bp, Homo sapiens
  misc_feature: GZ8MTXP01ARW0R.21.27.C05.1.454.CMB.2.raw
  modified_base (262)..(262): a, c, t, g, unknown or other
  modified_base (300)..(300): a, c, t, g, unknown or other
  modified_base (378)..(378): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccgagtggggtgtcctgtcacagatcaaactacagcagtctggtccaggactggtgacggccctgcacgtaccctttcactcacctgtgacatcgtaccggggaaatgtcgngtggacaacaagtggtaggatggataggcacgtcccgngagacggtccttgagtggtcgtaggaacggtactaagtacgtacgtccgagtcggtatagaagtactatgaactagtnttcgtgtagacgtcgggttctacgtacaccactcccaacccgtacgacctacgtaacaacgtactcgaccgttcctcccctacctaacctaggggttctccgttagacccgtaccgtcccgacgaccgtacggtactttaacgttttacgtttgcgtaacaaagggttacggtacttccgtaaacgtcgttacgggttccactttaacccgtctaacggtaccgtccggttacgggtaacgttaacgggtttaaccg

SEQ ID NO: 396024 - DNA, 684 bp, Homo sapiens
  misc_feature: GZ8MTXP01D1K58.21.27.C05.1.454.CMB.2.raw
  modified_base (207)..(207): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccaccctgtctgtgtctccggaggggggacnccgcccaccctctcctgcacagccagtcagtctatcgctgacttggtacgcctaggtaccagacaagtaaactcgtcggacccgacggccctaccccgaggtcccttcccgtcttaacgtttaccgcgacctactccccgaccgacgggccctacggttcggtaccgtaccgagtacgtacggttcgagggttcgggtcggttaggtaagtttcggggaacgtagtttaccgttttcctacctaccgaacctacgttccgacgcccgtacccgtaagaggtaacgtagtaaacgtgtttcgtacgtacgttagttttacttcgcggacctaagtaactaaattattaaacgttccgtgtccgttaggtccgtaccggtacggttccggaaccggtaacgggtaaccaaagggttaacgaaacgtaacggaaacgttaggttcgttacgctcgaactacgtattccttcgttccttcc

SEQ ID NO: 396025 - DNA, 775 bp, Homo sapiens
  misc_feature: GZ8MTXP01BUKNF.21.27.C05.1.454.CMB.2.raw
  modified_base (199)..(199): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccacctgtctgtgtctcgagggggacncgccaccctctcctgcacacgccagtcagtctatcgctgacttgggttacgccgtaggtaccagtacaagaaactcgtacggcccgaacggcctaccccgacggtcccttcccttaccgttaacgttttacccggtcgaccctaaccttaccccgaaccggtacggggtcccctaacggttcgggtaccgtacccccgaaggtaccgttacgggttcccgaacgggttcggggtacgggttagggtacggttttacgggggaacttaacgggttacgtttttcctaccgttacccaacctacgtacgaccgacccgtacccgtaacgaagggtagtaaggtaaaggtagtttacggttacgtacgtttaacgttttacgttcgttaacggcccttaaggggtaacttaaattaacgttaaacgtttccggtcggtccgttacggtccggttacccggtaccgggttaccggaacccgggtaaaggtaacccgtaaagggttaacggtaaacaacggtaaaacgtcgttcggacgttctaacgacctaacgtacttccgttattccttcgtaacccg

SEQ ID NO: 396026 - DNA, 736 bp, Homo sapiens
  misc_feature: GZ8MTXP01CK18C.21.27.C05.1.454.CMB.2.raw
  modified_base (204)..(204): a, c, t, g, unknown or other
  modified_base (220)..(220): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgcccaccctctccngcacacgccagtcagtctagtcgtctagtacttgttacgccgtacgtaccagacaagtaactcgcggaccgacggcctaccgacgtcctcctactacgtttaccgcacctactacccgaccgacgggtcccacgttcggtaccgtacccgaggtaccgtaccggttcggagggttcggggtacgggttaggttaacggtttacgggaacgttaggtttacgtttccctacctaccaaccgtacgtacccgaccgtcccgtacccgtaagaggtaaggttagtaaagttgttacggttacgtacgtttagtttacttcgtacgtaccgtaagtaacttaaagtttaacgttaacgttccggtccggtaccgttcgggtaccgtaccgggttaccggtacccgggaaccggtaaaccggggtaaacggttaaagggtaaacgttaaaccgttaaccgtaacggttacgttcgggttacgtccgacgtaacctacgttgttacctttcgttcctttccg

SEQ ID NO: 396027 - DNA, 708 bp, Homo sapiens
  misc_feature: GZ8MTXP01EUYLL.21.27.C05.1.454.CMB.2.raw
  modified_base (227)..(227): a, c, t, g, unknown or other
  modified_base (295)..(295): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactgggtgaggcccctcgccagaccctttnactcacctgtgacatcgtaccgggggaaatgtcgctggacaacaagtggttaggaattggattaggcncgtccccgtgagacggccgttgagtggcgttagggaacggtaccttagttacgtacgtacccgtaggtcggtaagtaggtaaagactaagtggaacctaagtcgtttacgtagggtacgacggtccgggttcgtcgttaccaccctacgtcccaacccccgtagaaccctaccggtaaccaaagtaactaccgtaacggttcccctacccttaccaaccttaactcggttaacccttcggtaccctaacccgtaccccggtaacgtaacccgtaaccggttacctttaagggtttttacctttggttacgaacggtaaaggttacgggtacttaccgtaagtacgttcgggttcttaaccttcccttccgttcggtaccttccggttacggggtccgttaacggggttaaccg

SEQ ID NO: 396028 - DNA, 654 bp, Homo sapiens
  misc_feature: GZ8MTXP01EXWG3.21.27.C05.1.454.CMB.2.raw
  modified_base (203)..(203): a, c, t, g, unknown or other
  modified_base (240)..(240): a, c, t, g, unknown or other
  modified_base (304)..(304): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgntgactggttagcctggtaccagcagaaatctggccaggcctcccaggcctcctctatttaccgngcatccccaccgacggggccctacgttcggtcgtccccgagaccgtacgggtttcaggtcggggcggttgggtaagtttgggaactagggttaacgtttttcctctacctaaccctattccgacgccgtacccctaagtaggaagttagaaagtagtttgttgacttagttttaacttcgtagtacccagtactaaattaagttaacttaccgtcggtcccttacggtccggtacggtacccggttccgggccggtaaaccggggaacccgttaaaggggtaacggttaaactaacgaaacgttacggttgttacggctacgaactacccgagttctcgtttccttaacc

SEQ ID NO: 396029 - DNA, 576 bp, Homo sapiens
  misc_feature: GZ8MTXP01EZ1JA.21.27.C05.1.454.CMB.2.raw
  modified_base (204)..(204): a, c, t, g, unknown or other
  modified_base (399)..(399): a, c, t, g, unknown or other
  modified_base (434)..(434): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctcctgcacagccagtcagtctatcgctgactggttagcctggtaccagcagaaatctggccaggcctcccgaggtcctcctctactttacccgtgccaatccccaaccgacggggcccacgtcggttcgtccccagaccgtaggttcaggtgggcggtgggtaatttggggctaggtagttttcncttcgaccagtcacgcgaccctacagagtgaaagnttggtgcttagtttatttctgtaccagtactaaattaattaaacttacgcgggtcctgtcgtcgtacggttccggccggaacgggtaaccgaaaggtggaaatacgaaacgaacgttgttggctgcacgattctgttcttcg

SEQ ID NO: 396030 - DNA, 701 bp, Homo sapiens
  misc_feature: GZ8MTXP01AE6LD.21.27.C05.1.454.CMB.2.raw
  modified_base (160)..(160): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgacggccctgcacgtaccctttcactcacctgtcgacatcgtacgggaaatgtcgcgtggacaacagtggtggaattggataggcacgtcccgtgagacgtcctgagtggctaggaagtacctattactacgtccagtcgtatagagactatgactagtaattcgtagtgacgtcggtcgtctacgaccactccaccccgtagacctacgtaccaaacgaactccgacggttccctaccccgtacctaaacccgttaacggtcgttacccgttacggtaccctaacccgttaccccggaaccgtaaccggtacccggggttactttaaaccggttttttatttttacggtcggttaaccggtaaacgggttaacggggtaacttacccgtaaacgttaaccggtttccggttaccggttaacccctttaacccgttccggttaaccgtcccggttccgggttaccgggggtaaccgttaacgggggttttaaccccgg

SEQ ID NO: 396031 - DNA, 813 bp, Homo sapiens
  misc_feature: GZ8MTXP01C42IL.21.27.C05.1.454.CMB.2.raw
  modified_base (202)..(202): a, c, t, g, unknown or other
  modified_base (304)..(304): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgactggtagctggtaccagcagaatcgtggccaggcctcccgagtcctccctctactttaccgngcctactccccgaccgacgggggtcccaacgttcggtaccgtaccccgaggtaaccgtaacggggtttccaggggttcgggggtaccggggttaggggttaaacgtttttacgggggaaccgttaagggtttaccgttttttcccgtaccttacccgaacccttacgtacccgaaccggtccccgtaacccccgttaaacgaacggggtaacggtttaacgggaaaagttgtttaggtttacggtaccgtttaaggtttttaacctttcgtaccgtaccctaaaggtaaccttaaaatttaatttaaacgtttaccgtcgggtcccgtttacgggtccggttacccggtaccgggtttacccgggtaacccggaaaccgggggtaaacccgttaaagggggttaaacggaaacttaaacccggtaaaaccggttaacggttcgggttaccgggaaccttacggaacccgttaacccgtactttcccgttaacgtttcccttttaacccg

SEQ ID NO: 396032 - DNA, 555 bp, Homo sapiens
  misc_feature: GZ8MTXP01AB2Y2.21.27.C05.1.454.CMB.2.raw
  modified_base (158)..(158): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctccatggggtntcctgtcacagatcaaactcagcagtctggtccaggactggtgaggccctgcagacgctttcactcactgtgacatcgtacgggaaatgtcgctgacacaatggttgattggattaggcagtccccgtgagaggcctgagtggctttggaaggtacctattactacgtcccagtcgtatcgaagactataggactaaggtattcctgtgagtcggtcgtctcacatcaccccagacacgtcaagaactcaagtctaccctacaccgtaatcgtctacgtcactccgacggtacaacggtctagttttactttgaacgtacgaaggtacgggacgttcacgttaacgttcgggttactaactacccgtctttcgacgttccgtgggcccgttaagggg

SEQ ID NO: 396033 - DNA, 721 bp, Homo sapiens
  misc_feature: GZ8MTXP01AUPPV.21.27.C05.1.454.CMB.2.raw
  modified_base (205)..(205): a, c, t, g, unknown or other
  modified_base (324)..(324): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccggagggggacnccgcccaccctctcctgcacagccagtcagtctatcgctgactggtacgccgtggtaccagcaagaatcgtcggccacggccctccccgacggtcccttccctacttacgttttaccgngaccaacctccccgaaccggacggggccctacggttcggtccgtacccgacggtacgtacgggttcgagggtcggggtacggggttgggtaaagtttcggggaacttagggtttacgtttttcctctaccaactactcgacgccgtaccctaagaggtacggtagtaaagtgtttacgttagtacgtttaagttttacttacgtacggtacctaagtaaacttaaatttaacttaaagtttccgtcgtccgtacggtccggtaccggttaccggttaccggaccggtaacgggaaacgttaacgggtaacgttaaacgttaacccgaaaacggttacgttcgggttaccgtaacgtccggtaacctaccgttacttccgttcgttcccgttaacccg

SEQ ID NO: 396034 - DNA, 741 bp, Homo sapiens
  misc_feature: GZ8MTXP01E01O5.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggggacnccgccacctctcctgcacacgccagtcagtctagtcgctagtacgttggtacgccgtaggtacagacaagtaactcgtacggaccgacggtccctacccgacggtcccttacccttacttaacgtttacccgtcgacctaaccgtaccccgaaccggacgggaccctacggttcggtaccgtacccgagtaccgtacggttcgagggtcgggtacgggtaggttaacgttacgggaacttagggtttacgtttcctacctaccaacctacgtaccgacgtcccgtacccgtaagaggtaggtaaggtaaacgtagtttgttacgtacgtttagttttacttacgtacgtacgtaagtaacttaaattaacgttaacgttcgtcggtaccgttacggtccggttaccggtaccggttaccggacccggtaaacgggtaacggttaaagggtaacgttaaaccgtaaccggtaaaaccgttacggttcggttacggtaacgtacgaacctacctacgttaccgttccgttccgttaacg

SEQ ID NO: 396035 - DNA, 588 bp, Homo sapiens
  misc_feature: GZ8MTXP01C0BEI.21.27.C05.1.454.CMB.2.raw
  modified_base (157)..(157): a, c, t, g, unknown or other
  modified_base (367)..(367): a, c, t, g, unknown or other
  modified_base (370)..(370): a, c, t, g, unknown or other
  modified_base (391)..(391): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccatgggtntcctgtcacagatcaaactacagcagtctggtccaggactggtgacggccctcgcacgtacccctttcacctcacctgtgacatcgtaccggggaaatgtcgctggacaacaatggtaggtaattggattaggcagtccccgtgagaggctgagtgcgtggaagtacctattagtaccgtccgagtggtataggaaagctagtgaacatnttntgtgagtcggtcgtctcaccntaccacccagacacgtacaagactcacgtctccccgtacacctaatcgtctgtaccacgtcccgacgacgacgtcttaagttttagtttacgtgaacgtaaaggagggtacttacgtaacgtgtttacggttcgaaccctttaacgttccgttaagtccgtaccggttcgggtaacccgttaaggggttttaacccg

SEQ ID NO: 396036 - DNA, 663 bp, Homo sapiens
  misc_feature: GZ8MTXP01ESM6Q.21.27.C05.1.454.CMB.2.raw
  modified_base (203)..(203): a, c, t, g, unknown or other
  modified_base (240)..(240): a, c, t, g, unknown or other
  modified_base (253)..(253): a, c, t, g, unknown or other
  modified_base (425)..(425): a, c, t, g, unknown or other
  modified_base (451)..(451): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccacctgtctgtgtctccgagggggganacgcccacctctcctgcacagccagtcagtctatcgntgacttggttacncctggtaccagcaagaaatcgtcggccagggcctcccgaggtcctcctctaactttccgtgacctaactccccaaccggacgggccctacgtggtcctacccgaggactacggttccaggtggggcggtaggtagtttgggaactgtttacgtttctctacactatacgacnccaccctagaggtagtagtaaaggtntttagggttcgtacgttagttttactttcgtaccgtaccgtaaagtaccttaaattaacttaaacttcgtcggaacctttcggggccgttaccggtaaccggtttccggacccggtaaacgggtacccgttaaagggtacggttaaaactacggaaaacgaacgttggacgggtctacgtaacccgtctacttcgttaacgttccttaaccg

SEQ ID NO: 396037 - DNA, 841 bp, Homo sapiens
  misc_feature: GZ8MTXP01EMY43.21.27.C05.1.454.CMB.2.raw
  modified_base (202)..(202): a, c, t, g, unknown or other
  modified_base (215)..(215): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctcgaggggggacnccgccacctctcngcacacgcagtcagtctatcgctgtacgttggtacgccgtaggtacagacaagtaactcgtcggaccgacggtcctcccgacggtccttacccgttacgttacgttttaccgtcgtacctaccgtaccccgaccggaccgggtacctacggttcggtaccgtaccgaaggtacgtacggttacgaggggtcggggtcgggttagggttaacggtttacggggaacgttagggttttacgttttaccctccgtaaccctaaccgtacttacccgaaccggtacccgtaccccgttaaacggtaggtaaaggttaacggtaaagttacgtttacggttacgttactttaagtttttacgtttacgttaccgtaacggtaaacgttaaacttaaaacgtttaaactttaaacggtttacggttaccggttccgttacggggtcccggttaccgggttaccgggttacccggggaaacccgggtaaaccggggtaaaccggttaaaacgggggtaaacgttaaaaaaccgtaaaccggtaaaaaaccggttacggtttcgggttaccggtaaccgtaccggtaaccgtaaaccgttcggttacccgttttaacggtttaacctttaaccg

SEQ ID NO: 396038 - DNA, 698 bp, Homo sapiens
  misc_feature: GZ8MTXP01DPK43.21.27.C05.1.454.CMB.2.raw
  modified_base (201)..(201): a, c, t, g, unknown or other
  modified_base (251)..(251): a, c, t, g, unknown or other
  modified_base (303)..(303): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgccacagccagtcagtctatcgctgactggttacnccgtggtaccagcagaatctggccagcctcccaggctcctctactttaccgngcactcccaccgagggcccaacgtggtcgtaccccaggtactaggtttcccgagggtgggtcgggttggtaggttttacgggggaacttaagggttactttttcccgtaccttaccaacccgtattaccgacggcccgtacccgttaacgagggtagtaggaaagtagtttaggtttcgtacgtttaggttttacttcgtacgtacccgtaagttaacctaaaagtttaacttaaacgtttacggtcggttccctttaagggttcggttaccggttaaccggggttaccggacccggtaaccggggtaaaccgtaaagggttaacgggtaaaacttacgaaaacgtcgttcgggttcgacgtaacgacaactactcgttagttccttctaacccg

SEQ ID NO: 396039 - DNA, 646 bp, Homo sapiens
  misc_feature: GZ8MTXP01A529Z.21.27.C05.1.454.CMB.2.raw
  modified_base (204)..(204): a, c, t, g, unknown or other
  modified_base (243)..(243): a, c, t, g, unknown or other
  modified_base (452)..(452): a, c, t, g, unknown or other
  modified_base (569)..(569): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacncgcccaccctctcctgcacagccagtcagtctacgtcgntgtacgttggttacgccgttaggtaccagacaagtaatcgcggaccgacggtcctcccgagtcctccgtactacgtttccgcactacgtcccgacgacggcctacgtcggtccgtaccgagtacgtacggttgaggtggggtcggtggtaagttcgggaactagtttcgtttctacctacctacgtctaccgacgtccgtacccgtaanaggtaggtagtaaacgtgtttgtacgtactttagtttatttccacggactaagtaactaaattaattaacgtcgtcgtacctcggtcgtcgggtacgtcccgggacgaaccgggtanaaggtaacgttaacgaaaccgtaacgttacggttcggacgtaaccacgtccctactagttccgtcgttaacctaacg

SEQ ID NO: 396040 - DNA, 606 bp, Homo sapiens
  misc_feature: GZ8MTXP01D1596.21.27.C05.1.454.CMB.2.raw
  modified_base (206)..(206): a, c, t, g, unknown or other
  modified_base (243)..(243): a, c, t, g, unknown or other
  modified_base (420)..(420): a, c, t, g, unknown or other
  modified_base (433)..(433): a, c, t, g, unknown or other
  modified_base (452)..(452): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccacctgtctgtcgtcgtccggagggggcnccgccaccctctcctgcacagccagtcagtctatcgntgactgtagccgtgtaccagacaagaatcgtcggaccacggcctcccgaggtccctaccctactacgtttaccgcgtaccactccccgaccgacgggccacgtcggtcgtacccagacgtacggtcgaggtcgggtcggtggtaagtttagggcgtagttacgtttctctaccactntcacgctacctanagagtagaatagttcgttnacgttagtttattacgtcgtacgtaacgtactaaattataacgttctcgtcgtacgtcgtcggtacgttccggaccggaagggtacgaagggtacgaaacgtacggtaagttacgttgttacggtctacgctactagttcttcgttccttaacg

SEQ ID NO: 396041 - DNA, 837 bp, Homo sapiens
  misc_feature: GZ8MTXP01CU6X3.21.27.C05.1.454.CMB.2.raw
  modified_base (203)..(203): a, c, t, g, unknown or other
  modified_base (217)..(217): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtgtcgtccgaggggggacnccgccacctctccngacacgacgcctagtactagtctacgtcgtcgtaggtacgttaggtacgtccgttacggaaccagacaaagtaactccgtacggaccgacggtccctacccgacgtcccttaccgttacgttaacgtttaccgcgtacctaaccgtaccccgaaccggacgggtaccctacggttcggtaccgtacccgaaaggtaccggttaccggttacggaggggtcggggtacgggttaggttaacggtttacgggaactttacggtttaccgttttacctaccgtaccaaccgtacgtacccggacggtacccgtaacccgtaaggtaggtaaggttaacggtaaacgtttcgttacgtttacgtacgttttacgttttacgttacgtacgtaaccgtaaacgttaaacttaaacgtttaacgtttaacgtttaccggtacggttaccgtacggttaccggtaaccgggttaaccggttacccgggaaccggtaaaccggggtaaacggttaaacgggtaaacgttaaaaccgttaaaaccggaaacggttaccggttcggttaccgtaaccgtaacgtaacccttaaccgttacgttaccgtttaacgttaaccgtttaacccg

SEQ ID NO: 396042 - DNA, 673 bp, Homo sapiens
  misc_feature: GZ8MTXP01EZE0C.21.27.C05.1.454.CMB.2.raw
  modified_base (203)..(203): a, c, t, g, unknown or other
  modified_base (413)..(413): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggganccgcccacctctcctgcacagccagtcagtctatcgctgacttggttacgcctggtaccagcaagaaatcgtggccaggcctcccgaggcctcctactacgtttaccgtgacctactcccaaccgcggggcctacgtggtctacccgaaggacctaggtttccaggtcggggaggtaggtaaacgtttgggaactaggttagtttttccnctactaccgtatcccgacgcgtacccctagagtagtaggtaaatagtttggttagtacgttacggttttaatttccgtacggtacccgtaaggtaactaaacgtttaaagttaaactttaccggtacggtacccttcggtacccggttacggttaccgttacccgggaccgaaccgggtaaccgttaagggtaaacgttaaacgtaacgaaacgttacgttcggttacggctcgaactcgtattcttaacgttcgtaacc

SEQ ID NO: 396043 - DNA, 652 bp, Homo sapiens
  misc_feature: GZ8MTXP01AR1N7.21.27.C05.1.454.CMB.2.raw
  modified_base (161)..(161): a, c, t, g, unknown or other
  modified_base (238)..(238): a, c, t, g, unknown or other
  modified_base (296)..(296): a, c, t, g, unknown or other
  modified_base (300)..(300): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtntcctgtcacagatacaaactacagcagtctggtccaggactggtgacggccctcgcacgtacccttcactcactgtnacatcgtaccgggaaatgtcgctggacaacatggtaggattggattagcacgtcccgngagngctgagtggctggaagactatatacgtccagtgtactagaagactatgacagtaattcgtggtagacgtcggtcgtactaccgaccctacgtacccaaccccgaagaaccgaaccgttacccgaaacgtaacgttaccgaacggttcccttaccccgtacctaacccgttaaacgttcgtccttacggtaccctaccgttaccccgaccgtaacgtaccggtacgttaacgttttacgttttcgacgtaacgtaaaggttcgggtacttacgtaacgtacgttcggttacgttacccttaaccgttccttaacgtcccgttccggttacgggtccgttaacgggtttaaccg

SEQ ID NO: 396044 - DNA, 624 bp, Homo sapiens
  misc_feature: GZ8MTXP01BTIVW.21.27.C05.1.454.CMB.2.raw
  modified_base (447)..(447): a, c, t, g, unknown or other
  modified_base (487)..(487): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtgggtgtcctgtcacagatacaaactacagcagtctggtccaggactggtgacggccctcgcacgtaccctttcactcacctgtcgactagtcgtaccggggaaatggtcgcgtaggacaaacaagtggttaggtaagttaggagttaggcctacggtccccgtcggacggacggtccgttggagtggcgttaggaacgtacttattagtacgtccgagtcggtaataggaagtactatgactagtaattcgtgtgagtcgtcgtctcaccactccacccagacacgtacaanactcgacgtcctccctacctacctagtcgtctacgtaccnccgtacccgacgacgtaccggtcttagtttacgtttcgcgtaacgtaaggttagggtacttacgtactagttccgggttacttaccttaaccgtccgttcgccgttcggttccgggtaacgttaacgggtttaaccg

SEQ ID NO: 396045 - DNA, 642 bp, Homo sapiens
  misc_feature: GZ8MTXP01D3D5D.21.27.C05.1.454.CMB.2.raw
  modified_base (199)..(199): a, c, t, g, unknown or other
  modified_base (263)..(263): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggncgccacctctcctgcacagccagtcagtctatcgctgactggtagctggtaccagcagaatcgnggccaggcctcccgaggtcctcctctacttttaccgtgccaactcccaccgacgggccctacgtcggtctccccgagacgtacggtttccgagggttgggcggttggtagtttaggggactaagggttactttttcctccttaccacctactacgacgtccgtacccttagagtaggtagtaaagtagttgttgacgttagtttacttctaggaccctaagggtaacttaaattaacttaacgttacgtcggtcctcggtacggttaccggtaaccggttccggaccgtaacggggtaaccgtaaacgggttaggaaaacttaacgaaaccggtaacgttggttcggactaagccaacgtctcgttctcttaacgttcc

SEQ ID NO: 396046 - DNA, 776 bp, Homo sapiens
  misc_feature: GZ8MTXP01DTYTT.21.27.C05.1.454.CMB.2.raw
  modified_base (208)..(208): a, c, t, g, unknown or other
  modified_base (249)..(249): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtcgtcgtccggaggggggacnccgcccacccctctcctgccacacgccagtcagtctatcgntgtacgttggtacgccgtaggtaccagacaagtaactcgtcggaccacggccctccccgaggtcccttacctacgttaacttttacccggcgacctaccgtaccccgaaccggaccggggtccctacggttcggtacctacccgaaggtaccgtacggttcgtagggttcggggtacgggtaggttaacgtttaggggaaccgttaggtttaccgtttttacccaccttacccgaccgtaacgttcccgacgtacccgtaacccctaagtaaggaaggttaggtaaagttacgtttggttacgttacgttacgttttacttccgtacggtaccgtaagttaacttaaatttaaacgtttaacgttacggttcgtaccggtttacgggtaccggtttaccgggtaccgggttcccgggaaccgggtaaccgggtaacgttaaaggggtaacgttaaaacgtaacgtaaacggttacgttcgggttacgtcgtacgtaacctacgttacttcgttcgttcgttaacccg

SEQ ID NO: 396047 - DNA, 725 bp, Homo sapiens
  misc_feature: GZ8MTXP01BCQSD.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccgagtggggtgtcctgtcacagatacaaactacagcagtctggtccaggactggtgacggccctcgcacgtaccctttcacctcacctgtacactagtccgtaccggggaaatgtcgcgtggacaaacgaagtggttaggaagttggattaggccgtacgtccccggtagaggacggtccttggagtgggacgttagggaaacggtaccttaagttacgtaccgtacccgaggttaggtaacctaggaaagtactaagtgaacgtagttaattcgtaggtacgacggtccggttcgtacttaccacctacttacccgaacccgaacgtaacctaacgtaaccgaaagtaacgtaccgacggttaccctacccctactaaccttaagtcgttcgtaccgtaccacccgttccccgaacgtaccgtaaccgggttctttaacgttttacgttttacgcgaaccgtaaagggttagggtaacttacgtaaacgttacgtttaccgggttcttaaccttcccgttccgttaacgtaacccgtccgggttacgggtaaccgttaacgggtttaacccgg

SEQ ID NO: 396048 - DNA, 627 bp, Homo sapiens
  misc_feature: GZ8MTXP01D7SH9.21.27.C05.1.454.CMB.2.raw
  modified_base (350)..(350): a, c, t, g, unknown or other
  modified_base (355)..(355): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaatgtcgctggcaacaatggtgaattggattaggcagtccccgtgagaggccttgagtggcttggaaggactattatacgtccagtggtatgaagctangcagnttctgtgagcggtcgtctcaccatccacccagaccacgtaccaagaactcgacgtccctcctaccacctaagtcgtctcgttccacctcccgtacgactaaccgggtcttaagttttacgttttcgtggtaacgtaaacgggttaggggtaacttccgaaaccgttaacgttttccgggttacggttaacccttaaccccgtttcccgtttaacgggtaacccgttcccgggttacgggggtaacccgttaacgggggtttttaaacccggg

SEQ ID NO: 396049 - DNA, 709 bp, Homo sapiens
  misc_feature: GZ8MTXP01AZKU3.21.27.C05.1.454.CMB.2.raw
  modified_base (201)..(201): a, c, t, g, unknown or other
  modified_base (310)..(310): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggganccgccaccctctcctgcacagccagtcagtctatcgctgactggtacgccgtggtaccagcaagaatcgtggaccgaggcctcccgaggtcctcctactactttaccgngacctactcccgaccgacgggccctacggtcggttccgtaccccgagtaccgtacggtttcgagggtcggggtcgggttggtaaagtttgggggaacctagggtttaaccggtttttcctacccgttacaacccgtactaccgacgcccgtacccctaacggaagtaggtaaggtaaggtacgttggttacggtacttagtttttacgtttactcggtacctaagtactaaactttaattaaacgtttcgcggttcctacgggtccgtaccggttaccggttaccgggacccgtaacggggaaccgttaaaggggttaacgaaacgttaacggaaaacgttacgttcggttacgggccttaggaaccctactacgttcgttccgttaacctttaacccg

SEQ ID NO: 396050 - DNA, 613 bp, Homo sapiens
  misc_feature: GZ8MTXP01BOXKG.21.27.C05.1.454.CMB.2.raw
  modified_base (203)..(203): a, c, t, g, unknown or other
  modified_base (240)..(240): a, c, t, g, unknown or other
  modified_base (308)..(308): a, c, t, g, unknown or other
  modified_base (406)..(406): a, c, t, g, unknown or other
  modified_base (419)..(419): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgntgactggtagcctggtaccatcagaatctggccaggcctccccgaggcctccctctacgttttaccgngccaactcccaccgacggggccctacgtggtcgtcccagactacggttcaggtggcggtggtaagtttgggaactagtacgtttttcacgtcaacctntcacgcgccctanacgagtgaagtacttgttcgtatagtttattctcgcgtagactaaattaattaacttacgtcggtccgtggtccgttccggtaccgtttccgggcccgtaacgggggtaacaagggttacggaaacgtaaccgtaaaacgttaacgttcggttcgggtctacggtccaccgtacttccgtcgttccgtttaacc

SEQ ID NO: 396051 - DNA, 583 bp, Homo sapiens
  misc_feature: GZ8MTXP01EFOQ4.21.27.C05.1.454.CMB.2.raw
  modified_base (159)..(159): a, c, t, g, unknown or other
  modified_base (388)..(388): a, c, t, g, unknown or other
  modified_base (518)..(518): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccagtggggtntcctgtcacagatacaaactacagcagtctggtccaggactggtgacggccctcgacacgtacccttcactcactgtgactagtacgtaccgggaaatgtcgctaggacaacgaagtggtagtagttaggtattacggcgtacgtccccgtagaggaggtccgttggaggtggtacgttaggaacgtacttagttactacgtccgagtgtacagaagactatgacagtnttcgtggtagagtcggtcgtctacgactactaccaacccgagaccgacgtaacaagaactcgtacgtccctacctactaacctagtcgtctacctcgacctcccgactacgacgtcttattttagtttgngaagagaggattcgatcgttacggttcttactctctcgctcggttacggtcgttaaggttaaccg

SEQ ID NO: 396052 - DNA, 677 bp, Homo sapiens
  misc_feature: GZ8MTXP01B69MB.21.27.C05.1.454.CMB.2.raw
  modified_base (206)..(206): a, c, t, g, unknown or other
  modified_base (247)..(247): a, c, t, g, unknown or other
  modified_base (279)..(279): a, c, t, g, unknown or other
  modified_base (315)..(315): a, c, t, g, unknown or other
  modified_base (467)..(467): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcgtccggaggggggacnccgcccacccttctccgtgccacagccagtcagtctatcgntgacttggtagcctggtaccagcagaaatcgnggccaggcctccgaggtcctcctctacgtttaccgngacctactcccgaaccgacgggccctacgtcggtctacccgagacgtacgggttcgagggtcggacgggtaggtaagtttcggggaactggttacgtttttcacttccaacgtataccgacgtcccgaccctaagacgtaggtagaaaggtnttgttgtacgttagttttacttcgtacgtaccgtagttaacttaaatttaacttaacttacggtccggtacttacgggtaccggttacccggtaccgggttaccggacccggtaaacggggaaccgttaagggttaacgaaacgtaaaccgaaacgttacgttggttacggaacttacgcgtaacctgttacgttcgttcgtttaacccg

SEQ ID NO: 396053 - DNA, 721 bp, Homo sapiens
  misc_feature: GZ8MTXP01BF3G7.21.27.C05.1.454.CMB.2.raw
  modified_base (329)..(329): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccggaggggggacccgccaccctctcctgccacacgccagtcagtctatcgctgacttggtacgccgtaggtaccagacaagaactcgtcggaccaggtccctacccgaggtcccttcccgtacttaacgtttacccgngacctacgtaccccgaaccggacgggtccctacggttcggtacctaccccgaggtaccgttaacgggttccgaaggggttcggggtcgggttaggttaaagtttacggggaacttagggtttaccgtttttccacctaccgtaactacgttccgacgtcccgtaccccgtaagaggtaacgtagtaaagttgttgttacgtacttagttttacttcgtacgaccgtaagtaacttaaattaacgttaacgtacgtcggtacctcggtaccggtccgtaccggttccggaaccggtaacgggtaacgttaaaggggtaacgaaacgttaaccggaaacgttacgttggttacggtaactcgtaaccaacgtcgttacgtcgtttaaccgttcg

SEQ ID NO: 396054 - DNA, 725 bp, Homo sapiens
  misc_feature: GZ8MTXP01BYOZ8.21.27.C05.1.454.CMB.2.raw
  modified_base (202)..(202): a, c, t, g, unknown or other
  modified_base (239)..(239): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtgtctccgaggggggacnccgccacctctcctgcacacgccagtcagtctatcgntgtacgttggtacgccgtacgtacagacaagtaactcgtcggaccgacggcctacccgacgtcctccgtactacgtttaccgcgtacctactaccccgaaccggtacgggtccctacggttcggtaccgtacccgaagtaccgtacggttcgagggtcgggtcgggttaggttaacgtttacgggaacttaggtttacgttttcctaccgtacctaaccgtacgtacccgacgtacccgtacccgtaacgacggtaaggttaacgaaacgttacgtttacggttacgtacgttagttttactttcgtacgtacgtaacgttaactaaattaacgttaacgttacgtccggttaccgtcggtccggtaccggtaccggttccggaacccggtaacgggtaaccgttaaagggtacgttaaacgtaaccgtaaacgttacgttcggttacggtctacgaacctacctacgttcttcgttccgtaaccg

SEQ ID NO: 396055 - DNA, 628 bp, Homo sapiens
  misc_feature: GZ8MTXP01DAIMO.21.27.C05.1.454.CMB.2.raw
  modified_base (201)..(201): a, c, t, g, unknown or other
  modified_base (249)..(249): a, c, t, g, unknown or other
  modified_base (386)..(386): a, c, t, g, unknown or other
  modified_base (426)..(426): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttancctggtaccagcagaatctggccaggcctcccaggcctcctcatttaccggccactcccaccgagggccctagtggtctcccagactaggttccaggtgggcggtggtagtttcggggactaaggttacgtttttcnctccgacctatcgacgccgtaccctagacgtagtgaaagngttagttgtcgttagtttattctacgaccaaggtactaaattaattaacgttacgtggtcccttaggtccgtccggtaccggttccggacccgtaacggggtaaaccgtaaaggggttacggtaaaacttacgaaaaccggtacgttagggttcggttaccgtcggacctaaccgtactcgttacgttccgttcgtaacccg

SEQ ID NO: 396056 - DNA, 776 bp, Homo sapiens
  misc_feature: GZ8MTXP01CG4XN.21.27.C05.1.454.CMB.2.raw
  modified_base (206)..(206): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtcgtcgtccggaggggggaccnccgccctaccctctccgtcgacacgacgacctagtactagtctagtcgcgtagtacgttggtacgccgtacgaccagacaagtaacgtcgacggaccgacggtccctccgagtccttcctactacgtttaccgctacctacgtacccgacggtacggccctacggtcggtaccgtaccgaaggtacgttacgggttcggaggggttcggggtacgggttaggttaacgggttacgggtaacgttacggttttaccgttttaccctacctaaccgtaaccgtacgtacccgaaccgtacccgtaaccgtaaaggtaggtaaggttaaggtaagttagttacgttacgtacgtttacgtttacttcgtacgtaacgttaaagttaaacttaaagttaacgttacgttacgtcggtaccgttacggtaccggtaccggtacccggtaccgggaaccggtaacgggtaaacggttaaaggtaaacgaaacgtaaaccggtaacgttacggttcggttacggtaaccgtaccgtaaccttaccgttacgttaccgtttccgttaaccgttaaccg

SEQ ID NO: 396057 - DNA, 599 bp, Homo sapiens
  misc_feature: GZ8MTXP01A09TF.21.27.C05.1.454.CMB.2.raw
  modified_base (299)..(299): a, c, t, g, unknown or other
  modified_base (359)..(359): a, c, t, g, unknown or other
  modified_base (505)..(505): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatcgtaccggggaaaatgtcgctggcaacaatggtggaattggattaggcagtccccgtgagnggccttgagtggcttggaagacctattatacgtcccagtggtatgaagactatgacagtnttctgtgagcggtctcgtcaccactccaccccagacacgtaccaagactcgacggtccctccctacctaacccttaagtcgttactcgtacctaccgtcccgacgacgtacggtcttaacgttttagttttcgtgaacgtaaaggngggtaacttcgtaaactgttaccggttcgttaccttaacccgttccgttcgtaccgttccggttacggggtcccgttaaggggtttaaccccgg

SEQ ID NO: 396058 - DNA, 616 bp, Homo sapiens
  misc_feature: GZ8MTXP01DOD0G.21.27.C05.1.454.CMB.2.raw
  modified_base (225)..(225): a, c, t, g, unknown or other
  modified_base (528)..(528): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaaactacagcagtctggtccaggactggtgaggccctcgcagaccctttnactcacctgtgacatcgtccggggaaaatgtcgctggacaacaatggtggattggattaggcagtccccgtgagaggccttgagtggcttggaaggactattatacgtccagtcggtatgaaagactatgacagtaattcgtgtgagtcggtcgtctcgaccctacacccaacacgacctacgtaaccgaagtaactacgacgttcccctcctaccctaacctaacgttcggttcttacgtaccgtacccgtacccgacgacgtaaccgtacgtttagttttattgtcaacggaagacggtanacgtacgttcgttacggttcttacccgttaacttaccgtaacgttcccgtacggttaccgggtaaccggttaacgggttttaaccggg

SEQ ID NO: 396059 - DNA, 772 bp, Homo sapiens
  misc_feature: GZ8MTXP01BOGFG.21.27.C05.1.454.CMB.2.raw
  modified_base (203)..(203): a, c, t, g, unknown or other
tcagtcgtcgctcgcacgaccggtgctcgatttagacgcgatcgaagggtttgggggaggaactgctcagttaggacccagacggagccatggaagcccagcgcagcttctcttcctcctgcttctctggctccagacaccactggagtgattgtgatgacgcagtctccagccacctgtctgtcgtctccgagggggggacnccgcctacctctcctgacacacgccagtctagttctacgtcgtctcgtacgttggtacgtccgtacggtacacgacgaagtaacgtcgtacggaccgacggtcctacccgacggtccttacctacttaccgtttaccgcgtacctaccgtacccgaccggaccgggtacctacggttcggtaccgtaccgaacggtacgtacggttacggtacggggtcggggtcgggttagggttaacgggtttacggggaacgttacgggtttacgttttcctccgtacctaactacgtaccgaccgtacccgtacctaaggtacggtaaggttaaggtaagttacgtttcggttacgttacgtttacgttttacgttacgtacgtacggtaaattaaacttaaacttaacgttaacgttaccggtcggtcgttacggtccggttaccgggttaccgggtacccgggaaccggtaaacggggtaacggttaaagggtaaacggttaaacgtaaaccggtaaacgttacggttcggcgtcgtacgtaacctacgtacgttcttaacgttccttaaccg

SEQ ID NO: 396060 - DNA, 754 bp, Homo sapiens
  misc_feature: GZ8MTXP01B74DK.21.27.C05.1.454.CMB.2.raw
  modified_base (241)..(241): a, c, t, g, unknown or other
  modified_base (316)..(316): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtgtctccggaggggggacccgcccaccctctcctgcacgagccagtcagtctatcgntgactggtacgcctggtaccagacaagtaaatcgtggaccaggcctcccgaggtccttcctactacgtttaccgngacctaactccccgaccgacgggtccctacggttcggtaccgtaccccgaggtaccgtacgggtttccgaggggttcggggtacgggttaggttaaacggttttcggggaacgttagggtttacgtttttcccactacctaaccgtactccgaacgtcccgtaccccttaaagacggtaaggttaaggtaaagtgtttaggttcggtactttaaggtttttcgtttaccgtacggtaacccgtaaggttaacttaaatttagttaaaccgttccggtcggtaccgttcggtaccggttaccgggtaccgggtttccgggaacccggaaaccgggggttaaacgaaaggggttaaaccggaaacgtaaaccgaaacggttacggttcggttacggtaacgtcggaacctaaccgttcttccgttaacgtttcctaaccg

SEQ ID NO: 396061 - DNA, 767 bp, Homo sapiens
  misc_feature: GZ8MTXP01DCVZ9.21.27.C05.1.454.CMB.2.raw
  modified_base (199)..(199): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctcgaggggggnccgccaccctctcctgccacacgccagtcagtctagtcgctgacttggtacgcctggtacagacaagaactcgtcggccaggcctaccccgaggtccttcctacctacgtttacccgtgacctactccccgacccgacggggtccctacggtgggttaccgtacccccgtaagtaccgtacgggttaccgaggggtcggggtacggggttagggtaacgttttaacgggggaacttaagggttacgttttttaccctctacccgtaacctacgttaccgacgacccgtaccctaacgaggtaagttaggaaacgtagttcggtttacgtacgtttacggtttactttacgtaccgtacccgtaaagggtaaccctaaaattttaaacgtttaaacgttaccggttacgtcccgttcggtacccggtttaccggtaccgggtttacccggaccggtaaccggggtaacccgtaaagggttacgggtaaaacgttacgtaaaaccggtacgttcggttcgttccgtaacggacctaaccgtactcgtttacgttccgttctttaaccccg

SEQ ID NO: 396062 - DNA, 737 bp, Homo sapiens
  misc_feature: GZ8MTXP01AD66F.21.27.C05.1.454.CMB.2.raw
  modified_base (202)..(202): a, c, t, g, unknown or other
  modified_base (218)..(218): a, c, t, g, unknown or other
tcagtcgtcgctcgcacgaccggtgctcgatttagacgcgatcgaagggtttgggggaggaactgctcagttaggacccagacggagccatggaagcccagcgcagcttctcttcctcctgcttctctggcctccagacaccactggagtgattgtgatgacgcagtctccagccacctgtctgtgtctccgaggggggacnccgccctacctctccngaccacgacgacctagtcagtctagtccgtctcgtacgttggttacgccgtacggtaccagacgaagtaactcgtacggaccgacggcctccgacgtcccttccgtacttaacgtttaccgcgacctacctaccccgaaccggacgggtaccctacggttcggtaccgtaccgaagtacgtacggttcggtaggggtcggggtacgggttaggtaacggtttacgggtaacgttacggtttaccgttttcctacctacctaacctacgtaccgaccgtacccgtaacccgtaagtaaggtaaggttaaggtaaacgtcgtttcggttacgttaacgtttagttttacgttcgtacgtaaccgtaagtaacttaaattaaacgttaacgttacgtcggtaccgttcggtaccgttaccgtaccgggtccggaaccggtaacggaacgttaaggtaacgaaacgtaacggtaaacgttacgttcgttacgcgtacaacctactcttcgttaacgttcgtcg

SEQ ID NO: 396063 - DNA, 757 bp, Homo sapiens
  misc_feature: GZ8MTXP01A6YCY.21.27.C05.1.454.CMB.2.raw
  modified_base (203)..(203): a, c, t, g, unknown or other
  modified_base (250)..(250): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatcgctgactggtancctggtaccagcagaatctggccaggcctcccgaggcctccctactactttaccgtgcctactccccaccgtacggggccctacgtcggtccgtaccccgaaggaccgtaacgggtttccgaagggttcggggtaccgggttagggggttaagttttcgggggaacgtagggtttaacgttttttcccaccgttaccgaaccctagttcccgacgtacccgtacccctaaacgacggtaaggtacgtaaacggtaagttggtttagtaccgtttaagttttacgtttcgttacggaccctaaggtaacctaaagttaatttaaacgttacgttacgggtccttacgggtccgttacccggtaaccgtttcccgggaacccggtaacccggggtaaccggttaaacggggttaaacggaaaaccggttaaccgaaaaacggttaccggttaagttacgggaacgttacggaacctacccgtaacggttcctttcgttccgtttaaccc

SEQ ID NO: 396064 - DNA, 616 bp, Homo sapiens
  misc_feature: GZ8MTXP01AYOKM.21.27.C05.1.454.CMB.2.raw
  modified_base (160)..(160): a, c, t, g, unknown or other
  modified_base (296)..(296): a, c, t, g, unknown or other
  modified_base (351)..(351): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactcagcagtctggtccaggactggtgacggccctgcagtaccctttcactcacctgtgactatcgtaccggggaaaatgtcgctggcaacaatggtggaattggattaggcagtcccgngagagctgagtgctggagactatatacgccagtcgtatgaagactatgactagtnttctgtagacgtcggtcgtctaccaccactccaacccagtaaccacgtaccaaagtaactcgaacggttccctaccctacctaacctaagtcgttctacgtacccaccgtcccgacgaaccgacgggtacttagttttaacttttggcgaaccgtaaaggcgggtaacttccgtaaacgtcgtttacgggttcttacccgttaaccccttcgttaacgaaccgttccccgggttaggggtaaccccgttaagggggtttaacccg

SEQ ID NO: 396065 - DNA, 621 bp, Homo sapiens
  misc_feature: GZ8MTXP01AZ0I4.21.27.C05.1.454.CMB.2.raw
  modified_base (364)..(364): a, c, t, g, unknown or other
  modified_base (371)..(371): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccgagtggggtgtcctgtcacagatacaaactacagcagtctggtccaggactggtcgacggccctcgcacgtaccctttcacctcacctgtgactagtcgtaccgggaaatgtcgctggcaacaagtggtggtaatggattaggctacgtcccgtgagacggcctgagtggcgttaggaagtactattatacgtccagtgtatagaagactangacagtntctgtgagtcggtctctcgactactcacccgtagaccagtaccaagtactccacggtccctaccctacctacttaacgtcgtctcgtacctacccgtacccgtaccgacgtaccggttacttaagtttttacgtttcgaggtaacctaaagggttacggtacttcgtaaactacgtttcgggttacttacctaacctttccgtaagtccccgtacgggttcgggtaaccgttaacggggttttaacccgg

SEQ ID NO: 396066 - DNA, 631 bp, Homo sapiens
  misc_feature: GZ8MTXP01DVCSE.21.27.C05.1.454.CMB.2.raw
  modified_base (361)..(361): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggactgggtgacggccctcgcacgtacccctttcactcacctgtcgactagtccgtaccggggaaaatgtcgctggcaacatggtgatgatgcagtcccgtgagagcctgagtggcttggaaggacctattatacgtccagtgtactgaagactatgaacagtnttacgtgtgagtcggtcgtctacacactccaacccagacacgtaccaagatcaagtcctacccacacctaatcgtactcgtcacctacccgacgaaccgtacggtaccgtagttttaccgttttagtcggtaaccgtaaacggttaaggggtacttacctaaaccgttacggtttaccggggttcttaaccccttaacccgggttaaccctttcggtacccgttaccgggttacgggggtaacccggttaaggggggtttttaaaccccg

SEQ ID NO: 396067 - DNA, 779 bp, Homo sapiens
  misc_feature: GZ8MTXP01C2O0K.21.27.C05.1.454.CMB.2.raw
  modified_base (204)..(204): a, c, t, g, unknown or other
  modified_base (276)..(276): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggcctcccagacaccactggagtgattgtgatgacgcagtctccagcccaccctgtctgtgtcgtccggaggggggnccgcccaccctctcctgcacagccagtcagtctatcgctgacgttggtacgcctggtacagacaagaatcgnggccacggcctccgacggtccttcctactatttacccggccactcccaccgacgggtccctacgtcggtcgacccagacgtacggttccaggggtgggtcgggtagggtaggttttacgggggaacttaagggtttacgtttttccctaccttaccgaaccctacgttaccgaccggtacccgtacccgttaacgaagggtaaggttaggaaaggtagtttggtttacgttacgtttaacgtttttaacgttccgttaacgacccgttaaagggttaaccttaaaagtttaaacgtttaaaccgtttaccgtccggtacccgttcggttacccgggttaccggtacccggggttacccgggacccggtaaaccgggggtaaacccgtaaaggggttaaacggtaaaaccgaaccggttaaaaaaccggtcgttacgggttacggttaccgtaaccggtacctaaccgttcttcgttaccgtttccgttaaccgtttaaccccg

SEQ ID NO: 396068 - DNA, 708 bp, Homo sapiens
  misc_feature: GZ8MTXP01C1T8M.21.27.C05.1.454.CMB.2.raw
  modified_base (203)..(203): a, c, t, g, unknown or other
  modified_base (316)..(316): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccggagggggggcnccgacctcctcctcgcgacacgccacgtacgtacgtacttatcgtcgtacgtacgtaggttacggtaccgtcggtacgacgacgaacgaagtacgtcggccgacgacgtcccncggccgtcctctacgttaccgttcgcgactacccgacgacggcgtacccgtggtcgtcccgacgtacgtacggttacgtacggtcggggtgggttagggtagtttcgggtaacggtacgttaaggttttccttccgtacctacccgtactcgacgtcccgtaccctaagtaggagtacggtaagtaattggttagttactaaggttttcttacgtcggtaccgtaagtagttaaacttagtttaaacgttccggtgtacccgttgtaccggttacccggtacggtcccggaccgggaccggtaaccggtaaaggtaggttaaacgaccttaaagtcgtagttcggcttacggaacctaccgtaattcgtccgttcttaacaaccgtttcccc

SEQ ID NO: 396069 - DNA, 590 bp, Homo sapiens
  misc_feature: GZ8MTXP01BW71C.21.27.C05.1.454.CMB.2.raw
  modified_base (203)..(203): a, c, t, g, unknown or other
  modified_base (306)..(306): a, c, t, g, unknown or other
  modified_base (395)..(395): a, c, t, g, unknown or other
  modified_base (407)..(407): a, c, t, g, unknown or other
  modified_base (413)..(413): a, c, t, g, unknown or other
  modified_base (423)..(423): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctccccgaggcctcctctactttaccgngcactcccaccgacgggcccacgttggtcgtacccagacgtacggttccaggtgggcggtggtaatttcggggaactagtacgttttcnctcacatcagcnccctangagtagagtntgtgagtagtttattcgtgaccgagtactaaattattaacttcgtcggtacctggccgttcgaccggttccggccggaaacggggaaccttaaaggggtacgaaacgtaacgaaacggttaacgttggttggaacctgaaccgtactacgttctcgtttcttaaccg

SEQ ID NO: 396070 - DNA, 648 bp, Homo sapiens
  misc_feature: GZ8MTXP01C5L5H.21.27.C05.1.454.CMB.2.raw
  modified_base (200)..(200): a, c, t, g, unknown or other
  modified_base (236)..(236): a, c, t, g, unknown or other
  modified_base (247)..(247): a, c, t, g, unknown or other
  modified_base (271)..(271): a, c, t, g, unknown or other
  modified_base (294)..(294): a, c, t, g, unknown or other
  modified_base (388)..(388): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctcagccacctgtctgtgtctccgagggggacncgccaccctctcctgcacagccagtcagtctatcgntgacttggtanctggtaccagcagaaatctgaccnggctccagctcctcatttaccgncactccgacgacgggccacgtggtcgtacccaggacctaggtttccgaggttcgggcggttggtaacgtttggggaactaggtacgtttttccncttacaccgtattccgacgccgtaccctaagaggaagttagtaaacggtagtttaggttcgactttaaggttttactttcgtacggtacctaagtaacctaaattacttaagttaccgtcggtccgttcggtacgttaccggtaaccggtttccggaacccggtaaccgggtaaccgaaaggggttacgttaaaacgtacgaaaacggttacgttggacgggtcctaggaaccctaacgtcttaccgtttcgttccgttc

SEQ ID NO: 396071 - DNA, 665 bp, Homo sapiens
  misc_feature: GZ8MTXP01DNT0U.21.27.C05.1.454.CMB.2.raw
  modified_base (252)..(252): a, c, t, g, unknown or other
  modified_base (308)..(308): a, c, t, g, unknown or other
  modified_base (401)..(401): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccggaggggggacccgccaccctctcctgcacagccagtcagtctatcgctgactggtacncgtggtaccagcaagaaatctggccaggcctacccaggcctcctctactttaccgngacctactccaccgacgggccctacgtggtcgtacccagacgtacggttcgaggtgggtcggtggtaagtttgggaactaggttacgttttcncctaccacctatacgacgccgtaccctaacgaggtagttagaaagtacttaggttagtacttagttttactttcgtacggtacctaagtacctaaagtttaataaacgtttaccgtcgggtcctacggtccgttaccgggtaccggtttccggaacccggtaaccggggtaaacgaaagggttaacggaaacgtaaccggtaaacggttaccgttggttacggaacctaggaaccctactagttcgttaacgttctttaacccg

SEQ ID NO: 396072 - DNA, 781 bp, Homo sapiens
  misc_feature: GZ8MTXP01A1PH1.21.27.C05.1.454.CMB.2.raw
  modified_base (208)..(208): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtcgtcgtccggagggggggaccnccgccctaccctctccgtcgaccacgacgcctagtctagtctagtcgtcgtagtacgttggtacgtccgtacggacagacaagtaactcgtcggaccgacggccctaccgtacgtccttcctacgttacgtttaccgcacctaccgtacccgaccggacggtaccgtacggttcggtaccgtaccgacgtacggttaccgggttacggacggggttcggggtacgggttagggttaaacggtttacgggtaacgtttacggttttaccgttttacctaccgtacctaccgtacgtacccgaccgtacccgtaacccgtaaggaacggtagtaaggtaaggttgttacggttacgttacgtttagttttacgttacgtacgtaaccgtaagttaacttaaagttaacgttacgttccgtcggttaccgttcggttaccggttaccggtacccgggttaccgggaaccggtaaaccgggtaacggttaaaggtaaaccgaaacgtaaaccggtaaacggttacgttcggttcgtaaccgtcgaacctacgtacgttaccgttcgttcccgtaacg

SEQ ID NO: 396073 - DNA, 575 bp, Homo sapiens
  misc_feature: GZ8MTXP01D7XML.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaatgtcgctggcaacaatggtgatggattaggcacgtcccgtgagagccttgagtggcttaggaaggtacctagttatacgtccagtcgtactagaagactagtgaacagtaagtctggtgtagtcggtcgtctacaccatccaacccagacacgtaccaagtatcacggtcctaccctacgaaccttaagtcggtactcgtaccacctcccgacgacgtacggtctaggttttactttggtgaactaaggacggtattcgactagttcggttcttaaccgtccttcgtcgtacgtccgttaggggccgttaagggtttaaccg

SEQ ID NO: 396074 - DNA, 641 bp, Homo sapiens
  misc_feature: GZ8MTXP01E0GHW.21.27.C05.1.454.CMB.2.raw
  modified_base (159)..(159): a, c, t, g, unknown or other
  modified_base (231)..(231): a, c, t, g, unknown or other
  modified_base (306)..(306): a, c, t, g, unknown or other
  modified_base (373)..(373): a, c, t, g, unknown or other
  modified_base (399)..(399): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtntcctgtcacagatcaaactcagcagtctggtccaggactgggtcgagggcccctcggcacggtacccctttnaacttcacctgtcgactatcgtaccggggaaaatgtcgctggacaacagtggtgattggattaggcagtccccgngagagctgagtggcttggaggacctagttactacgtccagtggtactggaaatacgtatgactagtnttctggtgacgtcgggtcgtctcacnctacaccccagacacgtaccaaagtacacgacgtccaccttacaacctaagtcgtacgtctcctaccgtcccgaacgtacgaaccggtcgttaaacgttttgttttagcgaacgtaaagggttaccgggtatttaccgaacgttaacggtttccgggttattaaccccggttaaccttcccgttttaacggaacccgttccgggttcgggggtaacccgttaaacggggggttttaaccccg

SEQ ID NO: 396075 - DNA, 709 bp, Homo sapiens
  misc_feature: GZ8MTXP01EEO67.21.27.C05.1.454.CMB.2.raw
  modified_base (208)..(208): a, c, t, g, unknown or other
  modified_base (229)..(229): a, c, t, g, unknown or other
  modified_base (246)..(246): a, c, t, g, unknown or other
  modified_base (318)..(318): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccaccctgtctgtgtcgtccggaggggggacnccgcccaccctctcctgcacngccagtcagtctatcgntgacttggtagcctggtaccagcaagaatcgtggaccacggcctcccgaggtcctcctactacgtttaccgngaccactcccgaccgacgggcctacgtcggtcgtacccgagtacgtacggttcgagggtcgggtacgggttagggtaacgttttaggggaactaggtttacgtttttccctacctacctaacctattccgacgcccgtacccgtaagacgtaaggtagaaagttgttagttacgtacgttagtttacttcgacgactaagtaactaaattaacttaagttcgtacggtccgttaggccggttaccgggtaccggttaccgggaacccgggtaaaccggggtaaacggttaaaggggtaaacggttaaaacgtaaaccggtaaaacggttaccggttgggttacggtaactacggtaacctaaccgtacgttacttccgtttccttaacccg

SEQ ID NO: 396076 - DNA, 517 bp, Homo sapiens
  misc_feature: GZ8MTXP01B4G5E.21.27.C05.1.454.CMB.2.raw
  modified_base (201)..(201): a, c, t, g, unknown or other
  modified_base (248)..(248): a, c, t, g, unknown or other
  modified_base (289)..(289): a, c, t, g, unknown or other
  modified_base (298)..(298): a, c, t, g, unknown or other
  modified_base (368)..(368): a, c, t, g, unknown or other
  modified_base (381)..(381): a, c, t, g, unknown or other
  modified_base (386)..(386): a, c, t, g, unknown or other
  modified_base (389)..(389): a, c, t, g, unknown or other
  modified_base (402)..(402): a, c, t, g, unknown or other
  modified_base (496)..(496): a, c, t, g, unknown or other
  modified_base (505)..(505): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaatctggccaggctcccgaggctcctnatttaccgngcatccaccagggcccacgtggtctcccagcaggttccaggtggcggtgagtttgggactgtagttttcnctcacatcagccncctanagngtgaagattgttnctagttattcagccaggtctaaattactaattacgtgcctggccgtcgtcgttcgccgacgggccaaagggttgaaacttcgaaacgacttggngctgcaacntcttgtcttgtc

SEQ ID NO: 396077 - DNA, 594 bp, Homo sapiens
  misc_feature: GZ8MTXP01BMAJ4.21.27.C05.1.454.CMB.2.raw
  modified_base (369)..(369): a, c, t, g, unknown or other
  modified_base (491)..(491): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgacggccctcgcacgtaccctttcactcacctgtgacagtccgtaccggggaaatgtcgctggcaacaatggtggaatggattaggcagtccccgtgagaggccttgagtggcttggaaggaccttattactacgtcccagtggtactaggaagtactatgaacagnttctggtgagtcggtcgtctcaccatccacccagaccacgtaccaagactcacgtcctccctaccacctaagtcgtctcgtaccacctcccgacgaccgtacggtcttagtttactttcggngtaaccgtaaggagggtacttcgtaacgtacgttcggttacttaccgttaacctccgtttcgaccgttccggttcggggtaaccgttaaggggtttaacccgg

SEQ ID NO: 396078 - DNA, 733 bp, Homo sapiens
  misc_feature: GZ8MTXP01DY81J.21.27.C05.1.454.CMB.2.raw
  modified_base (242)..(242): a, c, t, g, unknown or other
  modified_base (615)..(615): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgccgtgctgggcctcccagtggggtgtcctgtcacagatacaaactacagcagtcgtggtccaggtacgtggtcgacggccctcggcacgtaccctttcactcactgngacagtacgacggggtaaatgtcgcgtggactaaacgaagttgggttaggtaagttaggtagttacgggccgtacggttcccccggtaggaacggtacggtcccgttgggacggttgggtacgttagggtaaacggtaacccttaagttacgtaccgttaccgtaggttacggtaataggtaaagacgtagtcgtaaacgtacttaagttcgtgggtaggtacgtccggttacgtctacccgacctacgtccccaaccgacgacctaccgtacgaaacgtactaccgtacgttaccctccctacctactacgttcgtcgtactaccgtaccgtcccgaacgtacgtaaacggttcgtttagttttagtttcgnggtaactaagggttaggtacttaccgtaacgttacgtttaccggacgttacccttaacccgtcgttaaccggtaccggtcggggttaccggggtaacccgttaaggggtttaacccgg

SEQ ID NO: 396079 - DNA, 619 bp, Homo sapiens
  misc_feature: GZ8MTXP01DBQ1O.21.27.C05.1.454.CMB.2.raw
  modified_base (201)..(201): a, c, t, g, unknown or other
  modified_base (296)..(296): a, c, t, g, unknown or other
  modified_base (414)..(414): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactgtagcctggtacagcagaaatctggccaggctcccaggctcctctatttaccgngcatcccacgacgggccacgtggtctcccagacaggttccaggtggcggtggtaagtttgggctagttacgttttcctcgtcacctattccagccgtaccctagagagttagaaagtnttagttgtaccttagttttactttcgtagacctaagtccttaaaatacttaaatttaccgtggtccttacggtcggttccggtaaccggtttaccgggacccgtaaaccggggtaaccgaaagggttacggaaaacgtaacccgtaaaacggaacgttgggttacggcttacgcctaacgtacttccgttcggttcctttaaccg

SEQ ID NO: 396080 - DNA, 730 bp, Homo sapiens
  misc_feature: GZ8MTXP01CYVRV.21.27.C05.1.454.CMB.2.raw
  modified_base (204)..(204): a, c, t, g, unknown or other
  modified_base (219)..(219): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaacactggagtgattgtgatgacgcagtctccagccacctgtctgtgtcgtccgaggggggacnccgcccacctctccngacacgacgccagtcagtctacgtcgctagtacgttggtacgcgtacggacagacaagtaactcgacggaccgacggccctacccgacgtcccttacctacgttacgtttaccgcgacctaaccgtaccccgaaccggtacgggtaccctacggttcggtaccgtacccgaaggtaccggttaccggttcggtaggggtcggggtacggggttaggttaaacggtttacgggaacgttaggtttaccgtttcctaccgtacctaccgtacgtccgaccgtcccgtaacctaagaggtagtaagtaagttgttgttacgtacgtttagtttacttcgacgtacgtaagtaacttaaattaacgttaacgttccgtcggtaccgttacggtaccgttaccgggtaccggtacccggaaccgggtaacggggtaaacgttaaagggtaacgaaacgtaacggtaaacgttcgttcggacgtaacacgaacctactacgttcgttcgttcctaac

SEQ ID NO: 396081 - DNA, 769 bp, Homo sapiens
  misc_feature: GZ8MTXP01BTPTR.21.27.C05.1.454.CMB.2.raw
  modified_base (160)..(160): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactgggtgacggccctgcagtacccttcactcactgtgacatcgtaccggggaaatgtcgctgacaacgatggtagatggataggcacgtcccgtgaggacgcttggagtggcgttaggaacggtactaattacgtaccgtccgtaggtacggtataggaagtacgtagtcgtaacgagtaagttcgtaggtaggtacggtccggttacgttcgtaccctaacgtacctaccgaaacccccaggtaaccctaaccggtaaccaaacgtaacgttaccgtaacgggtacccttaacccctaccttaaacccgttaaacggttaccggttacccgttaccgtaacccgtaaccccgtacccccgggtaacggtaacccgttaaacccggggttcgtttaaacgggtttttaacgttttacgggtacggtaaacggttaaacgggttacgggtaaacccttagggtaaaccgttacggtttaccgggttaccgttaaacccgtttaacccgttccgttaacggttacccggtacgggttaccgggggtaaccggttaacgggttttaacccgggg

SEQ ID NO: 396082 - DNA, 628 bp, Homo sapiens
  misc_feature: GZ8MTXP01CEY1F.21.27.C05.1.454.CMB.2.raw
  modified_base (159)..(159): a, c, t, g, unknown or other
  modified_base (261)..(261): a, c, t, g, unknown or other
  modified_base (302)..(302): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtntcctgtcacagatcaaactacagcagtctggtccaggactggtgacggccctcgcacgtaccctttcactcacctgtgactatcgtaccggggaaatgtcgntgacaacagtggtgaagttgattacggcacgtcccgtgagnggtccttgagtggtctaggaacgtactattactacgtccagtggtactgaagtactagtgaactagtgttctggtgacgtcgtcgtctcacctatacccacccagaccacgtaccaagtactacgacgtcctaccctactacccttaaggtcgtccttaccgtacctacccgtaccccgacgaccgtacggttcttaagttttagttttcggacgtaaccgaagggttacggtacttacgtaacgtcgttaccggttcgttaacccgttccttacccgttcggaccgttcccgggttacgggtaacccgttaaggggtttaacccg

SEQ ID NO: 396083 - DNA, 799 bp, Homo sapiens
  misc_feature: GZ8MTXP01DZSH2.21.27.C05.1.454.CMB.2.raw
  modified_base (208)..(208): a, c, t, g, unknown or other
  modified_base (263)..(263): a, c, t, g, unknown or other
tcagtcgtcgctcgcacgaccggtgctcgatttagacgcgatcgaagggtttggggggaggaactgctcagttaggacccagacggagccatggaagccccagcgcagcttctcttcctcctgcttctctggcctcccagacaccactggagtgattgtgatgacgcagtctccagcccacctgtctgtgtcgtccggaggggggacnccgcccaccctctcctgcacacgccagtcagtctacgtcgctgtacgttggtacnccgtaggtaccagacaagtaactcgtcggaccaggccctacccgagtcctcctactactttaccggcactactccccgaaccggacgggtccctacgttcggttccgtacccgaggtaccgttaggggttccggaaggggttcgggggtacgggttagggttaaacggttttacggggaacgtttacggggtttacttttttcccgacccttaccctaaccgtacgttacccgacccggtacccgtaccccgttaaagacgggttaaggttaacggtaaagttgtttaggtttacggtaccgtttaaaggtttttactttccgttaccggtaacgtaaacgttaacctttaaatttaaacgtttaacgttaaccgttccgggtaccgtttacggtaccggttacccgggttaccggttaccggggaacccggtaaacggggtaaacggttaaacgggtaaacggttaaagtaaccgaacgttaacggttgttacgggtctacgtaacctaactcgttacgttcgttccgttaaccc

SEQ ID NO: 396084 - DNA, 765 bp, Homo sapiens
  misc_feature: GZ8MTXP01BH6EI.21.27.C05.1.454.CMB.2.raw
  modified_base (199)..(199): a, c, t, g, unknown or other
  modified_base (247)..(247): a, c, t, g, unknown or other
  modified_base (304)..(304): a, c, t, g, unknown or other
  modified_base (445)..(445): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccacctgtctgtgtctccgaggggganccgccaccctctcctgcacagccagtcagtctatcgctgactggttancctggtaccagcagaaatctggccaggcctccgaggcttcctctacgttttacccgngacctactccccgacccgaggggtaccccaacggttcggtaccgtaccccgaaggtacccgtagggtttacccccaaggggttcggggtccgggttaggggtaacgttttacgggggaactaaggtttacgttttttcccncctaccaccgtacgtaccgacgtaccccgtaccctaaggaacggtaggtaaggaagtagttcgtttacgtacgtttaagtttacttccgtacgtaccgtaacggtaacttaaaacttaagttaaaccgtttaccggtccggtcccggttacggttccgggttaccgggttacccgggttacccgggaacccggggtaaccggggtaaaccgtaaacggggttaaacgtaaaaccgttaccgtaaaaccggtaacgttcgggttcggttaccgtaaccgtaccgtaacctacgttccgtttacgttccttaacgtaacccg

SEQ ID NO: 396085 - DNA, 666 bp, Homo sapiens
  misc_feature: GZ8MTXP01BEOLN.21.27.C05.1.454.CMB.2.raw
  modified_base (160)..(160): a, c, t, g, unknown or other
  modified_base (298)..(298): a, c, t, g, unknown or other
  modified_base (368)..(368): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtntcctgtcacagatacaaactacagcagtctggtccaggactggtgacggccctgcacgtaccctttcacctcacctgtagactagtccgtacggggaaatgtcgcgtgacaacatggtagagtgatagcacgtcccgngagacgtcgtgagtgcgtaggaacgactattacgtacgtccgagtggtactagaagtatatgaactagtnttcgtggtagcgtacggtcgtactacgacctataccacccgagaccgacgtaaccgaacgtaactaccgtacgtaccctaccctaccgtaccttaacgtcgtaccgtcgtaccctaacccgtcccgaaccgtaccgtaaccggttcttaacggtttttacgttttcggtacgtaacgtaaacggttacgggtacttacgtaaacgttacgtttaccggttcggttaaccctttaacccgttccgttaacgtacccggttaccggttacgggtaacccggttaaggggttttaacccgg

SEQ ID NO: 396086 - DNA, 795 bp, Homo sapiens
  misc_feature: GZ8MTXP01BQGNZ.21.27.C05.1.454.CMB.2.raw
  modified_base (205)..(205): a, c, t, g, unknown or other
  modified_base (257)..(257): a, c, t, g, unknown or other
tcagtcgtcgctcgcacgaccggtgctcgatttagacgcgatcgaagggtttgggggggaactgctcagttaggacccagacggagccatggaagccccagcgcagcttctcttcctcctgcttctctggcctcccagacaccactggagtgattgtgatgacgcagtctccagccaccctgtctgtgtcgtcggaggggggacnccgcctaccctctcctgccacagccagtcagtctagtcgctgacgtggtacnccgtacggtaccagtacaagaactcgtcggacccgaggccctccccgacggtcccttcctaccttacgtttacccgtcgacctaaccgtaccccgaaccggcgggggtacccctaagttcggggtaccgtaccccgaaggaccgttagggttacccgagggtcgggtaccggggttggtagtttacggggaacttggttacttttccgactaccacctagtaccgaccggtcccgacccttaaggaggtaaaggttaggaaacgggttagtttgggtttaccgtagtttaacggttttacttcgtacggtacctaacggttaagttaaaactttaaccgttaaacgttacgttccggtacccgttacggtacccggttaccggttacccggggttaccgggtacccggaaaccggggtaaacccggtaaggggttaaaccgtaaaaccttaaccggaaaacggtacggttaccgggttcgaccgtcggtaacccaacgtttaacctacggtttcccgttaacctttcggttaaccccg

SEQ ID NO: 396087 - DNA, 730 bp, Homo sapiens
  misc_feature: GZ8MTXP01AZZX1.21.27.C05.1.454.CMB.2.raw
  modified_base (236)..(236): a, c, t, g, unknown or other
  modified_base (437)..(437): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggaccgccacctctcctgcacagccagtcagtctatcgntgacttggttacgccgtggtaccagacagaaactcgtggacccaggtcctacccgaggtccttccctactaacgtttaccgtgacctaacgttccccaaccgacggggccctaacgttgggtacctaccccgaaggaccgtacgggttcgaggtcgggcggttagggtaagtttacggggaacctagggttacgtttttcnccgttaccgaacctagtacccaacggtcccgaacccttaagacggtaacgttagaaacggtctttggtttacggacctttaaggttttaacttccgttacgaacccggtaagtaaccgttaaattacgttaaacgtttccgtcggtacccgtttaggtcccgttaccgggtaccggttacccggacccggttaaacggggaaacccttaaagggggtaacaaacgttaacggaaagttaccgttggttacgggaacctaggcctaacgtctttccgtaacgtttccttaaccg

SEQ ID NO: 396088 - DNA, 545 bp, Homo sapiens
  misc_feature: GZ8MTXP01AUOUN.21.27.C05.1.454.CMB.2.raw
  modified_base (202)..(202): a, c, t, g, unknown or other
  modified_base (359)..(359): a, c, t, g, unknown or other
  modified_base (368)..(368): a, c, t, g, unknown or other
  modified_base (374)..(374): a, c, t, g, unknown or other
  modified_base (399)..(399): a, c, t, g, unknown or other
  modified_base (407)..(407): a, c, t, g, unknown or other
  modified_base (451)..(451): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccacctctcctgcacagccagtcagtctatcgctgactgtagctggtaccagcagaaatctaggcaggcctcccaggcctcctcactttaccgccatccacgagggcctacgtggtctcccagaccaggttcagtggcggtggaatttgggaacngtagtttcnctcacntcagccgacctagagagttgaaagnttggttancttagtttacttcaggtaccaagtactaaatattaaagttacgnggtcctgccgttacgtacggttccgacgaacgggacaaggtacggaactaagaaacgacgttggttcggctgccactattcttcgttcttaacc

SEQ ID NO: 396089 - DNA, 639 bp, Homo sapiens
  misc_feature: GZ8MTXP01EXBKE.21.27.C05.1.454.CMB.2.raw
  modified_base (300)..(300): a, c, t, g, unknown or other
  modified_base (344)..(344): a, c, t, g, unknown or other
  modified_base (496)..(496): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatgggtgtcctgtcacagatcaaactacagcagtctggtccaggactggtgacggccctgcacgtaccctttcactcacctgtgacagtcgtaccggggaaatgtacgctggacaacagtggtgaattggattaggctacgtccccgngagagtcctgagtgcttggaacgtactatatacgtccagtgtanggaagactagtcgaacagtaattcgtgtacgacgtcgttcgtactaccacgactaccgacccagtaccacgtacaagtactcgaggtcctaccgtacaccgttaagtcgttacgtacgtaccgaccgtaccccgacgtaacgtacccggttnttaacgggttttcttttacggcgtaacggtaaacggttagggtaacttacctaaacgttacgtttccgggttacttaccgtttaaccctccgttaacgtaaccgttaccgggttcggggtaacccgttaacggggtttaaccg

SEQ ID NO: 396090 - DNA, 744 bp, Homo sapiens
  misc_feature: GZ8MTXP01BXML9.21.27.C05.1.454.CMB.2.raw
  modified_base (207)..(207): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccaccctgtctgtgtctccggaggggggacnccgcccaccctctcctgcacagccagtcagtctatcgctgacgttggtagcctggtaccagacagaaatcgtcggccacggcctccccgaggtccttcccctactacgttttacccggcgacctaccgtccccgaaccgacgggggtccctaacggttcgggtccgtaccccgaaggtaccgtacgggttcgaggtcggggtcgggtaggtaagtttcggggaacttagggtttacgtttttccaccgttacctaaccctagttacccgacggtacccgtaccccttaacggaaggtacgggttaggaaaggttacgtttggttacgtacgttagtttttacgttcgttacgacccgtaagtaacttaaattaacgtttaaacttccggtggttcccgtaggtcccggttaccggtacccgggttccggacccggtaaccggggaacgttaaagggtacggttaaaccgtaaccgaaaaccggttcgttcgggttcgggtcctcggaacctaaccggtcttcgttcgttccttcccg

SEQ ID NO: 396091 - DNA, 730 bp, Homo sapiens
  misc_feature: GZ8MTXP01C9CRR.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgaggccctcgcacgaccctttcactcacctgtagacatcgtaccggggaaaatgtacgcgtggacaacgaagttgggtaggtaagttagggagttaacggccgtacggttcccccggtacggaggacggtccgttggaggttggcgttaggaaacggtacctagttactacgtccagtggtataggaaagctatgaactagtaattcgtggtagacgggtccgtcgtactccaacctactaccccaacccgaacgaaccgtaacccggtaaaccaaacggtaaactaccgaacggttcccctacccctacccgtaaaccgttaacttaccggttctaaccgtaccctaaccgtaccccgaacggtaaccgaaccgggttacctttaacgtttttaaagtttcgtacggtaaaccgtaaaggttaacgggtaacttaccgtaaacgttaccggttcggttacgttacccttaacccgttacctcgtacggtccggttacggggtaaccgttaacggggtttaaccgg

SEQ ID NO: 396092 - DNA, 655 bp, Homo sapiens
  misc_feature: GZ8MTXP01CFQQ3.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgccgggcctcccatggggtgtcctgtcacagatacaaactacagcagtctggtccaggactggtgacggccctcgcagaccctttcactcacctgtgacatcgtaccgggaaatgtacgctggacaacaagtggttaggaagttggattaggcacggtccccgtgagacggtccttgagtcggtcgttaggaacgtaccttaattacgtacgtccgtagtggtatacgtaagtactagtagactaagtattcgtagtgacgtcgtcgtctacaccgtatcccgacccagaccacgtaccaaagactcgacgtccaccctaccacgttaatcgggtctacgtaccaccgtacccgacgaccgtaccggtacttacgtttttagtttcgacgacgtaaaggtacggttacttaccgaacgttaacggtttccgggttaaccgttccttaaccccgttcgttacgaacccgtttccgggtacggggttaccgttaacggggtttaaccgtttcccggg

SEQ ID NO: 396093 - DNA, 690 bp, Homo sapiens
  misc_feature: GZ8MTXP01C64RR.21.27.C05.1.454.CMB.2.raw
  modified_base (206)..(206): a, c, t, g, unknown or other
  modified_base (317)..(317): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggggacnccgccaccctctcctgcacagccagtcagtctatcgctgacttggttacgccgtggtaccagcaagaaatcgtcggaccaggcctcccgaggtcctcctctactttaccgngacctactccccaaccgacgggcccacgtggtcgcccagacgtacggttcaggtcgggcggtaggtaagtttgggaactaggttacgttttcactccaacctatcacgcccgaccctaacgaggtaagtagaagtattggttagtacttagtttacttacgtacgtaccgtaagtaactaaattaaacttaaacgtttaccgtcggtaccttacgggtaccggttaccggtacccgggttaccgggaacccggtaaccggggtaaccgttaaaggggtaaacgttaaaacgtaaccgtaaaaacggttacgttcggttacggtaacgttacggaaccgtaacccgtagttacccgttcgtttcccgttaaccg

SEQ ID NO: 396094 - DNA, 761 bp, Homo sapiens
  misc_feature: GZ8MTXP01CRU36.21.27.C05.1.454.CMB.2.raw
  modified_base (207)..(207): a, c, t, g, unknown or other
  modified_base (224)..(224): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtcgtccgagggggggacnccgccctaccctctccngacacacgccagtcagtctagtcgcgtagtacgttggtacgtccgtacggtaccagacaagtaactcgcggaccgacggtcctaccgacgtcctacctactacgtttaccgcgtaccactacccgaccggtacggcctacgtcggtaccgtaccgacgtacgtacggttacggagggtcggggtcgggttaggtaacgggtttacgggaacgttacggtttaccgttttaccaccgtaccaccgtacgtacccgaccgtacccgtaacccgtaagaaggtaacggtaaggtaaagttacgtttacgttacgttaacgtttaacgttttacgttaccgtacgtaacggtaaacgttaacttaaagttaaacgttaacgttaccggtcggtccgttacgggtaccggttaccggtacccgggtaccggaaccgggtaacgggtaaacgttaaagggtaaacgaaacgtaaaccggtaaacgttacgttcggttacgtaaccgtacgtaacctactacgttacgttccgttccgttaacg

SEQ ID NO: 396095 - DNA, 721 bp, Homo sapiens
  misc_feature: GZ8MTXP01DQ3P8.21.27.C05.1.454.CMB.2.raw
  modified_base (208)..(208): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccacctgtctgtgtcgtccggaggggggaccnccgccctaccctctccgtcgacacgacgcctagtcagtctacgtcgctagtacgttggtacgccgtagacagacgaagtaactcgtcggaccgacggtcctccgacgtcctcctacttacgttaccgcacctacgtacccgacgtacggtccgtacgtcggtaccgtaccgaggtacgttacggtacggtaggggtcgggtacggggttaggttaacgggttacgggtaacgttacggtttaccgttttccgtacctacctacgtacgtaccgaccgtccgtaaccgtagaggtaggtagtaagttgttagttcgtacgtttagtttacgttcgacgtacgtaataacttaaattacgttaacgttccgtacggtccgttacgggtccgtaccgggttaccggtaccgggaaccggtaaacgggtaacggttaaagggtaacgttaaacgtaacgaacgttacggttggttaccgtcgtacgtcccgttacgtctttccgttcgttcccttcg

SEQ ID NO: 396096 - DNA, 721 bp, Homo sapiens
  misc_feature: GZ8MTXP01BHF55.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccggaggggggacncgccaccctctcctgcacagccagtcagtctatcgctgacttggtacgctggtaccagcaagaaatcgtggaccagggcctccccgaggtcctccctactacgtttaccgtgcctaacgtccccaacgacggggcctaacgtggtacgtacccaggtaccgtaagggttcaggggtcgggtcgggtaggttaaacggtttcgggggaactaagggtttacgttttcctcgttaccgaacctacgtacacgtccgtaccctagagggtaagtagaaagtacgttggttcgactttaagtttactttcgtacgtaccgagttaactaaatttaacgtttaaacttaccgttggtccttaacgggtccggttacggttaccgggtttccggacccggggtaaaacgggtaacccggttaaaagggtacccgggttaaaaattacccggaaaacttaacgggttcggttacggtaacgttcccgaacgtaaacccttaggttaccttaacggtttcccttg

SEQ ID NO: 396097 - DNA, 838 bp, Homo sapiens
  misc_feature: GZ8MTXP01AVG03.21.27.C05.1.454.CMB.2.raw
  modified_base (205)..(205): a, c, t, g, unknown or other
tcagtcgtcgctcgcacgaccggtgctcgatttagacgcgatcgaagggtttgggggaggaactgctcagttaggacccagacggagccatggaagcccagcgcagcttctcttcctcctgcttctctggctccagacaccactggagtgattgtgatgacgcagtctccagccaccttgtctgtgtcgtccggaggggggaccnccgccctacctctcctgaccacacgcctagtctagtctacgtcgtcgtacggtacgttcggtacgtccgtacggtacagacgaagtaacgtcggtacggaccgacggtcccctacccggacgtcccttacccttacgttacgtttaccgtcgtacctaaccgtaccccgaaccggtaccgggtacccgtacggtaccggtaccgtaccgacggtacggtaccggtaggtacggggtcggggtacgggttagggttaacgggttacgggtaacgtttacgtttaccgtttccgtaccgtaaccgtacgtacgtaccgtaccgtacccgtaaccggtaaggtaacgggtaacggtaaggttaagttacggtttacggttacgtttaacgtttacgtttacgttaccgtaaccgttaaccgttaaacgttaaactttaaacgtttaacgtttacgttccgggttccgttaccggttacccgggttccggttaacccgggttacccgggtaacccggaacccggggtaaacggtaaacgggttaaacggtaaacgttaaaccggtaaacggtaacggttcggttcggttaccgtaacgtcgaaccttaccgttacgttccgtttccgttccgtaacg

SEQ ID NO: 396098 - DNA, 575 bp, Homo sapiens
  misc_feature: GZ8MTXP01AC2LX.21.27.C05.1.454.CMB.2.raw
  modified_base (204)..(204): a, c, t, g, unknown or other
  modified_base (268)..(268): a, c, t, g, unknown or other
  modified_base (298)..(298): a, c, t, g, unknown or other
  modified_base (383)..(383): a, c, t, g, unknown or other
  modified_base (389)..(389): a, c, t, g, unknown or other
  modified_base (402)..(402): a, c, t, g, unknown or other
  modified_base (414)..(414): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggtagctggtacagcagaatcnggcaggctcccagcctcctctatttaccgngccactcccaccgacgggcccacgtggtcgtcccagaccgtaggttcagtcgggcggtggtaagtttgggaactagtagttttcnctcacntccagccgcctanagagtagaagtnttgttagcttagtttattctgacctagtactaattaattattacgtcgctcgtcgtacggtaccgttccggacggaacgggaccgttaaagggtacgaaacgttaccgaaaccgttacgttggttcggtaacctcgaacctactcgttcttcgttcgtccg

SEQ ID NO: 396099 - DNA, 733 bp, Homo sapiens
  misc_feature: GZ8MTXP01BQXFQ.21.27.C05.1.454.CMB.2.raw
  modified_base (204)..(204): a, c, t, g, unknown or other
  modified_base (241)..(241): a, c, t, g, unknown or other
  modified_base (316)..(316): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctcggaggggggacnccgccaccctctcctgcacagccagtcagtctatcgntgacttggtacgcctaggtaccagacaagaatcgtggaccaggcctccccgaggtcctacctctacgtttaccgngacctactcccgaccgacggggccctacgttggtaccgtaccccaaggtaccgtagggtttacgagggttcgggggcgggttagggtaaacgtttcgggggaacctagggtttaccggtttttccaccttaccaaccgtagttacccaacggtcccgtaccccgtaacggaaggtaagggttaaggtaaaggtagtttacggttagtaacctttaagttttaacgttttcgaccgtacccggtaagtaaccttaaaagttaacttaaacgtttaccgtcgggtaccgttacgggtaccggtaccgggtacccggtttaccgggacccgggtaacgggaaaccggttaagggtaacggaaactacggaaacgttacgttgttcggaacctcgctaaccctgttctcgtttcttaaccc

SEQ ID NO: 396100 - DNA, 765 bp, Homo sapiens
  misc_feature: GZ8MTXP01E29HS.21.27.C05.1.454.CMB.2.raw
  modified_base (205)..(205): a, c, t, g, unknown or other
  modified_base (331)..(331): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccgagggggggacnccgccaccctctcctcgccaccgcctagtcagtctagtcgctgtacgttgggtacgcgtagtacagacaagaatcgtacggaccacggtcctacccgacggtccttacctactaacgttttaccgngacctacctaccccgaaccggacggggaccctaacggtcgggtaccgtacccgaagtacgtacggttaccgagggtcgggtacggggtggtaggtttaacggggaacttaaggtttacgttttcacctacctaacctacgtacgacgacccgtacccgtaacgaaggtaacgtaagaaagtagttacggttagtacgttaagttttacttacgtacgtaccgtaaggtaactaaaacttacttaaacgttaccgtacggtccgttacggtaccgtaccggttaccgggttacccggtaacccggaaaccggggtaaacggtaaacggggttaaacggtaaaacgttaaacgtaaaaccggtacggttacggttcggttaccgtaacgtacctaaccgttagttaccgttcgtttaacccgtttaacgtaacccg

SEQ ID NO: 396101 - DNA, 813 bp, Homo sapiens
  misc_feature: GZ8MTXP01A0AYC.21.27.C05.1.454.CMB.2.raw
  modified_base (204)..(204): a, c, t, g, unknown or other
  modified_base (242)..(242): a, c, t, g, unknown or other
  modified_base (270)..(270): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtcgtccgaggggggacnccgccaccctctcctgcaacagccagtcagtctatcgntgactggtacgcgtgtacagcagaatcncggccaggcctcccgacggtcctccgtacttactttaccgtcgacctactaccccaccgacgggtcccacggttcggtaccgtacccaggtaaccgtacgggtttcgagggtcggggcgggttagggtaagttttacggggaacttaggtttacgtttttcctacctaccgtaaccctacgttaccgaccggtaccccgtaaccccgttacgaagggttaaacgggttcggtaaaaaggtttaccgttggtttagtaccgtttaaagggtttttctttacccggttacggaaccctaaaggttaaccgttaaaacttaagttttaaaaacctttcccgggttcgggtaccccgtttacggtaccggggtttacccggttaaaccggggttccccgggaacccgggaaacccgggggtaaaaccggtttaagggggaaaccggttaaaacgaaacccggtaaaaaccggttacccgggtttggaaccgggtcccggtaagttccccgaaaccgttcttaccgttttcggtttccctttaacccg

SEQ ID NO: 396102 - DNA, 522 bp, Homo sapiens
  misc_feature: GZ8MTXP01BNQWN.21.27.C05.1.454.CMB.2.raw
  modified_base (438)..(438): a, c, t, g, unknown or other
  modified_base (452)..(452): a, c, t, g, unknown or other
  modified_base (460)..(460): a, c, t, g, unknown or other
  modified_base (475)..(475): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatcgtccggggaaaatgtcgctggcaacatggtgatggattaggcagtccccgtgagagccttgagtggcttggaaggacctattatacgtcccagtgtactgaagactatgacagaattctgtgagcggtcgtcgtcacagtccacccagacacgtcaagatcagtctcctcactaatgtctgtcactcccgacgacacggntacgtttatttgtncagagggnttcgatattcggttnaccttaacctacttcgtactccgacggggtcccaaggggttaacccg

SEQ ID NO: 396103 - DNA, 735 bp, Homo sapiens
  misc_feature: GZ8MTXP01AKL5C.21.27.C05.1.454.CMB.2.raw
  modified_base (206)..(206): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccggaggggggacnccgcccaccctctccctgccacacgcctagtccagttctagtcgctgacgttggtagccgtggtacagcagaatcgtggccaggcctaccgaggtcccttccgtcttaacgtttaccgcgacctactccccgaaccggacgggccctacggtggtaccgtacccgaagtaccgtacggttcgaggggtcggggtacggttagggtaacgttttacggggaacgttacggtttacgttttcctcctaccgtaacctcttacgacgtccgtacccgtaagaggtaggtagaagttgttgttacgtacgttagttttacgttacctacgtaccgtaaagtaccttaaagttaacgtttaacgttccggcggtacccgtacgggtcccggttaccgggtaccggttacccgggacccggaaccggggtaaaccgttaaagggggtaacgttaaaccgtaaccggaaaaccggttcgttggttacggtaaccctaggccccgttaactacggttccttaacgttccttaacccg

SEQ ID NO: 396104 - DNA, 682 bp, Homo sapiens
  misc_feature: GZ8MTXP01CDHUZ.21.27.C05.1.454.CMB.2.raw
  modified_base (161)..(161): a, c, t, g, unknown or other
  modified_base (371)..(371): a, c, t, g, unknown or other
  modified_base (376)..(376): a, c, t, g, unknown or other
  modified_base (383)..(383): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtntcctgtcacagatacaaactacagcagtctggtccaggactggtgacggccctcgcacgtaccctttcactcacctgtcacagtcgtaccggggaaatgtcgctggacaacaagtggttggaattggattacggctacgtccccgtgaggacggtcctggagtggcttagggaaacggtcctattactaccggtccagtggtactggaanactangacagtntctgtgagtcggtcgtctcacctctaccacccacgaaccacgtaacccaaggtaactaccgacggtccctacccctaccgtaacctaaacgggttcttctcgtacccaccgtacccgaccgtaaccgtaccggtaccgttagtttttacgttttcggtggtaaccgtaaagggttacgggtaacttccgtaaacggttcgtttacccgggttacgttaacccttaaccccgttccgtttaacggtaaccccgttccggggttaccgggggtaaccgttaacgggggtttttaacccggg

SEQ ID NO: 396105 - DNA, 739 bp, Homo sapiens
  misc_feature: GZ8MTXP01BGS1Y.21.27.C05.1.454.CMB.2.raw
  modified_base (205)..(205): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccatggagtgattgtgatgacgcagtctccagcccacctgtctgtcgtcgtcggagggggaccnccgcctacctctccgtcgccaccgctagtctagtctacgtcgtcgtagtacgttacggtacgccgtacgacagactaagtaactcggcgaccgacgtcctaccgacgtccttaccttacgttacgttccgcaccgtaccgtacccgaccggtacggtccctaggtccggtaccgtaccgaggtacgtacggttacgtaggggtcggggtcggtaggttaacggtttaacgggaacgttggtttctttaccaccttacccgaaccgtacgtaccgaccgtacccgtaaccgtaaggtaacggtaaggtaacggtaagttacgtttaggttacgttaacgtttacgtttacgtcgttaacgtacgttaacgtaaacttaagtttaaacttacgttacgtccgtcgtacggtaccggttacggtaccgggtaccggaaccgggtaacgggtaacggtaaacgggttaacgtaaacgttaacggtaaacgtcgttggttcgcgtaacgtacctaacgttctcgttactcgttcgtccg

SEQ ID NO: 396106 - DNA, 814 bp, Homo sapiens
  misc_feature: GZ8MTXP01EEOA2.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggactggtgacggccctcgcacgtacccttcactcacctgtgacatcgtaccgggaaatgtcgctggactaacaagtggtaggaattggtaagttacggccgtacggttcccccgtaggaacggtacggcccgtttaggaggttcgggtacgtttagggaaacggtaaccctttaagtttaacgtacccggttcccgaaggtacggttaatacggaaagtactagtcgaaacgtaagtaacgttccgtaggtacggtaacgggtccgggttccgttacctaccgtaaccctacgttaccccaaccccgtaagaaccccgtaaccggtaaaccaaacggtaaactacccgtaaccgggttaccccttacccccttaaccctaaaccgttaacggttacggttacccgttaccggtaccccgtacccgttaacccccggaaccgtaaccgttaaccccggtagtttaacgttttttacgttttacggaacgtaaccggtaaagggttacgggtaaaccttaccgtaacgttaacggttccggttacggttaaccctttaacccgtccgttaacggtacccgttaccgggacgggggtaaccgttaaggggtttaacccg

SEQ ID NO: 396107 - DNA, 630 bp, Homo sapiens
  misc_feature: GZ8MTXP01BKEHR.21.27.C05.1.454.CMB.2.raw
  modified_base (239)..(239): a, c, t, g, unknown or other
  modified_base (303)..(303): a, c, t, g, unknown or other
  modified_base (307)..(307): a, c, t, g, unknown or other
  modified_base (399)..(399): a, c, t, g, unknown or other
  modified_base (558)..(558): a, c, t, g, unknown or other
tcagtcgtcgctcgcacgaccggtgctcgatttagacgcgatcgaagggtttgggggcagagcctgctgacttctggctgaccagggcagtcaccggggctccagacaatgtctgtctccttcctcatcttcctgcccgtgctgggcctcccagtggggtgtcctgtcacagatacaaactacagcagtctggtccaggactggtgacggccctcgcacgtacccttcactcacctgtnacatacgtacggggaaatgcgctggacaactagtggtaggaattggaattaggctacgtcccgngagnggtcctgagtggacgtaggagtacctatataccgtccagtggtatacgaagtactagtgactaaagtattcgtgtaggacgtcggtcgtacncaccatacccgaccctagaccgtaacgaccaaaggtaactcgaaccggttcctccccgtaactaccttaaacgtcgggtcttacgtaccctacccgacccgacgtaccgtacgttacctttagttttacgttttgacgaggtaaagtcgggttactacngttaacgtggttaccgttccgttaccttcgttacgccgttccgggacgggaccgtaacggtttaacgttccg

SEQ ID NO: 396108 - DNA, 729 bp, Homo sapiens
  misc_feature: GZ8MTXP01BP4NJ.21.27.C05.1.454.CMB.2.raw
  modified_base (204)..(204): a, c, t, g, unknown or other
  modified_base (218)..(218): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgattacgcagtctccagccaccctgtctgtgtctccgaggggggacnccgccacctctccngacacgacgccagtctagtctacgtcgtcgtagtacgttgggttacgtccgtacggtaccagacaagaactcgacgaccgacggtcctaccgacgtcctcctacgtacgttaccgtgactacctaccgaccgtacggtaccctacggtcggtaccgtaccgagtacgtacggtccgagggtcgggtacggttaggttacggttaacgggtaacgttcggtttacgtttcctaccgtaccgtacctacgtaccgaccgtacccgtaccgtaacgaggtagtagtaagttacgttacggttacgttacgtttacgtttacttacgtacgtaaccgtaaggtaacttaaagttaacgttaacgttcggtacggtaccgttcggtaccggttaccggtaccggttaccggaacccggtaacgggtaaacgtaacgggttaaacgtaaaccgttaacgtaaacgtcggttacggttcgcgtaacgactaacgtcgtcttcgttccgttaacgtccg

SEQ ID NO: 396109 - DNA, 643 bp, Homo sapiens
  misc_feature: GZ8MTXP01BVDXI.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatacgtaccggggaaatgtcgctggcaacatggtagtatggattaggctacgtcccgtagagacggccttaggagtggcttaggaacggtactagttactacgtacccagtcggtatagaagtactagtgaacagtaattcgtagtgacgcggtcgtctcacatccacccgagaccgacgtaccaagtaactacgacgtcctaccctaccgaaccttaacgtcgtccgtacgtcctaccgtcccgaacgaacgtaccgggtacttacggttttacttttcggaggtaaccgtaaagggttacgggtaacttaccgtaacgttacgttccggttcggttacccttaaccgttcgttaacgtaaccgtccggttacggggtaacccgttaaggggtttaacccgg

SEQ ID NO: 396110 - DNA, 750 bp, Homo sapiens
  misc_feature: GZ8MTXP01BAPE8.21.27.C05.1.454.CMB.2.raw
  modified_base (205)..(205): a, c, t, g, unknown or other
  modified_base (315)..(315): a, c, t, g, unknown or other
tcagtcgtcgctcgcacgaccggtgctcgatttagacgcgatcgaagggtttgggggggaactgctcagttaggacccagacggagccatggaagccccagcgcagcttctcttcctcctgcttctctggctcccagacaccactggagtgattgtgatgacgcagtctccagcccaccctgtctgtatctccggaggggggacnccgcccacccctctcctgcacagccagtcagtctatcgctgacttggttacgcctggtaccagcaagaatcgtggccaggcctcccgaggtccttcctctactttaccgngcactcccaccgacgggccctacgtcggtcgtcccgagacgtggttccgaggtgggcggggtaggtaggtttaggggaaccgtaaggttacgtttttccgtccttacccgaacctacgtccgaacggtccccgtacccttaacggaaggtaaggttacgaaagggttagttcggtttacgtacgtttaaggttttactttcgtacggtacccctaagggtaaccttaaatttaaacgttaaacgtttaccggtacgggtccccgttacggtaccggtttaccggggtaaacccgggttcccgggtacccgggtaaaccggggaaacggtaaacgggggttaaacggtaaaaccttaaccggaaaacggtaacgttcgggttacggaccgtaacggacctaaccgtacttaccgttgttaaccgttaaccttcccg

SEQ ID NO: 396111 - DNA, 710 bp, Homo sapiens
  misc_feature: GZ8MTXP01EO986.21.27.C05.1.454.CMB.2.raw
  modified_base (220)..(220): a, c, t, g, unknown or other
  modified_base (329)..(329): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacccgccacctctctgcacncgcctagtcagtctagtcgcgtagtacgttggtacgccgtaggtaccagacaagtaacgtcgtacggaccacgccctaccgacgtccttcctacgttaccgtttaccgngtacctactaccgtacgtacggcctacgtcggtacgtacccgaggtacgtaccggttacgtaggtcgggtacggttacggtaagttacgggaacgtaggtttacgtttcctactacacctagtccacgtcccgtacccgtagagtacgtagtaagtagttagttacgtacgttagtttacttacgtacgtaaccgtaaggttaactaaagttaaacttaacgttaccgtaccggtacgttacgggtaccggttccggtaacccggtcccggaacccgggtaaccgggtaaacgttaaagggtaaacgttaaacgtaaccgtaaacgttacgttcggttacgaacctacgaacctacctcgttacgttaacgttcctaaccg

SEQ ID NO: 396112 - DNA, 625 bp, Homo sapiens
  misc_feature: GZ8MTXP01DPHX0.21.27.C05.1.454.CMB.2.raw
  modified_base (204)..(204): a, c, t, g, unknown or other
  modified_base (242)..(242): a, c, t, g, unknown or other
  modified_base (252)..(252): a, c, t, g, unknown or other
  modified_base (297)..(297): a, c, t, g, unknown or other
  modified_base (307)..(307): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctcctgcacacgccagtcagtctatcgntgactggtcncctggtaccagcaagaaatcgtggccaggcctccgaggcctcctntactttccgngaccactcccacgacgggccctacgtggtcgtcccaggaccgtacggttccaggtcgggcggttggtaagtttgggaactagttacgttttcacctcactatcacgtccgaccctagaggtagtacggaaagtagttgttacgtacttaagttttacttcacggtaccaaggttaactaaacgtttaattaacgttaccgtcggtaccgttggtccgttacggtaccggttcggaccgaacgggtaacgttaaaggggtacgaaacgtaacgaacgaacgttggttacgtcgagcctacagttctaacgttcttaacc

SEQ ID NO: 396113 - DNA, 718 bp, Homo sapiens
  misc_feature: GZ8MTXP01BLW55.21.27.C05.1.454.CMB.2.raw
  modified_base (207)..(207): a, c, t, g, unknown or other
  modified_base (245)..(245): a, c, t, g, unknown or other
  modified_base (701)..(701): a, c, t, g, unknown or other
tcagtcgtcgctcgcacgaccggtgctcgatttagacgcgatcgaagggtttggggtaggaactgctcagttaggacccagacggagccatggaagccccagcgcagcttctcttcctcctgcttctctggcctcccagacaccactggagtgattgtgatgacgcagtctccagcccaccctgtctgtgtctccggaggggggacnccgcccaccctctcctgcacagccagtcagtctatcgntgacttggtacgcctggtaccagacaagtaatcgtcggccgacggcctccccgaggtccttccctactacgttttacccgcgaccactaccccgaccgacgggccctacgtcggtccgtacccgaggtaccgtcggtttacgaggggttggggtaccgggttagggttaacgtttcggggaacttagggtttaccgtttttcctccgttacccaactacgtaccgacgtcccgtacccgtaagaggtagtaggtaaagtgtttggttacggttactttacgtttactttaccgtacggtaccctaagtttacctaaatttaacgttaacttccggttacgggtcttacgggtccgttacccgggttacggttcccgggaccggtaaacgggtaacgttaaggggtaaacgttaaacgtaaacgaaacgttacgttggttacggctacgctaacgtnttcctcgttccttaacg

SEQ ID NO: 396114 - DNA, 773 bp, Homo sapiens
  misc_feature: GZ8MTXP01DDQZE.21.27.C05.1.454.CMB.2.raw
tcagtcgtcgctcgcacgaccggtgctcgatttagacgcgatcgaagggtttgggggaggaactgctcagttaggacccagacggagccatggaagcccagcgcagcttctcttcctcctgcttctctggctccagacaccactggagtgattgtgatgacgcagtctccacgccacctgtctgtcgtcgtccggaggggggacccgccctaccctctccgtgcacacgccagtcagtctatcgctgacgttggtacgtcgtaggtaccagacaagaaactcgtcggacctacggccctcccgacggtccttaccttacgttactttaccgcgtacctaactccccgacggtaccgggtaccctacggttacggtaccgttacccaaggtaaccgttacgggttcgtagggtcggggtacgggttacggtaaggttttaacgggaacgttaacgggttttcgttttacccgtactacccaactacgtaccgtacgtacccggtaaccccttaaggaaggtaggttaacggaaagttacgttgttacggtactttaaggtttactttcgtacggaccttaaaggaacctttaaagttaactaacgtttaccggtcggttaccgtacgggttccggttaaccgggttacccgggttacccggggaaaccggttaaacccgggggtaaaccgttaaaggggtaaaccggttaaacgtaccgtaaaacgttacgttcgggttacgtcgtacgctaactgttacttcttcgtttaacc

SEQ ID NO: 396115 - DNA, 615 bp, Homo sapiens
  misc_feature: GZ8MTXP01ET7ZV.21.27.C05.1.454.CMB.2.raw
  modified_base (202)..(202): a, c, t, g, unknown or other
  modified_base (325)..(325): a, c, t, g, unknown or other
  modified_base (405)..(405): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagccacctgtctgtgtctccgaggggggacnccgccacctctcctgccacacgccagtcagtctagtcgtctggtacgttggttacgccgtacggtacagacaagaaactcgtcggaccgacggcctcccgacggtcctcctctactttaccgnacactccacgacgggcctacgtggtcaccagacgtacggtcgaggtcggcggtggtaagttagggaactagtacgtttcnctacactatacgacgccgacctagagtagtagaagtgttgtagtagttagtttattcgtacgacgtaagtactaaatacgttaagttacgtcggtaccgtcggtccgtcggtaccggttccgaccggtaacgggtaacgaagggtaacgttaaacgtaacgtaaacgttacgttcggttacgcgtacgcctactacttccgtcgttcgtc

SEQ ID NO: 396116 - DNA, 845 bp, Homo sapiens
  misc_feature: GZ8MTXP01DSOHB.21.27.C05.1.454.CMB.2.raw
  modified_base (208)..(208): a, c, t, g, unknown or other
  modified_base (248)..(248): a, c, t, g, unknown or other
  modified_base (260)..(260): a, c, t, g, unknown or other
  modified_base (326)..(326): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtcgtcgtccggaggggggacnccgcccaccctctcctcgccaccgcagtcagttctatcgntgactggttacnccgtaggtaccagacaagaactcgtcggccgaggcctacccgaggtcctcctactacgtttaccgngcctactcccgaccgtacggtccctacgtcgggtactacccgagacgtacggtttccgagggttcgggtcgggttaggtacgtttacggggaacttaagggtttcgtttttacctaccgtacctaacccgtacgtaccgtacccggtaccccgtaacccgtaaaccggtaagggtaaggtaggtaaacgttaggtttacgggtttacgttaacgtttaacgtttttaacgtttccggttaacgtaccccgttaaaggggttaaacctttaaaatttaaacgtttaaaccgtttaccggttccgggttcccgtttacggggttacccggtttaccgggttaacccgggtttacccggggaaaccccgggtaaccggggtaaaaccggttaaacggggttaacggtaaaaaccgttaaaccggtaaaaccggtacggtttaacgggttcgggttaccttaacccggtaaccttaacccgttacgttccgtttacggtttccctttaaccggtttaaccccg

SEQ ID NO: 396117 - DNA, 820 bp, Homo sapiens
  misc_feature: GZ8MTXP01BM8NQ.21.27.C05.1.454.CMB.2.raw
  modified_base (210)..(210): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtcctccagcccacctgtctgtcgtcgtccggaggggggaccnccgccctaccctcctccgtcgaccacgacgccgtagtaccgtagttcctacgtccgtcgttacggtacgttcggtacgtccgtacggtacaacgacgaacgtacgtcgaccggaccgtacgtacccgtcccggtacgttcccttaccgttaccgttaccgtttaccgaccgtaccctaccgtccccgaccggtacccgggtccgtaccggtccggtaccgtaccgaacggtacggtacggttacggtagggttcggggtacggttaggttaacggttacggtaacgttcgttttacccgtttaccctacccgtaacctaccgtacgtacccggtaccgtacccgtacccgtaaggtaacggtaaggtaaggttaaggttacgtttacgttacgttacgtttacgtttacgttacgtacgtaacgtaacgttaacttaaacgttacgtacgttccgtcgtaccgttacggtccggttaaccgggtaccggtaccgggtaaccggaaccgggtaacggttaaaggtaaaccggttaaacgtaaaccggtaacgttcggttacggttacgtaaccgtacgtaacctacgttcgttacgttccgttccgttaac

SEQ ID NO: 396118 - DNA, 706 bp, Homo sapiens
  misc_feature: GZ8MTXP01A71XB.21.27.C05.1.454.CMB.2.raw
  modified_base (202)..(202): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggacnccgccaccctctcctgcacagccagtcagtctatcgcttgacttggttacgccgtggtaccagcaagaactcgtcggccaggcctaccccgaggtccttcctactactttaccgcgcctactccccgaccggacgggccctacgtggtccgtaccgagaccgtacgggttcgagggtggggcgggttggtaagtttcggggaacttaggttacgtttttcaccgttacccaaccgtactcgaaccgtccgtaccccgtaagaggtaacggtagaaagttacgttggttacgtaccgtttagttttaacgtttcgtactaccggaagttaccttaaagttaactttaaagttcgtacggttccgtacgtccggtccggtaccggtttacccgggaccgaaaccggggtaacgttaaaggggtaaacggttaaaccgtaaacggtaaacgttaaccgttggttacggaacgttcaaccgtactacgttcctaagtttccttaaccg

SEQ ID NO: 396119 - DNA, 541 bp, Homo sapiens
  misc_feature: GZ8MTXP01BOUIV.21.27.C05.1.454.CMB.2.raw
  modified_base (160)..(160): a, c, t, g, unknown or other
  modified_base (258)..(258): a, c, t, g, unknown or other
  modified_base (265)..(265): a, c, t, g, unknown or other
  modified_base (284)..(284): a, c, t, g, unknown or other
  modified_base (338)..(338): a, c, t, g, unknown or other
  modified_base (343)..(343): a, c, t, g, unknown or other
  modified_base (355)..(355): a, c, t, g, unknown or other
  modified_base (379)..(379): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactgggtcgacggccctgcacgtaccctttcactcacctgtgacatcgtacgggaaatgcnctggcanatgtgatgatgcagtccgngagcgctgagtgctggagactatatactccagtgtatagaatctatgaacagtntctgngagcgtcgtacncactcacaccagacagacaagacncacgtccacccgacctactacgcgtactcgtctacctaccggacgaccgacggtccttaagtttcgtttagcgtaagaaacggttggacttcgactcgttacgttcgttacctaaccttcgtcgtaccgtaccggttcggggtaaccgaagggtttaaccgg

SEQ ID NO: 396120 - DNA, 633 bp, Homo sapiens
  misc_feature: GZ8MTXP01BTUSA.21.27.C05.1.454.CMB.2.raw
  modified_base (203)..(203): a, c, t, g, unknown or other
  modified_base (223)..(223): a, c, t, g, unknown or other
  modified_base (240)..(240): a, c, t, g, unknown or other
  modified_base (418)..(418): a, c, t, g, unknown or other
  modified_base (486)..(486): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacngccagtcagtctatcgntgacttggtacgcctggtaccagcaagaactctggccaggcctaccccgaggcctcctctatttaccgtgccactcccaccgagggccctacgttcggtctaccccgagtaccgtacgggtttaccagggtggggcggttagggtaagtttcgggggaactagggttacgtttttccncttaccactacgttcacgcccgtacccctaagaggaacgtagaaagtagttgttcgtacttagttttntttactacggacctagtactaaattaattaaacgtttcgtacggtctacggtccgtacgtacgttccggaccgaacggggaacttaagggacgaaagtaccgaaacgacgttggttcggaactacgctacattccgtgttccttaac

SEQ ID NO: 396121 - DNA, 695 bp, Homo sapiens
  misc_feature: GZ8MTXP01EUVQY.21.27.C05.1.454.CMB.2.raw
  modified_base (202)..(202): a, c, t, g, unknown or other
  modified_base (311)..(311): a, c, t, g, unknown or other
  modified_base (342)..(342): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagcccacctgtctgtgtctcggagggggncgcccacctctcctgcacagccagtcagtctatcgctgacttggtagcctaggtaccagtacaagaatcgtcggccaggcctcccgaggtcctcctctaactttcccgngaccactcccgacgacgggcctacgtggtcncccaagtctacggttcaggtgggcggtggtaacgtttgggaactaggtacgttttccacgtcctacgatccgacgccgtaccctagagtaggtagaaagtgtttggttgtacttaacggttttcttacgtacgacctagttaacctaaagtttaacgttaacgttacgtcgggtaccgttcggtaacccgggttaccggtaccgggtttaacggggaccccggtaaacgggggtaaacccgttaaagggggttaaaccaaaacgttaaaccggaaaaccggttaagttcggggttaacgggtccctacggaaccctaaacccggttacgtttaccgttaaccgtttctaaccg

SEQ ID NO: 396122 - DNA, 751 bp, Homo sapiens
  misc_feature: GZ8MTXP01A0CO5.21.27.C05.1.454.CMB.2.raw
  modified_base (205)..(205): a, c, t, g, unknown or other
  modified_base (221)..(221): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacnccgcccacctctccgngaccacacgccagtcacgttctagtcgtctgtacgttggttacgtccgtacggaccagacgaagtaacgtcgtacggaccgacggccctacccgacgtccctccgttacttaccgtttccggctacctaaccgtaccccgaccggaccgggaccctacggttcggtccgtacccgaggtacgtaccggttcgcggtgggtcggtaggttaaacggttagggtaacgttacgtttacgttttcctccgtaccgtactacgtaccgtacgtccccgtaaccgtagacggtagttagaagtgttcgttagttacgttagttttactcgtacgacgtaagtaacttaagttaacttaacgttcgtcgtaccgtacggtccggttaccggtaccggttaaccggggaaccccgtaacggggtaaaccgttaaacgggggtaaacgttaaaaccgtaaacggtaaacggttacgttcggttacggtaacctccggtaacccgtaaccgttgttacccgtttaactttccgttaacc

SEQ ID NO: 396123 - DNA, 612 bp, Homo sapiens
  misc_feature: GZ8MTXP01EZYAN.21.27.C05.1.454.CMB.2.raw
  modified_base (243)..(243): a, c, t, g, unknown or other
  modified_base (254)..(254): a, c, t, g, unknown or other
  modified_base (276)..(276): a, c, t, g, unknown or other
  modified_base (308)..(308): a, c, t, g, unknown or other
  modified_base (418)..(418): a, c, t, g, unknown or other
  modified_base (436)..(436): a, c, t, g, unknown or other
  modified_base (586)..(586): a, c, t, g, unknown or other
tcagtcgtcgctcgcacgaccggtgctcgatttagacgcgatcgaagggtttggggggaggaactgctcagttaggacccagacggagccatggaagccccagcgcagcttctcttcctcctgcttctctggctcccagacaccactggagtgattgtgatgacgcagtctcagccaccctgtctgtgtcgtccgaggggggagccgccacccctctcctgccacagccagtcagtctatcgntgactggttanccgtggtaccagcagaaatcgnggccaggcctccgagctcctctatttaccgtncactccgaccacgggccacgtggtcgtcccagactacgggttcaggtgggcgggtggtaagtttggggaactaggtagttttctctacacctatccagccgccctaacgngagtagaagatcgttagnttacgtttagttcaggtaccgaatactaaattaagtaactttacgcggttcctaggtccgtcggtaccggttaccggccggtaaccggggaaacgttaagggtaacgaaagtaaccgaaacgaaacggttggttacgtaacgtcgaaccncgtattcgttaacgttccgttaaccg

SEQ ID NO: 396124 - DNA, 794 bp, Homo sapiens
  misc_feature: GZ8MTXP01CRQDR.21.27.C05.1.454.CMB.2.raw
  modified_base (206)..(206): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagaccaccactggagtgattgtgatgacgcagtctccagccacctgtctgtcgtctccgaggggggacnccgcccaccctctcctgcacacgccagtcagtctagtcgctgacgttcggtacgccgttaggaccagacgaagtaacgtcgtcggccgacggtccctacccgacgtcccttaccgtacttacgtttacccggtgtacctaccgtaccccgaaccggacgggtaccctacggttcggtaccgtaacccgacgtaccggtacggttcggagggttcgggtacgggtagggttaaacgggtttacgggaacgttaacggttttaccgttttccgtaccgtaccgaacctacgttacccgacgtacccgtaacccgtaacgtagggtaacgttaaggtaaagttagttggttacgtaacgtttagttttacttacgtacgtaaccggtaagttaaaccttaaacgttaaacgtttaaccgtttaccggtcggttacccgttcggtacccggttaccgggtaccgggtacccggtaacccgggaaaccggggtaaacgttaaacggggttaacgaaaaccgttaaaccggtaaacggttaaggttcggttacgtcgttacgaaccttaacgtcttacgttcgttccgttaacg

SEQ ID NO: 396125 - DNA, 497 bp, Homo sapiens
  misc_feature: GZ8MTXP02GDNX1.21.27.C05.1.454.CMB.2.raw
  modified_base (199)..(199): a, c, t, g, unknown or other
  modified_base (209)..(209): a, c, t, g, unknown or other
  modified_base (317)..(317): a, c, t, g, unknown or other
  modified_base (359)..(359): a, c, t, g, unknown or other
tcagtcgtcgctcgcacgaccggtgctcgatttagacgcgatcgaagggtttgggaggaactgctcagttaggacccagacggagccatggaagccccagcgcagcttctcttcctcctgcttctctggctcccagacaccactggagtgattgtgatgacgcagtctccagccaccctgtctgtgtctccagggggancgccaccctntcctgcacagccagtcagtctatcgctgactggtagcctggtaccagcagaaatctggccaggctcccaggctcctcatttaccgtgcatccaccagggccactggtntcccagacaggttcagtgcgtggatttggggcagagttttcnctcacatcagcgccctacagagtgaagatgttagctagtttattctgccagcaatataatactggcctgcgtcgacgttcggccacgggaccaaggtggaaaatcaaaacgaactgtaggctgcaccatctgtctttc

SEQ ID NO: 396126 - DNA, 700 bp, Homo sapiens
  misc_feature: GZ8MTXP02HOXXG.21.27.C05.1.454.CMB.2.raw
  modified_base (201)..(201): a, c, t, g, unknown or other
  modified_base (297)..(297): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggctcccaggctcctcatttaccgncactccaccgacgggcccacgtcggtcgtacccagacgtacggttcgaggtcgggtcgggtggtaggtttggggactaggttacgtttttcctaccgttaccaacctatccgacgcccgtacccctaacgaacggtaggtagtaaagtagtttcggtttacgtacgtttaagtttttacttttccgttacggtacctaagtaacttaaaatttaacgttaaaacgtttaccgtcggtacccgttcggtaccggttaccggtaccggttaccgggacccggtaaaccgggggtaaaccggtaaaggggtaacggtaaaaacgttaaaccgaaaaaccggtaacgttacgggtacggtaaccgtacggaacctaacctacgtttccgttacgtttacctttaccg

SEQ ID NO: 396127 - DNA, 527 bp, Homo sapiens
  misc_feature: GZ8MTXP02IAWQU.21.27.C05.1.454.CMB.2.raw
  modified_base (200)..(200): a, c, t, g, unknown or other
  modified_base (300)..(300): a, c, t, g, unknown or other
  modified_base (323)..(323): a, c, t, g, unknown or other
  modified_base (372)..(372): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctccccaggcctcctcattttaccgngcatccaccagggcccactggtntccccagacaggttccagtggcggtggatttggggactgtagtttttcnctcaccatcagccgccctacagagtgaaagtattgttgctagttttattctgccagctaaattattaattactggcctgcgtcgacgttcggccgacgggaccaagggtggaaaactacgaaaacgacgtgtaggctgcaccatctgtcttacac

SEQ ID NO: 396128 - DNA, 555 bp, Homo sapiens
  misc_feature: GZ8MTXP02FWNAJ.21.27.C05.1.454.CMB.2.raw
  modified_base (202)..(202): a, c, t, g, unknown or other
  modified_base (304)..(304): a, c, t, g, unknown or other
  modified_base (406)..(406): a, c, t, g, unknown or other
  modified_base (418)..(418): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacncgccacctctcctgcacagccagtcagtctatcgctgactggtagcctggtaccagcaagaaatcgtggccaggcctcccgaggcctcctctactttaccgngcactcccaccgacgggccacgtggtcgtcccagacgtacggttcaggtggcggtggtagtttggggactagtagttttctctccacatcagccgaccctanagagtagaagtnttgttgacttagtttattctgaccagtactaaattaattaattacgtggcctggcgtcgtacgttcggaccgaacgggaccgaaagggtacgaaaactacgaaaacgtactggacgctcgacactatctcgttcttc

SEQ ID NO: 396129 - DNA, 514 bp, Homo sapiens
  misc_feature: GZ8MTXP02IQXMS.21.27.C05.1.454.CMB.2.raw
  modified_base (201)..(201): a, c, t, g, unknown or other
  modified_base (297)..(297): a, c, t, g, unknown or other
  modified_base (369)..(369): a, c, t, g, unknown or other
  modified_base (415)..(415): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggctcccaggctcctcatttaccgngcatccaccagggcccacgtggtcgtcccagacaggttcaggtggcggtggatttggggctaggtagtttcnctcaccatcagcgccctacagagtgaagatgtgctagtttatttcngtccagtcaaattataaattctggcctgcgtcgacgttcggccacgggaccaaggtacgaaaactcgaaaacgaactgtaggctgcaccatctagtctc

SEQ ID NO: 396130 - DNA, 514 bp, Homo sapiens
  misc_feature: GZ8MTXP02GRN0E.21.27.C05.1.454.CMB.2.raw
  modified_base (199)..(199): a, c, t, g, unknown or other
  modified_base (296)..(296): a, c, t, g, unknown or other
  modified_base (319)..(319): a, c, t, g, unknown or other
  modified_base (367)..(367): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatccaccagggcccactggtntcccagaccaggttccagtggcggtggatttggggactgtagttttcnctcaccatcagcgccctacagagtgaagatgttgctagtttattctgccagcaatataattactggcctgcgtcgacgttcgccgtacgggacaaggtaggaaactacgaaaacgactgtaggctgacaccatcctgttcttactac

SEQ ID NO: 396131 - DNA, 555 bp, Homo sapiens
  misc_feature: GZ8MTXP02JCTYE.21.27.C05.1.454.CMB.2.raw
  modified_base (405)..(405): a, c, t, g, unknown or other
  modified_base (495)..(495): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcaacaatggtggaattggattaggcagtccccgtcgagaggccttgagtggcttggaaggcctattatacgtccagtgtatgaagactatgcagattctgtgagcggtcgtctcaccatccacccagacacgtccaagaatcagtcncctacacctaatcgtctgtcactcccgacgacacggtctacgtttattttgtcgtacaaaggagggacttccaacgtacgtttccgggtntaaccttaaccgttcccgttacgacgttcccgtcgggggacccctaagggggttaacccg

SEQ ID NO: 396132 - DNA, 528 bp, Homo sapiens
  misc_feature: GZ8MTXP02GG5MU.21.27.C05.1.454.CMB.2.raw
  modified_base (200)..(200): a, c, t, g, unknown or other
  modified_base (370)..(370): a, c, t, g, unknown or other
  modified_base (400)..(400): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccagggggancgccaccctctcctgcacagccagtcagtctatcgctgactggttagcctggtaccagcagaaatctggccaggctcccaggctcctcatttaccgtgcatcccaccagggccactggtcgtcccagacaggttcagtggcggtggatttggggactagtagtttttccnctcacatcagccaccctagagagtagaagntgttgcttagtttattctgacagtactaattattaattacgtgtctgcgtcgtacgttcggaccgacgggacgaaggtacgaaactacgaaacgtacgtgtaggcgtacgactactatcgtcgttctc

SEQ ID NO: 396133 - DNA, 507 bp, Homo sapiens
  misc_feature: GZ8MTXP02FUJKD.21.27.C05.1.454.CMB.2.raw
  modified_base (198)..(198): a, c, t, g, unknown or other
  modified_base (318)..(318): a, c, t, g, unknown or other
  modified_base (355)..(355): a, c, t, g, unknown or other
tcagtcgtcgctcgcacgaccggtgctcgatttagacgcgatcgaagggtttggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggctcccaggctcctcatttaccgtgcatccaccagggcccactggtntcccagacaggttccagtggcggtggatttggggacngtagtttctctcaccatcagcgccctacagagtgaagatgttgctagtttattctgccagcaatataattactggcctgcgtcgacgttcggccacgggaccaaggtggaaactcaaaacgaactgtggctgcaacactctacgtcttctac

SEQ ID NO: 396134 - DNA, 514 bp, Homo sapiens
  misc_feature: GZ8MTXP02IM3NF.21.27.C05.1.454.CMB.2.raw
  modified_base (200)..(200): a, c, t, g, unknown or other
  modified_base (267)..(267): a, c, t, g, unknown or other
  modified_base (289)..(289): a, c, t, g, unknown or other
  modified_base (298)..(298): a, c, t, g, unknown or other
  modified_base (358)..(358): a, c, t, g, unknown or other
  modified_base (368)..(368): a, c, t, g, unknown or other
  modified_base (386)..(386): a, c, t, g, unknown or other
  modified_base (492)..(492): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatcnggccaggctcccaggcctcctnatttaccgngcatccacagggcccacgtggtctcccagacaggttccaggtggcggtggatttgggacnggtattttcnctcaccatcagcgcctanagagtgaagattgttgctagtttattctgccagactaattataattactggtcctgcgtacgacgttcgcgacgggaccaaggtagaaactacgaaacgacgtagngctgacacatctcgtctactac

SEQ ID NO: 396135 - DNA, 523 bp, Homo sapiens
  misc_feature: GZ8MTXP02HINJ5.21.27.C05.1.454.CMB.2.raw
  modified_base (406)..(406): a, c, t, g, unknown or other
  modified_base (453)..(453): a, c, t, g, unknown or other
  modified_base (460)..(460): a, c, t, g, unknown or other
  modified_base (481)..(481): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcaacaatggtggaattggattaggcagtccccgtcgagaggccttgagtggcttggaaggacctattatacgtcccagtggtatgaagactatgcagattctgtgagcggtcgtctcaccatcacccagacacgtcaagaatcagtcncctcacctaatgtctgtcactcccgacgacacggcagtttattttgngtcaagngggacttcgactacttcggtnactaaccgtcttacgactccgtcggggaccaggggttaaccg

SEQ ID NO: 396136 - DNA, 670 bp, Homo sapiens
  misc_feature: GZ8MTXP02GBUMZ.21.27.C05.1.454.CMB.2.raw
  modified_base (204)..(204): a, c, t, g, unknown or other
  modified_base (458)..(458): a, c, t, g, unknown or other
tcagtcgtcgctcgcacgaccggtgctcgatttagacgcgatcgaagggtttggggaggaactgctcagttaaggacccagacggagccatggaagccccagcgcagcttctcttcctcctgcttctctggctcccagacaccactggagtgattgtgatgacgcagtctccagccaccctgtctgtgtctccgaggggggacnccgccacctctcctgcacagccagtcagtctatcgctgactggtacgccgtggtaccagacaagaaatcgtcggaccaggcctcccgaggccttcctactacgtttaccgtgacctactcccaccgacgggccctacgttcggtcgtacccagacgtacggttcaggtcgggcggtaggtagtttaggggactaggttacgttttctacctaccaacctatcgacgtcccgtaccctacgagtagtagaaagtnttagttacgtacttagttttactttccgtacgtacctaagtactaaattaattaaacgttacgtcggtacccgttcggtaccggttaccggtaccggttcccgggaacccgtaaccggggtaaccgtaaagggtaacggaaaacgtaaccgaaaaccgtacgtacggtacgtaaccgtacgacctacgtacgttacgtacgtttaccttacg

SEQ ID NO: 396137 - DNA, 636 bp, Homo sapiens
  misc_feature: GZ8MTXP02F4SN0.21.27.C05.1.454.CMB.2.raw
  modified_base (203)..(203): a, c, t, g, unknown or other
  modified_base (309)..(309): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacnccgccaccctctcctgcacagccagtcagtctatcgctgactggtagcctggtaccagcaagaaatcgtggccaggcctccccgaggcctccctctactttaccgngcactcccaccgacgggcccacgtcggtcgtacccagacgtacggttcaggtcgggcgggtggtagtttggggactaggttacgtttttcctcctaccaacctatccgacgcccgtacccctaagaggtaagtagaaagtagttggttgacttagttttactttcgtcgacctagtactaaaattaacttaaatttaccgtcggtccttggtccggttaccggtaccgggttccgggacccggtaaccggggtaaccgtaaaggggtacggaaaactaccgaaaacgtacgtggtacggcgtacgaccacctattctcgttacttac

SEQ ID NO: 396138 - DNA, 609 bp, Homo sapiens
  misc_feature: GZ8MTXP02HRKFD.21.27.C05.1.454.CMB.2.raw
  modified_base (204)..(204): a, c, t, g, unknown or other
  modified_base (323)..(323): a, c, t, g, unknown or other
  modified_base (412)..(412): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggggacnccgccaccctctcctgcacagccagtcagtctatcgctgacttggtacgccgtaggtaccagacaagaaactcgtcggaccacggccctcccgacggtcctccctactacgtttaccgngacctactcccgaaccgacgggccctacgtcggtcgtaccccagacgtacggttcgaggtggcggtggtagttgggactagttatttcnctcacatcagccaccctagagagtagaagtattgttgacttagtttattcgtgtacctagtactaaattaattaaattacgtcggtactggccgttacgtaccggttcggacccgtaacgggaacgtaaagggtacgaaaactaacgaaaacgtacgttaggtacggcgtagacctactacgttctacgtttactcg

SEQ ID NO: 396139 - DNA, 504 bp, Homo sapiens
  misc_feature: GZ8MTXP02I01TA.21.27.C05.1.454.CMB.2.raw
  modified_base (201)..(201): a, c, t, g, unknown or other
  modified_base (320)..(320): a, c, t, g, unknown or other
  modified_base (364)..(364): a, c, t, g, unknown or other
  modified_base (392)..(392): a, c, t, g, unknown or other
  modified_base (430)..(430): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggancgccaccctctcctgcacagccagtcagtctatcgctgactggttagcctggtaccagcagaaatctggccaggctcccaggctcctcatttaccgtgcatccaccagggccactggtntcccagacaggttcagtggcggtggatttgggctagtagtttcnctcacatcagcgccctacagagtgaagntgttgctagtttatttctgccagtcaatataaattacnggctgcgtcgacgttcgccgacgggacaaggtcggaaaatcgaaaacgactgtaggctgacacatctgtacttc

SEQ ID NO: 396140 - DNA, 504 bp, Homo sapiens
  misc_feature: GZ8MTXP02FWZEX.21.27.C05.1.454.CMB.2.raw
  modified_base (201)..(201): a, c, t, g, unknown or other
  modified_base (322)..(322): a, c, t, g, unknown or other
  modified_base (367)..(367): a, c, t, g, unknown or other
  modified_base (396)..(396): a, c, t, g, unknown or other
  modified_base (414)..(414): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggctcccaggcctcctcatttaccgtgccatccaccagggccactggtntcccagacaggttcagtggcggtggatttggggcagtagttttcnctcaccatcagcgccctacagagtgaagntgttgctagtttatttcngccagcaatataattctggcctgcgtcgacgttcggccacgggaccaaggtacgaaatcaaaacgactgtacggctgcacatctgtcttc

SEQ ID NO: 396141 - DNA, 595 bp, Homo sapiens
  misc_feature: GZ8MTXP02JBJ75.21.27.C05.1.454.CMB.2.raw
  modified_base (201)..(201): a, c, t, g, unknown or other
  modified_base (247)..(247): a, c, t, g, unknown or other
  modified_base (296)..(296): a, c, t, g, unknown or other
  modified_base (372)..(372): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtancctggtaccagcagaaatctggccaggctccaggctcctcatttaccgnacactccacgaggccacgtcggtctcccagactacggtcaggtcggcgggtgtagtttgggactagttacgtttcnctacactatcacgccaccctaagagtagtagaagtattggttagacgttagttttacttcgcgtaccaagtactaaattaacttaaattacgtcggtacctggtccgttaccggtaacggttccgggaacccgtaaccggggtaaaccgtaaaggggtaacgtaaaactacgaaaacggtaacgtggaggtcctacgacctacctattcgttacgttactacg

SEQ ID NO: 396142 - DNA, 538 bp, Homo sapiens
  misc_feature: GZ8MTXP02GYBDB.21.27.C05.1.454.CMB.2.raw
  modified_base (202)..(202): a, c, t, g, unknown or other
  modified_base (249)..(249): a, c, t, g, unknown or other
  modified_base (299)..(299): a, c, t, g, unknown or other
  modified_base (371)..(371): a, c, t, g, unknown or other
  modified_base (407)..(407): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttancctggtaccagcagaaatctggccaggctcccaggctcctcatttaccgngccatcccaccagggcccactggtctcccagacaggttcagtggcggtggatttggggactagtagttttcncttcacctatcagccgaccctacagacgtgaaagtntggttgactagtttattctgcctagctaatataattacgtgcctgcgtcgacggttcgaccgtacgggaccaagggtacgaaaagtacgaaaacgtaactggtaggctcgacctaccatcgtcgtctttac

SEQ ID NO: 396143 - DNA, 535 bp, Homo sapiens
  misc_feature: GZ8MTXP02GOW2H.21.27.C05.1.454.CMB.2.raw
  modified_base (203)..(203): a, c, t, g, unknown or other
  modified_base (213)..(213): a, c, t, g, unknown or other
  modified_base (290)..(290): a, c, t, g, unknown or other
  modified_base (299)..(299): a, c, t, g, unknown or other
  modified_base (317)..(317): a, c, t, g, unknown or other
  modified_base (324)..(324): a, c, t, g, unknown or other
  modified_base (356)..(356): a, c, t, g, unknown or other
  modified_base (385)..(385): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctntcctgcacagccagtcagtctatcgctgactggtagcctggtaccagcaagaaatctggccaggctccaggctcctnatttaccgncatccacagggccatggnccagacnggttcagtgcggtggattgggcagtagtttcnctcacatcagccgcctacagagtgaaagnttgttgctagtttacttcgtgaccgatactaaattaattaaattacgtggtaccttggacgttacgtacggttcggaccgacgggtaaccaaagggtacggaaaatacgaaaacgaactggtacgcgtacgacacactactcgttctacg

SEQ ID NO: 396144 - DNA, 520 bp, Homo sapiens
  misc_feature: GZ8MTXP02GD7UD.21.27.C05.1.454.CMB.2.raw
  modified_base (202)..(202): a, c, t, g, unknown or other
  modified_base (370)..(370): a, c, t, g, unknown or other
  modified_base (389)..(389): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggctcccaggctcctcatttaccgtgcatcccaccagggccacgtggtcgtcccagacaggttcagtggcggtggatttggggacagtagttttcnctcacatcagccgccctanagagtgaagatgttgctagtttatttctgccagctaatataattactggcctgcgtcgacgttcgaccgacgggaccaagggtacgaaatacgaaaacgaactggtaggctcgacaccatctcgtctttac

SEQ ID NO: 396145 - DNA, 542 bp, Homo sapiens
  misc_feature: GZ8MTXP02G639S.21.27.C05.1.454.CMB.2.raw
  modified_base (202)..(202): a, c, t, g, unknown or other
  modified_base (302)..(302): a, c, t, g, unknown or other
  modified_base (370)..(370): a, c, t, g, unknown or other
  modified_base (389)..(389): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggcctcccaggcctcctctatttaccgncatcccacagggccacgtggtctcccagacaggttcagtggcggtggatttggggactagtagtttcnctcacatcagccgccctanagagtgaagatgttgactagtttattctgaccagtactaaattataattacgtggacctggacgtcggacgttcggaccgtaacggggacctaagggtacgaaatacgaaaaccgtacgtggtcgcgtcggaccacgtatcctgtactttacg

SEQ ID NO: 396146 - DNA, 694 bp, Homo sapiens
  misc_feature: GZ8MTXP02IAT80.21.27.C05.1.454.CMB.2.raw
  modified_base (203)..(203): a, c, t, g, unknown or other
  modified_base (304)..(304): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccaggcctcctctactttaccgngcatccactacgggccacgtggtcgtcccagactaggttcaggtggcgggtggtagtttgggactaggttacgtttttcctcctaccacctattcccgaacgtcccgaccccttaacgaggtaacggttagaaaaggtagtttcggtttaggtacctttaggtttttacttttccgtacggtaccctaaggtaccttaaaatttaagttaaaactttaccgtcgggtacccgttggtcccggttacggtaacccggggtttccgggaaccccgtaaaccgggggaacccgtaaaagggggttaacggaaaaacttaccgaaaaaccgtaacgttggtacgggtaacttacggacctaaacccgtagttcctttacggtttcctttacccg

SEQ ID NO: 396147 - DNA, 539 bp, Homo sapiens
  misc_feature: GZ8MTXP02IGEPB.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatcgtaccggggaaaatgtcgctggcaacaatggttggaattggattaggcagtccccgtgagaggccttgagtggcttggaaggacctattatacgtcccagtggtatgaagactaatgacagattctagtgagcggtcgtctcgacctatccaccccagacacgtaccaaagaatacaggtacctccctaccacctaatcgtctcgtcactccgacacgacggctagtttatttgtgactagagggatacgactacttacgtagactaaccgtctacgactcgtcgggcctagggtaaccg

SEQ ID NO: 396148 - DNA, 549 bp, Homo sapiens
  misc_feature: GZ8MTXP02JEC4U.21.27.C05.1.454.CMB.2.raw
  modified_base (496)..(496): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcaacaatggtgaattggattaggcagtccccgtgagaggccttgagtggcttggaaggacctattatacgtcccagtggtatgaagactatgcagattctgtgagcggtcgtctcaccatcaccccagacacgtaccaagaactcaggtcctccctaccaccttaaatcgtctgtccactccgacgacacggctagtttatttgagtacgaagaggggactcaactagttccggtanaccgttaaccttccttacgtacctcccgtcggggacccgtaggggtttaaccg

SEQ ID NO: 396149 - DNA, 505 bp, Homo sapiens
  misc_feature: GZ8MTXP02GD9XF.21.27.C05.1.454.CMB.2.raw
  modified_base (201)..(201): a, c, t, g, unknown or other
  modified_base (298)..(298): a, c, t, g, unknown or other
  modified_base (364)..(364): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggctcccaggctcctcatttaccgngcatccaccagggccactggtgtcccagacaggttcagtggcggtggatttgggcagtagttttcnctcaccatcagccgccctacagagtgaagattgttgctagtttattctgccagcaaatataattactggcctgcgtcgacgttcggccacgggacaaggtcgaaaatcaaaacgactggtaggctgctaccatctgtcttc

SEQ ID NO: 396150 - DNA, 515 bp, Homo sapiens
  misc_feature: GZ8MTXP02JUKOX.21.27.C05.1.454.CMB.2.raw
  modified_base (355)..(355): a, c, t, g, unknown or other
  modified_base (365)..(365): a, c, t, g, unknown or other
  modified_base (451)..(451): a, c, t, g, unknown or other
  modified_base (477)..(477): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatctccggggaaatgtcgctggcaacaatggttggaattggattaggcagtccccgtcgagaggccttgagtggcttggaaggacctattatacgtccagtggtatgaagactatgcagnttctgtgagngtcgtctcaccatccacccagacacgtccaagatcagtctcctcacctaatgtctgtcactccgacgacacggctagtttatttgngtacaagaggatcactacgttcggtnactaaccgtccttagactcgtcggggccagggtaaccg

SEQ ID NO: 396151 - DNA, 546 bp, Homo sapiens
  misc_feature: GZ8MTXP02GRR8I.21.27.C05.1.454.CMB.2.raw
  modified_base (202)..(202): a, c, t, g, unknown or other
  modified_base (300)..(300): a, c, t, g, unknown or other
  modified_base (376)..(376): a, c, t, g, unknown or other
  modified_base (395)..(395): a, c, t, g, unknown or other
  modified_base (405)..(405): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggctcccaggcctcctctatttaccgngcatcccaccgacgggccacgtggtctccccagacaggttcaggtgggcggtggagtttggggactagtagtttcnctcacatcagccgccctanagagtgaagntgttgctagtttattctgccagactaatattaatacgtggcctgcgtcgtacgttccggcccgtaacgggacccaaagggtacggtaaaactacgaaaacgaacgtggtacggctacggaccacctatcctcgttctttac

SEQ ID NO: 396152 - DNA, 727 bp, Homo sapiens
  misc_feature: GZ8MTXP02FVCKM.21.27.C05.1.454.CMB.2.raw
  modified_base (204)..(204): a, c, t, g, unknown or other
  modified_base (314)..(314): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggggacnccgccacctctcctgcacagccagtcagtctatcgctgacttggtacgccgtggtaccagcaagaaactcgtcggccaggcctacccgaggccttcctctactttaccgngaccactcccgaccgacgggccctacgttcggtccgtcccgaaggaccgtacggttcgagggtcgggtcgggttaggtagtttacggggactaggttacgtttttccacctacctaacctatccgaacgtcccgtacccctaacgaaggtacggtagtaaagtagtttggttacgtacgtttaagttttactttaccgtcgtacctaagtacttaaaagttaactttaaacgtttaccgtcgggtaccctggtaccggttaccggttaccgggttacccgggacccggtaaaccggggtaaaccggtaaacggggtaacggtaaaacgttaaaccggaaaaccggtaaacgttcgggtacgggtaaccgttacggacctaacccgtacgtttaccgttacgtttacctttacg

SEQ ID NO: 396153 - DNA, 647 bp, Homo sapiens
  misc_feature: GZ8MTXP02JELML.21.27.C05.1.454.CMB.2.raw
  modified_base (309)..(309): a, c, t, g, unknown or other
  modified_base (410)..(410): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacccgccaccctctcctgcacagccagtcagtctatcgctgactggtacgcctggtaccagcaagaaactcgtcggccaggcctcccgaggcctcctctactttaccgngcactcccaaccgacgggccctacgttcgggtccgtaccccaggaccgtacggttcgaggtcgggcggttggtagtttggggactaggttacgtttttccncctaccactactcgacgtcccgtaccctacgagtagtagaagtgttgttcgtacttagtttactttcgtcgtacctagtactaaattaacttaaacgtttacgtcggtccttcggtccgttacggtaccggttccgggacccgtaaccggggtaaccgtaaaggggtaacggaaaactaccgtaaaaacgtacgtaggtacggaacgtacgacctaactagttccttcgttacttcg

SEQ ID NO: 396154 - DNA, 569 bp, Homo sapiens
  misc_feature: GZ8MTXP02HO94M.21.27.C05.1.454.CMB.2.raw
  modified_base (202)..(202): a, c, t, g, unknown or other
  modified_base (249)..(249): a, c, t, g, unknown or other
  modified_base (302)..(302): a, c, t, g, unknown or other
  modified_base (380)..(380): a, c, t, g, unknown or other
  modified_base (399)..(399): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggttancctggtaccagcaagaaatctggccaggcctcccaggctcctctatttaccgngcatccaccagggccacgtggtcgtcccagaccaggttcaggtggcggtggtacgtttggggactaggtagtttttcnctcaccatcagcgccctanagagtgagattgttgcttagtttattctagcctagtacaaattataaacttacgtggtcctggtacgtcggtaccgtttcggacccgtaacgggaccgtaaagggtacggaaaataccgaaaacgaacttggtacgtcgtcgacgtaccctagtccttacgttctttacc

SEQ ID NO: 396155 - DNA, 526 bp, Homo sapiens
  misc_feature: GZ8MTXP02JJD3O.21.27.C05.1.454.CMB.2.raw
  modified_base (354)..(354): a, c, t, g, unknown or other
  modified_base (410)..(410): a, c, t, g, unknown or other
  modified_base (465)..(465): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacaatggtgaattggattaggcagtccccgtgagaggccttgagtggcttggaaggcctattatacgtcccagtggtatgaagactatgcagnttctgtgagcggtgtctcaccatccaccccagaccacgtaccaagaatcaggtccnccctcacctaatgtctgtcacctcccgacgacacggctagtttatttgtgcaagnggactcaactacgttcggtagactcctcgttacggacttccgcggggccacgggtttaacg

SEQ ID NO: 396156 - DNA, 504 bp, Homo sapiens
  misc_feature: GZ8MTXP02IIMZI.21.27.C05.1.454.CMB.2.raw
  modified_base (200)..(200): a, c, t, g, unknown or other
  modified_base (366)..(366): a, c, t, g, unknown or other
  modified_base (389)..(389): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccagggggggancgccaccctctcctgcacagccagtcagtctatcgctgactggttagctggtaccagcagaaatctggccaggctcccaggctcctcatttaccgtgcatccaccagggcccactggtgtcccagacaggttccagtggcggtggatttggggactgagtttttcncttcaccatcagcgccctacagngtgaagatgttgctagtttattctgccagcaatataattactgctgcgtcgacgttcggccacgggaccaggtgaaactacgaaacgacgtgtgctgacaccgatctgtctctac

SEQ ID NO: 396157 - DNA, 566 bp, Homo sapiens
  misc_feature: GZ8MTXP02FUG1P.21.27.C05.1.454.CMB.2.raw
  modified_base (202)..(202): a, c, t, g, unknown or other
  modified_base (417)..(417): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggcctcccaggcctcctctatttaccgtgcactcccaccgacgggcccacgttcggtcgtccccagacacggttcagtgggcggtggagtttggggactagtacgttttctctcaccatcacgccgccctacgagagtagaagntgttgcttagtttactttctagcctagtactaaattaattaattaccgtggtcctgtcgtcgacgtttccggacccgtaacgggaccgaaggttacggaaaacttacgaaaacgtaactggtaggctcggacaccgattctcgtcttac

SEQ ID NO: 396158 - DNA, 587 bp, Homo sapiens
  misc_feature: GZ8MTXP02H1Y2Q.21.27.C05.1.454.CMB.2.raw
  modified_base (203)..(203): a, c, t, g, unknown or other
  modified_base (302)..(302): a, c, t, g, unknown or other
  modified_base (416)..(416): a, c, t, g, unknown or other
  modified_base (428)..(428): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctcctgcacagccagtcagtctatcgctgactggttagcctggtaccagcaagaaatctggccaggctcccaggctcctctatttaccgngcatcccaccgagggcccacgtggtcgtccccaggacacgggtttccaggttgggcgggttggtagtttggggactaggttagtttttcctctacacctatcacgccgccctanagagtgaaagtntgttgcttagtttattctgccagtacaaattataaattacgtggccttggcgttaccgacggtttccggacccgtaacggggaacccgtaaagggtacgaaaacgttacgaaaaccggtaacttggacggctacggactaccattccgttcgttacctc

SEQ ID NO: 396159 - DNA, 523 bp, Homo sapiens
  misc_feature: GZ8MTXP02GOE1C.21.27.C05.1.454.CMB.2.raw
  modified_base (202)..(202): a, c, t, g, unknown or other
  modified_base (299)..(299): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggctcccaggctcctcatttaccgngcatccaccagggcccacgtggtctcccagacaggttcagtggcggtggatttggggctaggtagttttctctcaccatcagccgccctacagagtgaagtatgttgctagtttattctgccagcaatataattactggcctgcgtcgacgttcggacctaacggggaccaagggtcggaaaatcgaaaacgaactggtacgcgtgctaccgatctcgtcttac

SEQ ID NO: 396160 - DNA, 669 bp, Homo sapiens
  misc_feature: GZ8MTXP02H7B2T.21.27.C05.1.454.CMB.2.raw
  modified_base (206)..(206): a, c, t, g, unknown or other
  modified_base (311)..(311): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggggacncgccaccctctcctgcacagccagtcagtctatcgctgactggttacgcctggtaccagcaagaaatcgtggccaggcctcccgaggcctcctctactttaccgngcactcccaccgacgggcccacgtggtcgtcccagactaggttcaggtggcgggttggtagtttggggactagttacgttttcctctaccacctatccacgccgaccctacgaggtagtagaagtagttggttacgtacgttagttttactttcgtcgtacctaagtactaaatttaattaaactttacgtcgggtaccttgggtccggttaccggtaccgggtttcccggggaccccggtaaaccgggggtaacccgtaaagggggtaacggtaaaaacgttaaccgaaaaccggtaaccgttggtacgggtccgtacgaccctaacccgtacttccgtttacgttaccctttaccg

SEQ ID NO: 396161 - DNA, 517 bp, Homo sapiens
  misc_feature: GZ8MTXP02I3FC0.21.27.C05.1.454.CMB.2.raw
  modified_base (199)..(199): a, c, t, g, unknown or other
  modified_base (373)..(373): a, c, t, g, unknown or other
  modified_base (441)..(441): a, c, t, g, unknown or other
tcagtcgtcgctcgcacgaccggtgctcgatttagacgcgatcgaagggtttgggggaactgctcagttaggacccagacggagccatggaagcccctgcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggcctcccaggcctcctcatttaccgtgccatcccaccagggcccacgtggtcgtcccagacaggttccagtggcggtggatttggggactggtagttttcnctcaccatcagcgccctacagacgtagaagtatgttgctagtttattctgccagctaatataattacngctgcgtcgcgtcgccgacgggaccagggtagaaactacgaaacgacgtcgtgctgaccacactctcgtctactac

SEQ ID NO: 396162 - DNA, 678 bp, Homo sapiens
  misc_feature: GZ8MTXP02G2N1Z.21.27.C05.1.454.CMB.2.raw
  modified_base (203)..(203): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctcctgccacagccagtcagtctatcgctgacgttggtacgccgtggtaccagacaagaaatcgtcggaccgacggcctcccgacggtcctcctactactttaccgtcgacctactcccgaccgacgggccctacgtcggtcgtacccgaggtacgtacggttcgaggtcgggtcgggtaggtacgtttggggactaggttacgttttcctcctaccacctactaccgacgtcccgtaccctaacgaggtacgtagaagtagttggttacgtacgttagttttactttcgtacgtaccgtagtaactaaattaattaaacttacgtcggtaccgttcggtaccggttaccggtaccggttaccgggaccggtaaccggggtaaccgtaaagggtaacggtaaaactaccgaaaacgtacgtcggtacggtcgtacgacctacgtacttccgttacgttacttacc

SEQ ID NO: 396163 - DNA, 531 bp, Homo sapiens
  misc_feature: GZ8MTXP02F5KP6.21.27.C05.1.454.CMB.2.raw
  modified_base (203)..(203): a, c, t, g, unknown or other
  modified_base (302)..(302): a, c, t, g, unknown or other
  modified_base (375)..(375): a, c, t, g, unknown or other
  modified_base (395)..(395): a, c, t, g, unknown or other
tcagtcgtcgctcgcacgaccggtgctcgatttagacgcgatcgaagggtttgggggaggaactgctcagttagtacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccaggctcctcatttacccgngcatcccaccgagggcccacgtggtcgtcccagacaggttcaggtggcggtggatttgggctagtagttttcnctcaccatcagccgccctanagagtgaagatgttgctagtttattcgtgccagctaaattataattacgtggtcctgcgtcgacgttccggacctacggggaccaagggtacgaaaatacgaaaacgacgtggtagcgtgacaccatctcgtcttc

SEQ ID NO: 396164 - DNA, 529 bp, Homo sapiens
  misc_feature: GZ8MTXP02GBCKQ.21.27.C05.1.454.CMB.2.raw
  modified_base (202)..(202): a, c, t, g, unknown or other
  modified_base (266)..(266): a, c, t, g, unknown or other
  modified_base (369)..(369): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactgtagctggtaccagcagaaatcnggccaggctcccaggctcctcatttaccgtgcatccaccgagggccacgtggtgtccccagacaggttcaggtggcggtggatttggggactagtagttttcnctccacatcagccgccctacagagtgaagattgttgctagtttatttctgccagcaattataattactaggcctggtcgtcgtacgttcggaccgacggggaccaaagggtcggaaaactacgaaaacgacgtgtaggcgtcgctaccatctgtctttac

SEQ ID NO: 396165 - DNA, 696 bp, Homo sapiens
  misc_feature: GZ8MTXP02JBB7K.21.27.C05.1.454.CMB.2.raw
  modified_base (201)..(201): a, c, t, g, unknown or other
  modified_base (302)..(302): a, c, t, g, unknown or other
  modified_base (412)..(412): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggcctcccgaggcctcctcatttacccgngccactcccaccgtacgggcccacgttcgggtcgtccccaggacctacgggtttccagggttgggccgggttgggtaacttttcggggactagggttacggttttttccnccgttaccaaccctaattcccgaacggcccgtacccccttaacgaggtaagttaggaaagtattggtttagaccttaagttttactttcgtcgaccctaagtactaaattattaaacttaccgtgggtcccttggaccgttaccggtaccggtttccgggacccgtaaccgggggtaacccgtaaaggggtacggtaaaaacttaccgaaaaccggtaaacttgggtaacggccgttacggaccctaaacccggttacgttaccgttacgtttaccctttaccg

SEQ ID NO: 396166 - DNA, 651 bp, Homo sapiens
  misc_feature: GZ8MTXP02JD462.21.27.C05.1.454.CMB.2.raw
  modified_base (306)..(306): a, c, t, g, unknown or other
  modified_base (412)..(412): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacccgccaccctctcctgcacagccagtcagtctatcgctgactggtacgcctggtaccagcaagaatcgtggccaggcctcccgaggcctcctctactttaccgngacctactcccaaccgacgggtccctacgttcggtccgtaccccaagtaccgtacggttcaggtcgggcggttaggtagtttcggggactaggttacgtttttccnccgtaccaacctatccgacgtcccgtaccctaacgagtagtagaaagtagttggttagacttagttttactttcgtcgacctaagtactaaattaacgttaacgttacgtacggtacctggtaccgttaccggtaccggttccggacccgtaaccggggtaaccgtaaaggggtaacgtaaaacgtaccgaaaacgtaacgttggtacggcgtacgacctacctactcgttacgtactc

SEQ ID NO: 396167 - DNA, 607 bp, Homo sapiens
  misc_feature: GZ8MTXP02JLNGX.21.27.C05.1.454.CMB.2.raw
  modified_base (329)..(329): a, c, t, g, unknown or other
  modified_base (356)..(356): a, c, t, g, unknown or other
  modified_base (379)..(379): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggttggaattggattaggcagtccccgtgagaggtcctgagtggctggaaggacctattanacgtccagtgtatgaagactatgcagntctgtgagcggtcgtctcacctntccacccagacacgtacaagaactcaagtcctaccctaccaaccttaatacgtctacgtacctacctacccgacgaccgtacggtacttacgtttttaacttttcggtacgtaccgtaaaggtacgggtaactaccaacgttacgttacggggtacttaacccttaacccgttcccgttacgtaaccgttcccggtacggggtacccgtaaagggggtttaaccccgg

SEQ ID NO: 396168 - DNA, 592 bp, Homo sapiens
  misc_feature: GZ8MTXP02JT24Y.21.27.C05.1.454.CMB.2.raw
  modified_base (202)..(202): a, c, t, g, unknown or other
  modified_base (301)..(301): a, c, t, g, unknown or other
  modified_base (370)..(370): a, c, t, g, unknown or other
  modified_base (422)..(422): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgactggttagcctggtaccagcagaaatctggccaggcctcccaggctcctcatttaccgngcatcccaccagggccactggtctcccagacaggttcagtggcggtggagtttgggctagtagttttcnctcaccatcagccgccctacgagagtgaagtattgttgctagtttatttcgngtccagctaaattattaaattacgtggtccttggcggttaccggtaccggtttccgggaccccgtaacgggggtaacccgtaaaggggttacggaaaacgttaccgaaaaacgtaccgttaggtacggaaccttacggacccaaccgtattccgttcgttacctttaccg

SEQ ID NO: 396169 - DNA, 554 bp, Homo sapiens
  misc_feature: GZ8MTXP02GWLKF.21.27.C05.1.454.CMB.2.raw
  modified_base (203)..(203): a, c, t, g, unknown or other
  modified_base (250)..(250): a, c, t, g, unknown or other
  modified_base (269)..(269): a, c, t, g, unknown or other
  modified_base (299)..(299): a, c, t, g, unknown or other
  modified_base (370)..(370): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggaccagcagaaatcnggccaggctcccaggctcctcatttaccgngcactccaccgagggccacgtggtcgtcccagacaggttcagtggcggtggatttgggctagtagttttcnctcaccatcacgcgaccctagagagtgaagatgttgcttagtttatttctgccagtactaattattaaattacgtggccttggcgttccgtacggttccggccgtaacgggaccgtaagggtacggaaaactacgaaaacgtaacgtggtcgggaactcggaccaccgtactctcgttctttac

SEQ ID NO: 396170 - DNA, 692 bp, Homo sapiens
  misc_feature: GZ8MTXP02JQGD4.21.27.C05.1.454.CMB.2.raw
  modified_base (203)..(203): a, c, t, g, unknown or other
  modified_base (312)..(312): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacnccgccaccctctcctgcacacgccagtcagtctatcgctgactggttacgcctggtaccagcaagaaatcgtcggccaggcctcccgaggcctcctctacgtttaccgngcactcccaccgacgggccctacgtcggtccgtacccgaggtaccgtacggttcgagggtcgggtcggggttaggtaggtttggggactagggtttacgtttttcctaccgttaccaacctactaccgacgtcccgtaccctaacgaggtaggtagaaagtagttggtttacgtacttagtttttactttcgtcggtacctaagtactaaattaacttaaacgtttacgtcggtaccgttcggtccggttaccggtaccgggttccggacccggtaaaccggggtaaccgtaaaggggtaacggtaaaacgtaaccgtaaaaccgtacgtacggtacggtaacgtacgacctaccgtacgttccgttacgttaccttacg

SEQ ID NO: 396171 - DNA, 607 bp, Homo sapiens
  misc_feature: GZ8MTXP02GER04.21.27.C05.1.454.CMB.2.raw
  modified_base (203)..(203): a, c, t, g, unknown or other
  modified_base (384)..(384): a, c, t, g, unknown or other
  modified_base (390)..(390): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctcccaggcctcctctatttaccgtgcactcccaccgagggcccacgtggtcgtccccaggaccagggttcaggtgggcggtggtagtttggggctagtagttttcnctcacntcagcgccctacagagtgaagattgtgcttagtttatttcgtgaccagtactaaattattaaattaccgtggtaccttggccgttccgtacgggtttccggacccgtaaccgggggacccgtaaggggtaacgggtaaaactaccgtaaaaacggtaaccgttagggtacggtaaccgttacggacctaccgtagttaccttcggttcctttacccg

SEQ ID NO: 396172 - DNA, 524 bp, Homo sapiens
  misc_feature: GZ8MTXP02HV9BL.21.27.C05.1.454.CMB.2.raw
  modified_base (204)..(204): a, c, t, g, unknown or other
  modified_base (303)..(303): a, c, t, g, unknown or other
  modified_base (362)..(362): a, c, t, g, unknown or other
  modified_base (373)..(373): a, c, t, g, unknown or other
  modified_base (393)..(393): a, c, t, g, unknown or other
  modified_base (401)..(401): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggttagcctggtaccagcagaaatctggccaggcctcccaggctcctcatttaccgngcatcccacagggccactggtgtccccagacaggttcaggtggcggtggatttggggcnggtagttttcnctcaccatcagccgccctangagtgaanatgttgactagtttatttctgccagactaaatataaattactggacctgcgtcgtacgttcggaccgacgggacaaagggtacgaaaatacgaaaacgactgaggctgacacatctcgtcttc

SEQ ID NO: 396173 - DNA, 527 bp, Homo sapiens
  misc_feature: GZ8MTXP02H5NOR.21.27.C05.1.454.CMB.2.raw
  modified_base (450)..(450): a, c, t, g, unknown or other
  modified_base (459)..(459): a, c, t, g, unknown or other
tcagtcgtcgctcgcacgaccggtgctcgatttagacgcgatcgaagggtttgggggcagagcctgctgacttctggttgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatctccggggaaaatgtcgctggcaacaatggttggaattggattaggcagtccccgtgagaggcttgagtggcttggaaggacctattatacgtccagtggtatgaagactatgcagtattctgtgagcgtcgtctcaccatccacccagacacgtcaaagatcagctcctcactatgtctgtcactccgacgacacggtctagtttatttgngtacaaggnggatcactagttcggactactacctcgttcgaaccgttccgtacggggaccctaggggtaactttcgg

SEQ ID NO: 396174 - DNA, 668 bp, Homo sapiens
  misc_feature: GZ8MTXP02JQFWW.21.27.C05.1.454.CMB.2.raw
  modified_base (200)..(200): a, c, t, g, unknown or other
  modified_base (302)..(302): a, c, t, g, unknown or other
  modified_base (385)..(385): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatcgtggccaggcctcccgaggcctcctctactttaccgngccatcccaccgagggcccacgtggtcgtcccagaccgaggttccaggtcgggcggtggtagtttggggactgtacgttttcncgtacaccatccgacgccgaccctagagtagtagaagtagttgttagtcgttaagttttacttcgtacgcctaagtactaaattaattaaactttacgtcgggtacccttcgggtccgttaccggtaccgggtttacccgggacccggtaaaccgggggtaaacccgtaaaagggggttaacggaaaacgtaacccggtaaaaaccggtaaccgttagggttacgggaccgttaacggacccgtaaaccctacgttccttacggtttaccgttaccttaaccg

SEQ ID NO: 396175 - DNA, 597 bp, Homo sapiens
  misc_feature: GZ8MTXP02F0C89.21.27.C05.1.454.CMB.2.raw
  modified_base (207)..(207): a, c, t, g, unknown or other
  modified_base (305)..(305): a, c, t, g, unknown or other
  modified_base (395)..(395): a, c, t, g, unknown or other
  modified_base (417)..(417): a, c, t, g, unknown or other
  modified_base (430)..(430): a, c, t, g, unknown or other
  modified_base (436)..(436): a, c, t, g, unknown or other
tcagtcgtcgctcgcacgaccggtgctcgatttagacgcgatcgaagggtttgggggaggaactgctcaggtttaggacccagacggagtccatggaagccccagcgcagcttctcttcctcctgcttcgtctggctcccagacaccgactggagtgattgtgatgacgcagtctccagccaccctgtctgtgtctccgagggggancgccaccctctcctgcacagccagtcagtctatcgctgactggtagcctggtaccagcaagaaatctggccaggctcccaggctccgtcatttaccgngacatcccaccagggacccacgttggtacgtaccccaagtactaggtttccaaggtggcggtaggaactttggggacagtacggttttcncgtcaccatcagcgtaccctanagagtagaaagtnttgtgnttagtttacttacgagtcctagtactaattaagtaacttacgtaggacctggccgttcgtacggttccggaccgaacgggaccgtaagggtacgaaaactaccggaaaacgtaacgtcggtacggtaaccgtcgaccgacctagtccgtacgttcttaccg

SEQ ID NO: 396176 - DNA, 1012 bp, Homo sapiens
  misc_feature: GZ8MTXP02ITG97.21.27.C05.1.454.CMB.2.raw
  modified_base (202)..(202): a, c, t, g, unknown or other
  modified_base (307)..(307): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggganccgccaccctctcctgcacagccagtcagtctatcgctgactggttagcctggtaccatcaagaaatcgtggccaggcctcccgaggcctcctctactttaccgngccactccccaccgacgggccctacgttcggtccgtaccccaaggtaccgtacgggtttaccgaagggttcggggtaccggggttaggggttaacggtttttacgggggaaccgttaggggttttaaccggttttttcccgtacccgtttacccgaaacccttaacgttaccccggaaacggtcccccgtaaccccccgtttaaaacggaaacggggttaaacgggttaacgggaaaaacgggtttacgttttacggggttttaacggtaaacccgtttttaaagggttttttaaccgttttttacccggtacccggggttaaacccccgttaaagggtttaaaacccgtttaaaaaacgtttttaaaacgttttaaaaaaccgtttttaaccccgggttaccgggggttaccccctttaaccgggggttaccccggggttttaaccccgggggttaaaccccgggggttttacccccgggggaaaacccccggggttaaaaccccggggggtaaaaccccggttaaaaaggggggtttaaaaccgggtaaaaaaaacccggttaaaccccgggtaaaaaaacccggggttaaaaccggtttccgggggtttaaaacggggtaaccccgttaaccggggaaacccccttaaaacccccggttaatttacccccggtttcgggttttaaacccccgtttaaccccg

SEQ ID NO: 396177 - DNA, 620 bp, Homo sapiens
  misc_feature: GZ8MTXP02II7ZD.21.27.C05.1.454.CMB.2.raw
  modified_base (201)..(201): a, c, t, g, unknown or other
  modified_base (301)..(301): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggtagctggtaccagcagaaatctggccaggcctcccgaggcctcctctactttaccgngcactcccaccgagggcctacgtggtcgtcccagactaggttcaggtgggcggtggtagtttgggactaggttacgtttttcctccgtacaccatccgacgcccgaccctagagagtagaaagtagttgttagtacttagtttatttcgtcgacctagtactaagttaattaaacttacgtacggtacctggtccgttaccggtaccgtttaccgggacccgtaacggggtaaccgtaaaggggtacgtaaaacgtaaccgaaaacgtacgtaggtacgggtaactcggacctaacctagtaccgttacgtttccttac

SEQ ID NO: 396178 - DNA, 604 bp, Homo sapiens
  misc_feature: GZ8MTXP02H3Y44.21.27.C05.1.454.CMB.2.raw
  modified_base (205)..(205): a, c, t, g, unknown or other
  modified_base (311)..(311): a, c, t, g, unknown or other
  modified_base (398)..(398): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggggacncgccaccctctcctgcacagccagtcagtctatcgctgactggttagcctggtaccagcaagaaatcgtcggccaggcctcccgaggtcctcctctactttaccgngcactccaccgagggcctacgtggtccgtcccagacacggttcaggtcgggcggttggtagtttggggactaggttacgtttttccnctaccacctatccacgccgaccctacgagagtagaaagtatgttgacttagtttatttcgtgacctagtactaaattattaattacgtcggtcctgcgtaccgtacgttccggaccgtaacgggaaccgtaaagggtacgaaaacgtaacgaaaacgtaacgttggtacggtaacgtacgaccacctataccgttacgttacctac

SEQ ID NO: 396179 - DNA, 662 bp, Homo sapiens
  misc_feature: GZ8MTXP02F9F3D.21.27.C05.1.454.CMB.2.raw
  modified_base (203)..(203): a, c, t, g, unknown or other
  modified_base (305)..(305): a, c, t, g, unknown or other
  modified_base (385)..(385): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacncgccaccctctcctgcacagccagtcagtctatcgctgactggtagcctggtaccagcaagaaatctggccaggcctcccgaggcctcctctactttaccgngcactcccaccgagggcccacgtcggtctcccagacgtacggttcaggtggcggtggtatttggggactagtagttttcnctcacatcacgccgccctagagagtagaagtattgttgacttagttttactttcgtcgaccaagtactaaaattaattaaaacgtttaccgtgggtaccctggtaccggttaccggtaaccggtttccggggaacccggtaaaaccgggggtaaacccgtaaaagggggttaacgggtaaaaaactaaaccgtaaaaaccggtaaaaccggtaacggttacgggtaacgtacggtaaccgtaacccgtaacgttaccgttacgtttaccgtttaccg

SEQ ID NO: 396180 - DNA, 577 bp, Homo sapiens
  misc_feature: GZ8MTXP02HYH6M.21.27.C05.1.454.CMB.2.raw
  modified_base (202)..(202): a, c, t, g, unknown or other
  modified_base (302)..(302): a, c, t, g, unknown or other
  modified_base (382)..(382): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggttagcctggtaccagcagaaatctggccaggcctcccgaggctcctctatttaccgngcatcccaccgagggcccacgtcggtcgtcccagaccaggttcaggtggcggtggagtttggggactagtagtttttccncgttacacctatccagccgccctagagagtagaagattgtgctagtttattctgcctagtactaattaataattacgtggtccttgccgttacgtacgttccgggacccgtaacggggaacccgaagggtacggaaacttacgaaaacgtaccgtggtacggcgtacggaccaccgtatccgttcgttacttacc

SEQ ID NO: 396181 - DNA, 566 bp, Homo sapiens
  misc_feature: GZ8MTXP02I5AUI.21.27.C05.1.454.CMB.2.raw
  modified_base (357)..(357): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcaacaatggttggaattggattaggcagtccccgtcgagaggccttgagtggcttggaagacctattatacgtcccagtggtatgaagactatgcagnttctgtgagcgtcgtctcacatccacccagacacgtcaagatcagtctcctacacctaatcgtactcgtcacctcccgacgaccaccggtactaggttttactttgtacgtactaaggagggtactctacgtacgtttcgggtacgtaaccttaacccttccgtttcgtaaccttcccgtacgggggtaccctaaggggtttaacccgg

SEQ ID NO: 396182 - DNA, 554 bp, Homo sapiens
  misc_feature: GZ8MTXP02GCLIP.21.27.C05.1.454.CMB.2.raw
  modified_base (202)..(202): a, c, t, g, unknown or other
  modified_base (300)..(300): a, c, t, g, unknown or other
  modified_base (374)..(374): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgactggtagcctggtaccagcagaaatctggccaggctcccaggcctcctcatttaccgncatcccaccgagggccacgtggtcgtccccagacaggttcagtggcggtgagtttggggactaggtagttttcncgtcacctatcacgccgaccctacgagtagtagaagtattgttgacttagtttattcgtcgacctagtactaattattaattacgtggtactgcgtcgtacgttcggaccgtacgggaccaagggtacggaaactacgaaaacgtactggtaggctcgactaccattctacgttcttacg

SEQ ID NO: 396183 - DNA, 566 bp, Homo sapiens
  misc_feature: GZ8MTXP02GG0RD.21.27.C05.1.454.CMB.2.raw
  modified_base (199)..(199): a, c, t, g, unknown or other
  modified_base (300)..(300): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggcctcccgaggcctcctcactttaccgngcactcccaccgagggcccacgtggtcgtcccagactaggttccaggtcggcggtggtagtttggggaactggttagttttctctccacctatcagcccgaccctacagagtagaagtatgttgcttagtttattctagccagactaaattacttaaattacgtcggtcctgtcgtcgtacggttccggaccgtaacgggaaccaagggtacggaaaactacgaaaacgtacgtaggcggactgacactactctacgtcttactac

SEQ ID NO: 396184 - DNA, 557 bp, Homo sapiens
  misc_feature: GZ8MTXP02GJRJO.21.27.C05.1.454.CMB.2.raw
  modified_base (204)..(204): a, c, t, g, unknown or other
  modified_base (306)..(306): a, c, t, g, unknown or other
  modified_base (382)..(382): a, c, t, g, unknown or other
  modified_base (401)..(401): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggtagcctggtaccagcaagaaatctggccaggcctcccaggcctcctctactttaccgngcactcccaccgacgggccacgtggtcgtcccagacaggtcaggtggcggtggtagtttgggactagtagttttcnctcacatcagccgccctanagagtagaagtatgtgctagtttattctcgccagtactaaattataattacgtggccttgcgtcgtacgttcggacccgtaacgggtaccgaaagggtacggaaaactacgaaaacgtactacggtaggctcgactacctatcgtacgtcttaccg

SEQ ID NO: 396185 - DNA, 730 bp, Homo sapiens
  misc_feature: GZ8MTXP02JP15J.21.27.C05.1.454.CMB.2.raw
  modified_base (200)..(200): a, c, t, g, unknown or other
  modified_base (410)..(410): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatcgctgactggtagctggtaccagcagaaatctggccaggcctcccgaggcctcctctatttacccgtgaccatcccaccgacgggccctacgttcgggtcgtaccccgaaggacctaggtttccccgaggtcgggacgggttggtagtttcggggaactagggttacgtttttccnccgttaccgaaccctacgttaccgaacgtcccgtaccccttaaaccgaaggtaacggtaacggtaaaggtagttcggttaggtaccgtttaagtttttaacgtttccgttacggcccctaaaggtaacctaaaatttaaatttaaacgtttaaccgtacggtacccgttagggtccgttaccggttacccgggttaccggggaccccgtaaaaccgggggaacccgtaaaaggggttacggtaaaaacgttaccgaaaaacgtaacgtacggtaacgtacgtaacggactacctaagttctcgtttaccttactaacccg

SEQ ID NO: 396186 - DNA, 591 bp, Homo sapiens
  misc_feature: GZ8MTXP02G9ZYL.21.27.C05.1.454.CMB.2.raw
  modified_base (203)..(203): a, c, t, g, unknown or other
  modified_base (306)..(306): a, c, t, g, unknown or other
  modified_base (377)..(377): a, c, t, g, unknown or other
  modified_base (411)..(411): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggcctcccgaggcctcctctactttaccgngcatcccaccgagggccacgtggtcgtcccagtacaggttcagtggcggtggatttgggactgtagtttcnctcaccatcagccgacctacagacgtagaaagtntgtagctagtttactttcgtagtaccaagtacaaaattattaaacttacgtaggcccttaggaccgttaccggtaacggttccggaccgtaaaccggggaccgtaaagggtaaggaaaacgtaacgaaaacgtaaccgtggtacgaaccgtgacctaacctattaccgtcgttacttacc

SEQ ID NO: 396187 - DNA, 544 bp, Homo sapiens
  misc_feature: GZ8MTXP02FXDJ0.21.27.C05.1.454.CMB.2.raw
  modified_base (358)..(358): a, c, t, g, unknown or other
  modified_base (362)..(362): a, c, t, g, unknown or other
  modified_base (410)..(410): a, c, t, g, unknown or other
  modified_base (463)..(463): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggtggaattggattaggcagtccccgtgagaggccttgagtggcttggaaggacctattatacgtccagtggtatgaagactatgcagnttcngtgagcggtcgtctcaccatccacccagacacgtacaagaatcagtcncctaccacctaatcgtctgtacactcccgagacacggctacgtttattttcgngtacaaggagggacttacgactacgttcggataaccttaacctcgttacgaccttccgtcggggtacctaggggttaaccg

SEQ ID NO: 396188 - DNA, 576 bp, Homo sapiens
  misc_feature: GZ8MTXP02HRUOS.21.27.C05.1.454.CMB.2.raw
  modified_base (204)..(204): a, c, t, g, unknown or other
  modified_base (252)..(252): a, c, t, g, unknown or other
  modified_base (310)..(310): a, c, t, g, unknown or other
  modified_base (387)..(387): a, c, t, g, unknown or other
  modified_base (410)..(410): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggttancctggtaccagcaagaaatcgtggccaggcctcccgaggcctccctctactttaccgngcatcccaccgagggccacgtggtcgtcccagactacggtcaggtggcggtggtagtttgggactagtacgttttcnccttcactatcacgccgccctanagagtagaagtattgttgacttagttttattctgcctagtactaattataattacgtcggtcctggtcgtcgtacggttcggacccgacgggtaccgtaaagggtacgaaaacttacgaaaacgtacgttggacggcgtacgacctacattcgtcgtttacttacg

SEQ ID NO: 396189 - DNA, 511 bp, Homo sapiens
  misc_feature: GZ8MTXP02H38ZT.21.27.C05.1.454.CMB.2.raw
  modified_base (202)..(202): a, c, t, g, unknown or other
  modified_base (361)..(361): a, c, t, g, unknown or other
  modified_base (366)..(366): a, c, t, g, unknown or other
  modified_base (383)..(383): a, c, t, g, unknown or other
  modified_base (491)..(491): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcaagaaatctggccaggctcccaggctcctctatttaccgtgcatccaccagggccacgtggtgtccccagacaggttcagtggcggtgatttgggcagtntttcntcacatcagcgccctanagagtgaaagtatgttgctagtttattctgccagacaatataaattactggccttgcgttcgacgttcggaccgtacgggaccaaggtacgaaatcgaaaacgactgnggctgacacatctcgtactc

SEQ ID NO: 396190 - DNA, 678 bp, Homo sapiens
  misc_feature: GZ8MTXP02IRS1U.21.27.C05.1.454.CMB.2.raw
  modified_base (202)..(202): a, c, t, g, unknown or other
  modified_base (304)..(304): a, c, t, g, unknown or other
  modified_base (383)..(383): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttacgcctggtaccagcaagaaatctggccaggcctcccaggcctcctctatttaccgncactccacgacggcctacgtcggtccgtaccagacgtacggtcgaggtggcggtggtagttcgggactagttactttcnctaccactatcacgcccgaccctagagtagtagaagtagttgttacgtacgttagtttacttcgtacgtacctaagtactaaagttaacttaacgttacgtcggtaccgttcggtaccggttaccggttaccggttacccgggaacccggtaaaccggggtaaaccgtaaacgggggttaaacggtaaaaaccgttaaaccggtaaaaaccggttaaccggttacgggtaaccggtaaccgttaccggaacccgtaaacccgttacgtttaccgtttaccgtttaccctttaccg

SEQ ID NO: 396191 - DNA, 609 bp, Homo sapiens
  misc_feature: GZ8MTXP02HG70N.21.27.C05.1.454.CMB.2.raw
  modified_base (203)..(203): a, c, t, g, unknown or other
  modified_base (250)..(250): a, c, t, g, unknown or other
  modified_base (270)..(270): a, c, t, g, unknown or other
  modified_base (302)..(302): a, c, t, g, unknown or other
  modified_base (375)..(375): a, c, t, g, unknown or other
  modified_base (404)..(404): a, c, t, g, unknown or other
  modified_base (424)..(424): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcaagaatcnggccaggctcccaggcctcctctatttaccgngcatcccaccagggcccacgtggtcgtcccagactacggttcagtggcggtggatttgggactagtagtttcnctcacatcagcgaccctacagagtgaagntgttgactagttttatttcngtaccagtacaaattattaaattacgtggaccttggccgttacgacggtttaccgggaccccgtaaacggggtaacccgaaggggttaacggaaaaacttacccgaaaaacggtaaaccgttgggttacgggaaccctttcggaacccgtaaccctaggtttaccctacggtttcctttaacccg

SEQ ID NO: 396192 - DNA, 515 bp, Homo sapiens
  misc_feature: GZ8MTXP02JJN1Y.21.27.C05.1.454.CMB.2.raw
  modified_base (202)..(202): a, c, t, g, unknown or other
  modified_base (249)..(249): a, c, t, g, unknown or other
  modified_base (298)..(298): a, c, t, g, unknown or other
  modified_base (364)..(364): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttancctggtaccagcagaaatctggccaggctccaggctcctcatttaccgncatccaccagggccactggtctcccagacaggttcagtgcggtgagtttgggactagtagttttcncgtcacctatcacgccgccctacagagtgaagatgttgctagtttatttctgcctagactaattataattactggcctgcgtcgtacgttcggacctacgggacaggtacgaaatcaaacgactggtggctagccacatcgtcgtacttac

SEQ ID NO: 396193 - DNA, 506 bp, Homo sapiens
  misc_feature: GZ8MTXP02FMM1I.21.27.C05.1.454.CMB.2.raw
  modified_base (201)..(201): a, c, t, g, unknown or other
  modified_base (287)..(287): a, c, t, g, unknown or other
  modified_base (296)..(296): a, c, t, g, unknown or other
  modified_base (358)..(358): a, c, t, g, unknown or other
  modified_base (366)..(366): a, c, t, g, unknown or other
  modified_base (384)..(384): a, c, t, g, unknown or other
  modified_base (480)..(480): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggancgccaccctctcctgcacagccagtcagtctatcgctgactggtagcctggtaccagcagaaatctggccaggctccaggctcctnatttaccgngcatcccaaccagggccacgtggtcgtcccagacaggttcagtggcggtggatttggggacngattttcnctcacatcagcgccctanagagtgaagatgttgctagtttattctgccagcaatattaatacgtggcctgcgtcgacgttcggcacgggacaaggtacgaaatcaaaacgtacngtaggctgacgacatcgtcgtcttac

SEQ ID NO: 396194 - DNA, 669 bp, Homo sapiens
  misc_feature: GZ8MTXP02IVLVN.21.27.C05.1.454.CMB.2.raw
  modified_base (200)..(200): a, c, t, g, unknown or other
  modified_base (247)..(247): a, c, t, g, unknown or other
  modified_base (301)..(301): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggcctcccgaggcctcctcactttaccgngcactccaccgacgggcccacgtggtcgtcccagacgtaggttcccaggtgggcggtggtagtttggggactaggttacgttttcctccttccaaccctatccgacgtcccgtacccctaacgacgtaggttaggaaagtagttaggtttacgaccgttaaggttttactttcttacgacccgtaagacctaaaatttaatttaaactttaacgtcgggtacccttggtaccggttaccgtaccgggtttccggggacccgtaaccgggggtaacccgtaaaggggtaacggaaaacgttaccgaaaaacggtaaccgtaggtacggtactaacggaccaaccgtacttcgtacgttactttctaacc

SEQ ID NO: 396195 - DNA, 539 bp, Homo sapiens
  misc_feature: GZ8MTXP02FNL2O.21.27.C05.1.454.CMB.2.raw
  modified_base (202)..(202): a, c, t, g, unknown or other
  modified_base (302)..(302): a, c, t, g, unknown or other
  modified_base (384)..(384): a, c, t, g, unknown or other
  modified_base (404)..(404): a, c, t, g, unknown or other
  modified_base (414)..(414): a, c, t, g, unknown or other
  modified_base (432)..(432): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggcctcccaggcctcctcactttacccgngcactcccaccgagggcccacgttggtcgtccccagaccaggtttcaggtgggcggtggagtttggggactagtagttttcnctcaccatcagccgccctanagagtgaagntgttgctagtttatttcngccagtactaattaataattactggcctgcgtcgacgttcggaccgacgggacaagggtagaaactacgaaaacgactggtacggctacgcaccatctcgttcttac

SEQ ID NO: 396196 - DNA, 557 bp, Homo sapiens
  misc_feature: GZ8MTXP02G0MKS.21.27.C05.1.454.CMB.2.raw
  modified_base (203)..(203): a, c, t, g, unknown or other
  modified_base (298)..(298): a, c, t, g, unknown or other
  modified_base (374)..(374): a, c, t, g, unknown or other
  modified_base (449)..(449): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcaccgccagtcagtctatcgctgactggtagcctggtaccagcagaatctggccaggctcccagctcctctatttaccgngcactccaccgagggcccacgtggtcgtccccagactaggtccaggtggcggtggatttggggactggtattttcnctcaccatcacgccgccctacgagagtgaagtatgttgacttagtttacttctagccagactaattataattacncggtctgtcgtcgtacggttccggacgtacggggacctaagggtacggaaactacgaaacgtacgtcggtaggactcggactaccgtatcgtcgttaccttactaccg

SEQ ID NO: 396197 - DNA, 563 bp, Homo sapiens
  misc_feature: GZ8MTXP02GEYFR.21.27.C05.1.454.CMB.2.raw
  modified_base (200)..(200): a, c, t, g, unknown or other
  modified_base (248)..(248): a, c, t, g, unknown or other
  modified_base (299)..(299): a, c, t, g, unknown or other
  modified_base (381)..(381): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttancctggtaccagcagaaatctggccaggctcccaggcctcctcatttaccgngcatcccaccgagggcccacgtggtcgtcccagaccgtaggttccaggtggcggtggtagtttggggactggtacgttttcnctcaccatcagcgccctacagagtgaagtatgttgctagtttattctgccagtactaaattattaattacgtgtacctgcgtcgacgttccggaccgacgggaccgtaaagggtaggaaaactacgaaaacgacgtaggtcggactaacggacctaacctacttcgtacgttccttactacc

SEQ ID NO: 396198 - DNA, 659 bp, Homo sapiens
  misc_feature: GZ8MTXP02H7G26.21.27.C05.1.454.CMB.2.raw
  modified_base (201)..(201): a, c, t, g, unknown or other
  modified_base (303)..(303): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggttagcctggtaccagacagaaatcgtggccaggcctccgaggctcctctactttaccgngcactcccgaccgagggcctacgtgggtctaccccgaggactacgggttcaggtcggggcggggttaggtaggttttcggggacgtagggtttacgtttttccgtaccttccaacccgtattcccgaacgcccgacccccttaagaggagtagtaaagtagttggttacgacttagttttacttcgtacgccaagttactaaattactttaaacgttcgtacggtcccttggtaccgttaccggtacggttccggacccggtaacgggaaccgtaaagggtacgaaaactaccgtaaaacgacgttaggtacggtaacgtacggacctaaccgtgtaccgttacgttaccttaccg

SEQ ID NO: 396199 - DNA, 612 bp, Homo sapiens
  misc_feature: GZ8MTXP02FT95B.21.27.C05.1.454.CMB.2.raw
  modified_base (202)..(202): a, c, t, g, unknown or other
  modified_base (303)..(303): a, c, t, g, unknown or other
  modified_base (374)..(374): a, c, t, g, unknown or other
  modified_base (406)..(406): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggcctcccgaggcctcctctactttaccgngcatcccacgacgggccacgtggtcgtcccagactaggttcagtggcggtgtagttgggactgtagtttcnctcacatcagccgaccctagagagtagaaagnttggttgtacttaagttttatttcgtcgaccgtatactaaatttaattaaacttaccgtggtaccttcgggtaccggttccggtaccgggtttccgggacccggtaaaccggggtaacccgtaaagggtaacggaaaacttaacgaaaaacggtaaccgtggtaggaaccgtaggaccctaaccgtattcgtacgttcctttaacc

SEQ ID NO: 396200 - DNA, 573 bp, Homo sapiens
  misc_feature: GZ8MTXP02II7GT.21.27.C05.1.454.CMB.2.raw
  modified_base (470)..(470): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtgaattggattaggcagtccccgtgagaggccttgagtggcttggaaggacctatatacgtccagtggtatgaagactatgcagattcgtgtgagtcggtcgtcttcacccatccaaccccagaccacgtccaaagaactcaggtcctccctccacctaatgtctgtccactcccgacgacacggtcaggttttatttgngtacaaaggtagggaactcgtaactacgttccggtagtaacccgttaaccttcccgttacgtacccgttccgtacgggggaccctaacgggggtttaacccgg

SEQ ID NO: 396201 - DNA, 588 bp, Homo sapiens
  misc_feature: GZ8MTXP02HT7PI.21.27.C05.1.454.CMB.2.raw
  modified_base (203)..(203): a, c, t, g, unknown or other
  modified_base (299)..(299): a, c, t, g, unknown or other
  modified_base (375)..(375): a, c, t, g, unknown or other
  modified_base (395)..(395): a, c, t, g, unknown or other
  modified_base (406)..(406): a, c, t, g, unknown or other
tcagtcgtcgctcgcacgaccggtgctcgatttagacgcgatcgaagggtttgggggaggaactgctcagttaggacccagacggagccatggaagccccagcacagcttctcttcctcctgcttctctggctcccagacaccactggagtgattgtgatgacgcagtctccagccaccctgtctgtgtctccgaggggggancgccaccctctcctgcacagccagtcagtctatcgctgactggtagctggtaccagcagaaatctggccaggctcccaggctcctctatttaccgngcatccacgtagggccacgtggtcgtcccagactaggttcaggtggcggtggtagtttggggactagtagttttcncttcacatcagccaccctanagagtagaagnttgttgcttagtttatttctgacctaagtactaaattaattaaactttacgtggtacctggccggttacggacggtttccggaccgtaacggggaccgtaaagggtacggaaaacttaccgaaaacgtaacgttggtaggaaccgttacggacctaacctatccgttacgttacctttaccg

SEQ ID NO: 396202 - DNA, 554 bp, Homo sapiens
  misc_feature: GZ8MTXP02GWTTL.21.27.C05.1.454.CMB.2.raw
  modified_base (356)..(356): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtacggggaaatgtcgctggcaacaatggtggaattggattaggcagtcccgtgagaggcctgagtggcttggaagacctattatacgtccagtgtatgaagactatgcagattcngtgagtcggtcgtctacaccatccaccccagacacgtacccaaagaactcacggtcctccctaccacctaaatgtctgtcactcccgacgacacggctagtttatttgcgtacaaggaggtactcgaactacgttcggtagtaacctaacccttccgttacgaccgtccgtacgggggccctaaggggtttaacccgg

SEQ ID NO: 396203 - DNA, 515 bp, Homo sapiens
  misc_feature: GZ8MTXP02F5XFF.21.27.C05.1.454.CMB.2.raw
  modified_base (202)..(202): a, c, t, g, unknown or other
  modified_base (365)..(365): a, c, t, g, unknown or other
  modified_base (385)..(385): a, c, t, g, unknown or other
  modified_base (392)..(392): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccacagggccactggtgtcccagaccaggttcagtggcggtggatttgggacagtagtttcnctcacatcagcgcctacagngtgaagntgttgctagtttattctgccagcaatataattactggcctgcgtcgacgttcggaccgacgggaccaaagggtaggaaaactacgaaaacgaactggtacggcgtgacaccatctcgtcttac

SEQ ID NO: 396204 - DNA, 540 bp, Homo sapiens
  misc_feature: GZ8MTXP02JFFNJ.21.27.C05.1.454.CMB.2.raw
  modified_base (199)..(199): a, c, t, g, unknown or other
  modified_base (298)..(298): a, c, t, g, unknown or other
  modified_base (364)..(364): a, c, t, g, unknown or other
  modified_base (374)..(374): a, c, t, g, unknown or other
  modified_base (394)..(394): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggcctcccaggcctcctcatttaccgngcatcccaccaggggcccacgtggtcgtccccagacaggttccagtgggcggtggatttggggacngtagttttcnctcaccatcagccgccctanagagtgaagtatgttgcttagtttattctgccagactaattataattactggcctgcgtcgacgttcggaccgacgggaccaaagggtggaaaactacgaaaacgtacgtggtcggctaacgacacctatcctgttaccttctacc

SEQ ID NO: 396205 - DNA, 561 bp, Homo sapiens
  misc_feature: GZ8MTXP02JZTZO.21.27.C05.1.454.CMB.2.raw
  modified_base (201)..(201): a, c, t, g, unknown or other
  modified_base (289)..(289): a, c, t, g, unknown or other
  modified_base (298)..(298): a, c, t, g, unknown or other
  modified_base (320)..(320): a, c, t, g, unknown or other
  modified_base (352)..(352): a, c, t, g, unknown or other
  modified_base (361)..(361): a, c, t, g, unknown or other
  modified_base (372)..(372): a, c, t, g, unknown or other
  modified_base (377)..(377): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctnatttaccgngcatccaccagggccactggtntcccagacaggttcagtggcgtgatttgggcngagttttcntcacatcagcncctanagagtgaagatgttgactagtttacttcgtgtaccagtactaaatattaaattacgtggtcctggtcgtacgtacggttccggaccggtaaccgggaaccgaaagggtacggtaaaactaccgaaaaacgtaacgtaggtacggtaaccgtcgacctaccgtacgttaccgtacgttacttacg

SEQ ID NO: 396206 - DNA, 606 bp, Homo sapiens
  misc_feature: GZ8MTXP02IR2HG.21.27.C05.1.454.CMB.2.raw
  modified_base (159)..(159): a, c, t, g, unknown or other
  modified_base (223)..(223): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtntcctgtcacagatcaaactacagcagtctggtccaggactggtgaggccctcgcagaccctttnactcacctgtgacatcgtaccggggaaatgtcgctggacaacaatggtgaatggattagcagtcccgtgagaggcctgagtggcttggaagtacctattatacgtccagtcgtatagaagtactagtgacagtattcgtgtagtagcggtcgtctcacctacgtacccaaccccgaagacctaccgtaccaaagaactacgacggtcctaccctaccaaccttaatcgttctacgtaccacctcccgacgacacggtactagttttatttcgagtacgtaaaggtagggactacgaacgtacgttaccgggtactaacccgttaacccttaccgttaccggtaccgttcccggtacggggtaccgtaacggggtttaacccgg

SEQ ID NO: 396207 - DNA, 577 bp, Homo sapiens
  misc_feature: GZ8MTXP02JVX8H.21.27.C05.1.454.CMB.2.raw
  modified_base (202)..(202): a, c, t, g, unknown or other
  modified_base (249)..(249): a, c, t, g, unknown or other
  modified_base (299)..(299): a, c, t, g, unknown or other
  modified_base (375)..(375): a, c, t, g, unknown or other
  modified_base (411)..(411): a, c, t, g, unknown or other
  modified_base (432)..(432): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttancctggtaccagcagaaatctggccaggctcccaggctcctcatttaccgncatcccaccgagggcccacgtggtcgtcccagacaggttcaggtggcggtggtagtttgggactaggtagttttcnctcacctatccgagccgaccctacagagtagaagtntgttgactagttttacttcgngaccagactaaattaattaaacttacgtcggccctggtccgtcggtaaccggttcgggacccgtacggggaaccctaaggggtacggaaaataccgaaaacgtacgtaggtacggaactcggactaccgatccgtactccttacc

SEQ ID NO: 396208 - DNA, 607 bp, Homo sapiens
  misc_feature: GZ8MTXP02HMY1Y.21.27.C05.1.454.CMB.2.raw
  modified_base (200)..(200): a, c, t, g, unknown or other
  modified_base (298)..(298): a, c, t, g, unknown or other
  modified_base (381)..(381): a, c, t, g, unknown or other
  modified_base (403)..(403): a, c, t, g, unknown or other
  modified_base (434)..(434): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccactctctcctgcacagccagtcagtctatcgctgactggttagcctggtaccagcagaaatctggccaggctcccaggcctcctcatttaccgngcatcccaccaggggcccagtcggtcgtccccagactacgggttcaggtgggcggttggagtttggggactaggtagttttcnctcaccgatcacgccgccctanagagtgaagatgttgcttagtttactttcgngtccagtacaaattattaaattacgtcggtacctggtccggttacggtaccgggtttccgggacccgtaaacgggggtacccgtaaaggggttacggaaaacttaccgaaaaacgtaacgttagggtacggtccgtaggaccctaaccgtaacttccgtacgtttctttaccg

SEQ ID NO: 396209 - DNA, 599 bp, Homo sapiens
  misc_feature: GZ8MTXP02IT703.21.27.C05.1.454.CMB.2.raw
  modified_base (202)..(202): a, c, t, g, unknown or other
  modified_base (301)..(301): a, c, t, g, unknown or other
  modified_base (372)..(372): a, c, t, g, unknown or other
  modified_base (391)..(391): a, c, t, g, unknown or other
  modified_base (401)..(401): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctctcctgcacagccagtcagtctatcgctgactggttagcctggtaccagcagaaatctggccaggcctcccaggctcctcatttacccgngccatcccaccagggccagtggtctccccagaccaggttcagtggcggtggatttggggactgtagtttcnctcaccatcagcgccctanagagtgaagntgttgctagtttatttctgccagtctaaattattaaacttacgtaggtcccttggtccggttaccggtaacggtttccgggacccgtaacggggacccgtaaaaggggttacggaaaaacttaccgaaaaaccggtaaccgttcgggttacggaaccgttacggacctacccgtagttccttcggtttaccctttccg

SEQ ID NO: 396210 - DNA, 538 bp, Homo sapiens
  misc_feature: GZ8MTXP02GQYSY.21.27.C05.1.454.CMB.2.raw
  modified_base (412)..(412): a, c, t, g, unknown or other
  modified_base (461)..(461): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtccggggaaaatgtcgctggcaacaatggtggaattggattaggcagtccccgtgagaggccttgagtggcttggaaggacctattatacgtcccagtggtatgaagactatgcagattctgtgagcggtcgtctcaccatccacccagacacgtcaagatcagtctcccncacctaatgtctgtaccactcccgacgacgacggctagtttacttttgngtacgaaggagggtactcgactacgttcggtagacctaacctcctgtacctccgtcggggtacctaggggttaaccg

SEQ ID NO: 396211 - DNA, 549 bp, Homo sapiens
  misc_feature: GZ8MTXP02IVQE0.21.27.C05.1.454.CMB.2.raw
  modified_base (203)..(203): a, c, t, g, unknown or other
  modified_base (301)..(301): a, c, t, g, unknown or other
  modified_base (382)..(382): a, c, t, g, unknown or other
  modified_base (400)..(400): a, c, t, g, unknown or other
  modified_base (411)..(411): a, c, t, g, unknown or other
  modified_base (429)..(429): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggcctcctcatttaccgngccatcccaccagggcccacgtggtcgtccccaagaccaggttccaggtggcgggtggatttggggactagtagttttccnctcacatcagcgccctanagagtgaagtntgttgctagtttatttcngccagctaaatataattacgtggcctgcgtcgtacgttcggacctacggggaccaaagggtcggaaaactacgaaaacgtaacgtggtacggcgtacgacgtacctatcctagtctttac

SEQ ID NO: 396212 - DNA, 551 bp, Homo sapiens
  misc_feature: GZ8MTXP02GDPB0.21.27.C05.1.454.CMB.2.raw
  modified_base (203)..(203): a, c, t, g, unknown or other
  modified_base (270)..(270): a, c, t, g, unknown or other
  modified_base (301)..(301): a, c, t, g, unknown or other
  modified_base (381)..(381): a, c, t, g, unknown or other
  modified_base (404)..(404): a, c, t, g, unknown or other
  modified_base (460)..(460): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatcnggccaggctcccaggcctcctcatttaccgngccatcccaccgacggggccacgtggtcgtccccagacaggttcagtgggcggtggatttggggactaggtagtttttcncgtcaccatcgagccgaccctanagagtgaagattgttgcttagtttatttctgaccagtactaaattattaaattacnggtcctggtcgtcgacgttcggaccgtacgggaccaaagggtcggaaaatcgaaaacgacgtggtacggctgaccactagtctcgtcttac

SEQ ID NO: 396213 - DNA, 517 bp, Homo sapiens
  misc_feature: GZ8MTXP02JAUQ8.21.27.C05.1.454.CMB.2.raw
  modified_base (200)..(200): a, c, t, g, unknown or other
  modified_base (364)..(364): a, c, t, g, unknown or other
  modified_base (373)..(373): a, c, t, g, unknown or other
  modified_base (393)..(393): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggcctcctcatttaccgtgcactcccaccgagggcccacgtggtctccccagacaggttccaggtggcggtggtatttgggacngtagtttcnctcaccatcagccgccctanagagtgaagatgtgctagtttattctgcagacaatataattactgctgcgtcgacgttcgcgacgggaccaaggtagaaactacgaaacgtactacggtgctgcaacgactctcgtctactacc

SEQ ID NO: 396214 - DNA, 533 bp, Homo sapiens
  misc_feature: GZ8MTXP02IWMCU.21.27.C05.1.454.CMB.2.raw
  modified_base (203)..(203): a, c, t, g, unknown or other
  modified_base (301)..(301): a, c, t, g, unknown or other
  modified_base (375)..(375): a, c, t, g, unknown or other
  modified_base (404)..(404): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctccccaggctcctcatttaccgngcactccaccgagggcccacgtcggtctccccagacaggttcaggtggcggtggatttgggactgtagttttcnctcacatcacgcgccctacagagtgaagntgttgctagtttattctgccagactaattattaattactggcctgcgtcgtacgttcggaccacggggaccaagggtacggaaaactacgaaaacgaactggtacggctcgaccactatctcgtcttac

SEQ ID NO: 396215 - DNA, 504 bp, Homo sapiens
  misc_feature: GZ8MTXP02F4RHE.21.27.C05.1.454.CMB.2.raw
  modified_base (201)..(201): a, c, t, g, unknown or other
  modified_base (247)..(247): a, c, t, g, unknown or other
  modified_base (297)..(297): a, c, t, g, unknown or other
  modified_base (370)..(370): a, c, t, g, unknown or other
  modified_base (388)..(388): a, c, t, g, unknown or other
  modified_base (399)..(399): a, c, t, g, unknown or other
  modified_base (404)..(404): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtancctggtaccagcagaaatctggccaggctcccaggctcctcatttaccgngcatccaccagggccacgtggtctccccagacacggttcaggtggcggtggatttggggactagtagttttcnctcacatcagcgccctanagagtgaaagntgttnctagtttattctgccagacaatactaattacgtggactgcgtcgacgttcggccacgggacaggtcgaaatcgaaacgactgtggctgcacatctgcttc

SEQ ID NO: 396216 - DNA, 676 bp, Homo sapiens
  misc_feature: GZ8MTXP02IKWOR.21.27.C05.1.454.CMB.2.raw
  modified_base (200)..(200): a, c, t, g, unknown or other
  modified_base (210)..(210): a, c, t, g, unknown or other
  modified_base (299)..(299): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctntcctgcacagccagtcagtctatcgctgactggttagcctggtaccagcaagaaatctggccaggctcccaggctcctctatttaccgngcatccaccagggcccacgtcggtcgtccccaagaccgtacggtttccaggtcgggccgggttggtagttttggggacctaggttaacgtttttccgccttccgacctaattccgaacgtccgaccccttacgaggtacgtaggaaacgtagttaggttgtacgttaagttttattttcctacggtaccctaagtactaaacttaattaaaactttacgtcggtacccttaggtccggtacggtaaccggtttccgggacccgtaaccggggaacccgtaaaaggggtacggtaaaacgtaaaccgaaaaccggtaaaacgttcgtaacggtccgttacggacctaaaccgtaacttccgttacgtttacctttacg

SEQ ID NO: 396217 - DNA, 734 bp, Homo sapiens
  misc_feature: GZ8MTXP02HGGA0.21.27.C05.1.454.CMB.2.raw
  modified_base (203)..(203): a, c, t, g, unknown or other
  modified_base (307)..(307): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatcgctgactggttagcctggtaccagcaagaaatctggccaggcctcccgaggcctcctctactttaccgngcactcccaccgaggggcccacgtcgggtcgtaccccgaggtaccgtacgggtttccagggttcggggcggggtttagggtaagtttttcgggggaccttaagggttaacggttttttccctaccgttaccaacccgtaagttcccgaaacggcccgtacccccttaaacgaacggtaaggttaggaaaagtagttggtttacgtaccgtttaaggtttttaacttttcgtcgtaaccccgtaaggttaaccttaaaatttaaagtttaaaactttaaccgtcggggttacccttcgggtaccggtttccgggttaaccggttttcggggaccccgttaaaacgggggacccgtaaaggggttacggaaaactaccgaaaacgtacgtggttacggctacgacctacctagttctacgttcctttac

SEQ ID NO: 396218 - DNA, 624 bp, Homo sapiens
  misc_feature: GZ8MTXP02FX6WO.21.27.C05.1.454.CMB.2.raw
  modified_base (202)..(202): a, c, t, g, unknown or other
  modified_base (248)..(248): a, c, t, g, unknown or other
  modified_base (300)..(300): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtancctggtaccagcagaaatctggccaggctcccaggctcctcattttacccgncactcccaccgacgggccacgtcggtccgtccagacgtacggttcgaggtcgggtcggtggtagtttggggactaggttacgttttcctcctacaacctatccgacgtcccgtaccctaacgaggtaggtagaaagtagttagttagtactttagttttactttcgtacgtacctaagtactaaattaattaaacttaccgtcggtcctaggtccggttaccggtacggttccggacccgtaacggggtaaccgaaaggggtaacgaaaactacgaaaacgtacgtaggtacggcgtacgacctactattcgttacgtcttacg

SEQ ID NO: 396219 - DNA, 685 bp, Homo sapiens
  misc_feature: GZ8MTXP02HQPL0.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccgaggggggacncgccaccctctcctgcacacgccagtcagtctatcgctgacttggtacgccgtggtaccagacaagtaatcgtcggaccgacggcctacccgacggtccttcctacttacgtttaccggtcgacctacctacccgaccggacgggccctacgttcggtacgtaccccgaggtacgtacggttacgagggtcgggtcgggttggttaggtttacggggacgttaggttacgttttcctccttaccaacctactccgacgtcccgtaccctacgaaggtaggtagaaagtgttggttagtacttagttttacttcgtacgtacctagtaacttaaattaattaaacgttacgtacggtccgtggtccgttacggtaccggtccggacccggtaacgggtaacggtaaagggtaacggaaaacgtaaccgtaaaacgtacgtcggtacggtaacgtacgacctactacttcttacgttacttac

SEQ ID NO: 396220 - DNA, 569 bp, Homo sapiens
  misc_feature: GZ8MTXP02JN0RZ.21.27.C05.1.454.CMB.2.raw
  modified_base (411)..(411): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgccgtgctgggcctcccatggggtgtcctgtcacagatcaaactacagcagtctggtccaggactggtgaggccctcgcacgaccctttcactcacctgtgacatcgtaccggggaaatgtcgctggcaacaatggtggaattggattaggcagtccccgtgagaggccttgagtggcttggaaggtacctattatacgtccagtggtatgaagactatgacagattctggtgagcgtcgtctcaccatcaccccagacacgtacaagaatcagtcnccctaccaactaatcgtctgtaccacgtacccgacgacacggtactacgtttaattttgagtacgaaaggacgggactaccaactacgttacggtacgaaccttaacccttccgttacgtaccttccggtacggggtacccgaaggggtttaacccgg

SEQ ID NO: 396221 - DNA, 519 bp, Homo sapiens
  misc_feature: GZ8MTXP02GCQ67.21.27.C05.1.454.CMB.2.raw
  modified_base (202)..(202): a, c, t, g, unknown or other
  modified_base (371)..(371): a, c, t, g, unknown or other
  modified_base (393)..(393): a, c, t, g, unknown or other
  modified_base (403)..(403): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggctcccaggctcctcatttaccgtgcatccaccagggccactggtcgtcccagacaggttcagtggcggtggatttggggactaggtagtttttcncttcacctatcagccgccctanagagtgaagntgtgctagtttattctgccagtctaatataattactgcctgcgtcgtacgtcgaccgacgggaccaggtacgaaactacgaaacgaactgtagcgtcgacacgatctacgtcttac

SEQ ID NO: 396222 - DNA, 709 bp, Homo sapiens
  misc_feature: GZ8MTXP02I1QQ5.21.27.C05.1.454.CMB.2.raw
  modified_base (203)..(203): a, c, t, g, unknown or other
  modified_base (304)..(304): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctcccgaggcctcctctactttaccgngcactcccaaccgagggccacgtcggtcgtcccagactaggttcaggtggacggttggtagtttggggactaggttacgtttttcctaccgtacctaaccgtacgttaccgaacgtcccgtaccccgtaacgaaggtaagtaggaaaagttgttaggtttcgacgtttagttttacttttcgacgtaccgaagttactaaaatttaatttaaaacgttacgttcgggtaccttcgggtaccggtttaccggtaaccgggtttaccgggaaccccggtaaaccgggggtaaacccgtaaagggggttaacggtaaaaacgttaccggaaaaaccgttaaaccggttgggaacgggtccgttaacggacccgtaacctacggttacctttacggttcctttaacccg

SEQ ID NO: 396223 - DNA, 582 bp, Homo sapiens
  misc_feature: GZ8MTXP02G4A12.21.27.C05.1.454.CMB.2.raw
  modified_base (203)..(203): a, c, t, g, unknown or other
  modified_base (297)..(297): a, c, t, g, unknown or other
  modified_base (374)..(374): a, c, t, g, unknown or other
  modified_base (405)..(405): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagctggtaccagcagaatctggccaggcctccaggctcctcatttaccgngcactccaccagggccacgtggtcgtccccagaccagggttcaggtggcggtggatttggggactaggtagttttcncgtcacatcagccgcctacagagtgaaagtntgttgctagtttattctcgtaccagtactaaattattaaacgtttacgtcgggccttggccggttaccgaccggtttccggacccgacgggggtaacccaaaggggttacggaaaacttacgaaaacgaacgttggtacggaacctaggaccgaactattccgttagttcctttacg

SEQ ID NO: 396224 - DNA, 503 bp, Homo sapiens
  misc_feature: GZ8MTXP02GDLMW.21.27.C05.1.454.CMB.2.raw
  modified_base (202)..(202): a, c, t, g, unknown or other
  modified_base (248)..(248): a, c, t, g, unknown or other
  modified_base (366)..(366): a, c, t, g, unknown or other
  modified_base (385)..(385): a, c, t, g, unknown or other
  modified_base (395)..(395): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtancctggtaccagcagaaatctggccaggcctccaggctcctcatttaccgtgcatcccaccagggccacgtggtctcccagacaggttcagtggcggtggatttgggactagagtttcnctcaccatcagcgccctanagagtgaagntgtgctagtttatttctgccagcaatataattactggcctgcgtcgacgttcgcgacgggacaaagggtgaaactcgaaaacgactgaggctgacacatctgtctacg

SEQ ID NO: 396225 - DNA, 547 bp, Homo sapiens
  misc_feature: GZ8MTXP02HC3A5.21.27.C05.1.454.CMB.2.raw
  modified_base (200)..(200): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccgaggcctcctcatttacccgtgccatcccaccagggcccacgtggtctcccagactaggttcccaggtgggcggtggtagtttggggactggtagttttctctcaccatcagcccgaccctacgagtagtagaagtattgttgacttagtttattctgccagactaatatattatggcctgcgtcgacgttcggacgacggaccgaggtggaaactacgaaacgtaacgtgtaggactggaccacgtactcgtcgttaccttctacc

SEQ ID NO: 396226 - DNA, 523 bp, Homo sapiens
  misc_feature: GZ8MTXP02GP4C3.21.27.C05.1.454.CMB.2.raw
  modified_base (203)..(203): a, c, t, g, unknown or other
  modified_base (300)..(300): a, c, t, g, unknown or other
  modified_base (370)..(370): a, c, t, g, unknown or other
  modified_base (388)..(388): a, c, t, g, unknown or other
  modified_base (399)..(399): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagctggtaccagcagaaatctggccaggctcccaggcctcctctatttaccgngcatcccaccagggccacgtggtcgtcccagacaggttcagtgggcggtggagtttgggacagtgtttcnctcacatcagccgcctanagagtgaagtntagttgactagtttattcgtgcagtacaattataattacgtgcctgcgtcgacgttcggaccgacgggacgaaggtacgaaactcgaaaaccgacgtgtacggctcgacacctatctcgtcttc

SEQ ID NO: 396227 - DNA, 538 bp, Homo sapiens
  misc_feature: GZ8MTXP02IHALX.21.27.C05.1.454.CMB.2.raw
  modified_base (496)..(496): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaaatgtcgctggcaacaatggtggaattggattaggcagtccccgtgagaggccttgagtggcttggaaggacctattatacgtcccagtggtatgaagactatgcagattctgtgagcggtcgtctcgaccatccaacccagacacgtaccaaagatcaggtctccctcaaccctatcgtctcgtacacctccgacgacacgtctagtttatttgagtacaaaggtaggactcaactagttacgtnaccttaaccgtcttacgactccgtcgggacctagggttaacg

SEQ ID NO: 396228 - DNA, 529 bp, Homo sapiens
  misc_feature: GZ8MTXP02JTHMH.21.27.C05.1.454.CMB.2.raw
  modified_base (407)..(407): a, c, t, g, unknown or other
  modified_base (462)..(462): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatctccggggaaatgtcgctggcaacaatggtggaattggattaggcagtccccgtcgagaggccttgagtggcttggaagacctattatacgtcccagtggtatgaagactatgcagattctgtgagtcgggtcgtctcacatcacccagacacgtcaagatcaggtccnccctcactaatgtctgtccactcccgacgacacggctagtttatttgagtcaagngggactcgactacgttcgtgaccttaacctccttacgaccttccgtcggggtacctagggttaaccg

SEQ ID NO: 396229 - DNA, 548 bp, Homo sapiens
  misc_feature: GZ8MTXP02I28DO.21.27.C05.1.454.CMB.2.raw
  modified_base (460)..(460): a, c, t, g, unknown or other
  modified_base (465)..(465): a, c, t, g, unknown or other
tcagtcgtcgctcgcacgaccggtgctcgatttagacgcgatcgaagggtttgggggcagagcctgctgacttctggctgaccagggcagtcaccggagctccagacaatttctgtctccttcctcatcttcctgcccgtgctgggcctcccatggggtgtcctgtcacagatcaaactacagcagtctggtccaggactggtgaggccctcgcagacccttcactcacctgtgacatctccggggaaaatgtcgctggcaacaatggttggaattggattaggcagtccccgtgagaggcctgagtggcttggaagacctattatacgtcccagtggtatcgaagactatgcagattctgtgagcggtcgtctcaccatccacccagacacgtaccaaagactcgagtcctccctaccacctaaatcgtctgtccacctcccgacgacacgctagtttntttgngactaagaggtatacgtactacgttcgtacgtacctaccttccgtacgtacctccgtcggggacctaggggtaaccgtttcgg

SEQ ID NO: 396230 - DNA, 555 bp, Homo sapiens
  misc_feature: GZ8MTXP02I80BP.21.27.C05.1.454.CMB.2.raw
  modified_base (201)..(201): a, c, t, g, unknown or other
  modified_base (302)..(302): a, c, t, g, unknown or other
  modified_base (374)..(374): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggcctcccaggcctcctctactttaccgngccatcccacagggccactggtcgtcccagacctaggttcaggtggcggtggatttgggactagtagtttcnctcacatcagcgccctacgagagtgaagatgttagctagtttatttccgtgccagctaaattataaattactggacctggcgtacggtacgttcgggacccgtaacgggacccgaaagggtcggaaaatacgaaaaccgtaacgtgtacggaactagacctaccatcctagttcctttacg

SEQ ID NO: 396231 - DNA, 598 bp, Homo sapiens
  misc_feature: GZ8MTXP02H04D6.21.27.C05.1.454.CMB.2.raw
  modified_base (200)..(200): a, c, t, g, unknown or other
  modified_base (304)..(304): a, c, t, g, unknown or other
  modified_base (383)..(383): a, c, t, g, unknown or other
  modified_base (424)..(424): a, c, t, g, unknown or other
tcagtcgtcgctcgcacgaccggtgctcgatttagacgcgatcgaagggtttgggggagaactgctcagttaggacccagacggagccatggaagccccagcgcagcttctcttcctcctgcttctctggctccagacaccactggagtgattgtgatgacgcagtctccagccaccctgtctgtgtctccgaggggganccgccaccctctcctgcacagccagtcagtctatcgctgactggttacgcctggtaccagcaagaaatcgtggaccaggcctcccaggctcctctatttaccgngcactcccacgagggccacgtggtcgtcccagactacggttcaggtggcggttgtagtttgggactagttagttttccnctacaacctatccaacgtccgccctaagagagtgaaaggtnttcggttgacttagtttattcgtgaccagtactaatattaattacgtcggtaccttggcgttaccgtacggttccgggaaccgtacggggtaaacccgtaagggtaacgaaaacgtacgaaaaccgtacgtggtacggaacctacggacctacctattcccgtatttcctaccg

SEQ ID NO: 396232 - DNA, 511 bp, Homo sapiens
  misc_feature: GZ8MTXP02GDX26.21.27.C05.1.454.CMB.2.raw
  modified_base (199)..(199): a, c, t, g, unknown or other
  modified_base (298)..(298): a, c, t, g, unknown or other
  modified_base (355)..(355): a, c, t, g, unknown or other
  modified_base (365)..(365): a, c, t, g, unknown or other
  modified_base (487)..(487): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggctccccaggcctcctcatttaccgncatcccaccaggcccactggtctcccagacaggttccagtggcgtggatttgggacngtagttttcnctcaccatcagccgccctacagagtgaagatgttgctagtttattctgccagcaatataattactggcctgcgtcgacgttcgccgacgggaccaagggtagaaactacgaaaacgaactgnggctgacaccatctcgtcttctac

SEQ ID NO: 396233 - DNA, 701 bp, Homo sapiens
  misc_feature: GZ8MTXP02HGPQV.21.27.C05.1.454.CMB.2.raw
  modified_base (200)..(200): a, c, t, g, unknown or other
  modified_base (314)..(314): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccaggggggacnccgccaccctctcctgcacacgccagtcagtctatcgctgacgttggttacgccgtaggtaccagacaagaactcgtcggccaggcctcccgaggtcctcctctactttaccgnacactcccgaccgacggtccctacgtcggtacctacccgagacgtacggttcccgaggtcgggtcggttaggtacgttggggaactggtttacgttttcctcctaccacctagtaccgacgcccgtacccgtaacgaggtaacggtagaaagtagttggttacgtacgtttagttttacttcgtacgaccgtaagtactaaattaacttaaacgttaccgtcggtaccgttacggtaccggttaccggttaccggttaccgggacccgtaaccggggtaaaccgtaaaggggtaacggtaaaacgtaaaccggaaaacggtacgttacggtacggtaccgtaacggaacctaaccgtacgttaccgttaccgttaccttacctaccg

SEQ ID NO: 396234 - DNA, 579 bp, Homo sapiens
  misc_feature: GZ8MTXP02H2PIW.21.27.C05.1.454.CMB.2.raw
  modified_base (203)..(203): a, c, t, g, unknown or other
  modified_base (306)..(306): a, c, t, g, unknown or other
  modified_base (380)..(380): a, c, t, g, unknown or other
  modified_base (394)..(394): a, c, t, g, unknown or other
  modified_base (404)..(404): a, c, t, g, unknown or other
  modified_base (560)..(560): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccgtgtctgtgtctccgagggggganccgccaccctctcctgcacagccagtcagtctatcgctgactggttacgcctggtaccagcagaaatctggccaggcctcccaggctcctctactttacccgngacatcccaccgagggccacgtggcgtccagacaggttcaggtggcggtggagtttggggctagtagttttccnctcaccgatcgacnccgaccctanagacgtgaagtatggttgacttagtttattctagaccagtacaaatttataaattacgtacggcctttcggacgttccgtaacggtttccggaccgtaacggggacctaaaggggtacgaaaacgtacgaaaacgacttggtacggaactgaaccncctaatcctacgtttctac

SEQ ID NO: 396235 - DNA, 532 bp, Homo sapiens
  misc_feature: GZ8MTXP02HRN8S.21.27.C05.1.454.CMB.2.raw
  modified_base (418)..(418): a, c, t, g, unknown or other
  modified_base (464)..(464): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgaggccctcgcagaccctttcactcacctgtgacatcgtaccggggaaaatgtcgctggcaacaatggtggaattggattaggcagtccccgtgagaggcctgagtggcttggaaggacctattactacgtcccgtagtggtatgaagactattgcagtattctgtgagtcggtcgtctcaccatccacccagaccacgtaccaagaatcagtccnccctcactaatgtactgtcactcccgacacacgctagtttatttgngacaaggaggactcactagttcgcgtactccgtacctgtacctccgtcggggaccgtaggttaaccgg

SEQ ID NO: 396236 - DNA, 714 bp, Homo sapiens
  misc_feature: GZ8MTXP02G6N6X.21.27.C05.1.454.CMB.2.raw
  modified_base (203)..(203): a, c, t, g, unknown or other
  modified_base (250)..(250): a, c, t, g, unknown or other
  modified_base (306)..(306): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatctggccaggcctccccgaggcctcctctactttaccgngaccactcccaaccgacggggccctacgttgggtcgtccccaaggacctacggggtttccaggttcggggcggggttggtaagtttcggggactaggttagtttttccgcttccaacccgtattccgaacggccctacccccttaagaacggaggttaaggaaaggtattgggtttacgtaccgttaaaggttttttactttccgtacggacccctaaggttacctaaaagtttaagtttaaaactttaccgtacggggtaccccttagggtcccggttacggtaaccgggtttccggggaccccgtaaaaccgggggaccctaaaaggggtacgggaaaacttacgaaaaaccgggtaacttgggtacggcttacggaccctaaccctagttccttcgttacctttc

SEQ ID NO: 396237 - DNA, 546 bp, Homo sapiens
  misc_feature: GZ8MTXP02JAX69.21.27.C05.1.454.CMB.2.raw
  modified_base (202)..(202): a, c, t, g, unknown or other
  modified_base (300)..(300): a, c, t, g, unknown or other
  modified_base (377)..(377): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggctcccaggcctcctctatttaccgngccatcccaccgacgggcccacgtggtcgtccccagacaggttcaggtggcggtggagtttgggactagtagtttcnctcaccatcacgccgccctagagagtgaagtatgttgctagtttatttctgacctagactaaattattaattactggcctgcgtcgtacgttcggaccgacgggaccaaggtacggaaactacgaaaacgtaactggtacggctcgaccacctatccttcgtacttacg

SEQ ID NO: 396238 - DNA, 518 bp, Homo sapiens
  misc_feature: GZ8MTXP02JRUUL.21.27.C05.1.454.CMB.2.raw
  modified_base (202)..(202): a, c, t, g, unknown or other
  modified_base (299)..(299): a, c, t, g, unknown or other
  modified_base (373)..(373): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgngcatcccaccagggcccactggtcgtcccagacaggttcaggtggcggtggatttggggactaggtagttttcnctcacatcagccgccctacagagtgaagtatgttgctagtttatttctgccagctaatataattacgtgcctgcgtcgtacgttcggcctacgggaccaagggtagaaatacgaaacgactgtagctgacactatcgtgtcttac

SEQ ID NO: 396239 - DNA, 523 bp, Homo sapiens
  misc_feature: GZ8MTXP02G74AA.21.27.C05.1.454.CMB.2.raw
  modified_base (451)..(451): a, c, t, g, unknown or other
  modified_base (459)..(459): a, c, t, g, unknown or other
  modified_base (483)..(483): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcaacaatggtgaattggattaggcagtcccgtgagagccttgagtgcttggaagacctatatacgtccagtgtatgaagactatgcagattctgtgagtcggtcgtctcaccatccacccagacacgtcaagaatcagtcctccctacacctaatcgtctgtcactcccgacgacacggctagtttatttgngtacaagngggtactacgactacgttacggtntacctaacctcttcgacctcgtcgggacctagggttaccg

SEQ ID NO: 396240 - DNA, 697 bp, Homo sapiens
  misc_feature: GZ8MTXP02GE3CR.21.27.C05.1.454.CMB.2.raw
  modified_base (203)..(203): a, c, t, g, unknown or other
  modified_base (327)..(327): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacnccgcccaccctctcctgccacacgccagtcagttctatcgctggacgttggttacgccgtcggaccagacaagaaactcgtcggaccgacggcctcccgacggtcctcctactacgtttaccgnaccactcccgaccgacgggcctacggttcggtacgtaccgaacggtacgtacggttacgagggtcggggtcggggttaggtaggtttacggggacgttaggttacgttttcctacctacctaactactaccgacgacccgtaccctaagaggtagtagaagtgttggttagtactttagtttactttcgtacgtacctaagtactaaattaagttaacttaccgtcggtaccgttcggtaccggttaccggtaccggttacccgggaccggtaaccggggtaaacggtaaagggtaaacgtaaaacgtaaccgtaaacgtaacggttggtacggaacgtacgaacctacgtacgttcgtacgttactacg

SEQ ID NO: 396241 - DNA, 535 bp, Homo sapiens
  misc_feature: GZ8MTXP02IU998.21.27.C05.1.454.CMB.2.raw
  modified_base (357)..(357): a, c, t, g, unknown or other
  modified_base (492)..(492): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtggaattggattaggcagtccccgtgagaggccttgagtggcttggaaggacctattatacgtcccagtggtatgagactatgcagnttctgtgagcggtcgtctcaccatccaccccagaccacgtccaagatcaggtctccctccacctatgtctgtcacctcccgagacacggtctagtttacttttgtacgacaaggagggatacactagttcggtanacctaaccgtcttcgactccgtcggggtaccagggtttaaccg

SEQ ID NO: 396242 - DNA, 566 bp, Homo sapiens
  misc_feature: GZ8MTXP02FSC27.21.27.C05.1.454.CMB.2.raw
  modified_base (359)..(359): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtggaattggattaggcagtccccgtgagaggccttgagtggcttggaaggacctattatacgtccagtggtatagaagactatgcagtntctgtgagcggtcgtctcaccatccacccagacacgtcaagatcagtcctccctaccacctaatcgtctgtccactccccgacgaccacggtactagttttattttgagtacctaaggagggtactacgtaactacgtttacggtacgtacctaaccttcccgttacgtaccgttccgtacgggggtaccctaaggggtttaacccg

SEQ ID NO: 396243 - DNA, 763 bp, Homo sapiens
  misc_feature: GZ8MTXP02HMRR5.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccggaggggggacnccgcccacctctcctgcacacgccagtcagtctactcgctgtacgttggttacgccgtacggtaccagacaagtaactcgtacggaccgacggccctacccgacggtcccttcccttacgttacgtttaccgcgacctaccgtaccccgaaccggacgggtaccctacggttcgggtaccgtacccgaggtacgtacggttacgaggggttcggggtacggggttaggtacggtttacgggacgttacggtttacgttttccgtacctacctactacgtaccgacgtacccgtacccgtaagaaggtaggtaagaaagttgttacggttacgttacgtttacgttttacgtttaccgtacgtaaccgtaagttaacttaaaagtttaacttaacgttaccgtcggtaccgtacggtaccggttaccggtaccggtaccgggaaccggtaaccgggtaaacggtaaagggtaacgtaaaacgtaaccggtaaaaccgtacggttacggtacgtaaccgtacgaacctaccgtacgtttaccgttacgtttacccttaccg

SEQ ID NO: 396244 - DNA, 537 bp, Homo sapiens
  misc_feature: GZ8MTXP02GP0TG.21.27.C05.1.454.CMB.2.raw
  modified_base (160)..(160): a, c, t, g, unknown or other
  modified_base (355)..(355): a, c, t, g, unknown or other
  modified_base (359)..(359): a, c, t, g, unknown or other
  modified_base (464)..(464): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgaggccctcgcagaccctttcactcacctgtgacatcgtaccggggaaatgtcgctggcaacaatggtgaattggattaggcagtccccgtgagaggccttgagtggcttggaaggacctattatacgtccagtgtatgaagactatgcagnttcngtgagcggtcgtctcaccatccacccagaccacgtaccaagatcagtcctcccgtacacctaatcgtctagtcacctcccgacgacacggtactagtttatttgngtacgaaggaggacttacactacgttcgagtacctaacctacgtgtacctcgacgggtccacgggtttaaccg

SEQ ID NO: 396245 - DNA, 619 bp, Homo sapiens
  misc_feature: GZ8MTXP02IKGEQ.21.27.C05.1.454.CMB.2.raw
  modified_base (352)..(352): a, c, t, g, unknown or other
  modified_base (376)..(376): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgaggccctcgcagaccctttcactcacctgtgacatcgtacggggaaatgtcgctgcaacaatggtgaattggattaggcagtccccgtgagagccttgagtggcttggaaggacctattatacgtccagtggtatgaagctatgacagnttctagtgagcggtcgtctcacanccacccagacacgtacaagaatcgacggtcctacccctaccgaacccttaatcgttactcggtaccaaccgttccccgaacgtaaccgaccggtcttaagtttttacttttaggtacgtacgaaaagggtagggtaacttaccgaaacgttacgttaccgggttacgtaaccctttaacccgttacccgttacggtaacccttcccgggttacgggggacccgtaagggggtttaaaccccgg

SEQ ID NO: 396246 - DNA, 572 bp, Homo sapiens
  misc_feature: GZ8MTXP02GW0J9.21.27.C05.1.454.CMB.2.raw
  modified_base (201)..(201): a, c, t, g, unknown or other
  modified_base (248)..(248): a, c, t, g, unknown or other
  modified_base (298)..(298): a, c, t, g, unknown or other
  modified_base (361)..(361): a, c, t, g, unknown or other
  modified_base (380)..(380): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggttancctggtaccagcagaaatctggccaggcctccaggctcctcatttaccgngcatcccacagggccagtggctccagacaggttcagtggcggtggattgggctagtagtttcnctcacatcagccgccctanagagtgaagtatggttgacttagtttacttctgcccagtacaaattataaatttacgtgggtcccttggtccggttaccggtaccggtttccgggaccccgtaaacggggaacccgtaaaggggtacgaaaacgttaccgaaaacggtaacctggtacggctacgaccaactagtccttacttacctttacc

SEQ ID NO: 396247 - DNA, 569 bp, Homo sapiens
  misc_feature: GZ8MTXP02JDPKL.21.27.C05.1.454.CMB.2.raw
  modified_base (363)..(363): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtggaattggattaggcagtccccgtgagaggccttgagtggcttggaacgggtacctattactacgtcccaggtcggtatgaagactatgcagnttcgtgtgagcggtacgtctcgaccatccacccagacacgtaccaagactcaggtcctccctaccaaccttaatgtctgtccacctcccgacgactacgggctagtttatttcgtagtacgaaggacgggtactcgtaacacgttaccggtagtaacctccgttccgttacgaccttccgtcggggtaccctagggtttaacccgg

SEQ ID NO: 396248 - DNA, 619 bp, Homo sapiens
  misc_feature: GZ8MTXP02JAYOG.21.27.C05.1.454.CMB.2.raw
  modified_base (200)..(200): a, c, t, g, unknown or other
  modified_base (298)..(298): a, c, t, g, unknown or other
  modified_base (377)..(377): a, c, t, g, unknown or other
  modified_base (391)..(391): a, c, t, g, unknown or other
  modified_base (397)..(397): a, c, t, g, unknown or other
  modified_base (406)..(406): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggcctcctcatttaccgngcactcccaccgagggcccacgtggtcgtccccaggactaggttcccagtgggcggtggatttgggactaggtgtttcnctcaccatcacgcnccctanagagtgaantgtgctagtttattcgtagccagtactaattaagtaactttacgtacggtcctaggtaccgttcggtaaccggttccgggacccgtaaaccgggggtaccgtaaaacgggggtagtaaaaaccgttaaccgaaaaaccggtacgttaacgggtcggtaccgttaacggaccctaaaccgttactaccgtttacggtttcctttacctaacccg

SEQ ID NO: 396249 - DNA, 537 bp, Homo sapiens
  misc_feature: GZ8MTXP02J3YED.21.27.C05.1.454.CMB.2.raw
  modified_base (201)..(201): a, c, t, g, unknown or other
  modified_base (297)..(297): a, c, t, g, unknown or other
  modified_base (329)..(329): a, c, t, g, unknown or other
  modified_base (364)..(364): a, c, t, g, unknown or other
  modified_base (412)..(412): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggancgccaccctctcctgcacagccagtcagtctatcgctgactgtagcctggtaccagcagaaatctggccaggcctcccaggctcctcatttaccgngcatcccaccagggccactggtctcccagacnggttcagtggcggtgatttggggcagtacgtttcnctcacctatcagccgccctacagagtgagatgttgctagtttattcgngtccagtcaaattattaattacgtcggtacctgtaccggtcgtacgttaccggaccgtacggggaaccaagggtacgaaaatacgaaacgacgtggtacggctggacacctatctacgtcttacc

SEQ ID NO: 396250 - DNA, 604 bp, Homo sapiens
  misc_feature: GZ8MTXP02JO2X7.21.27.C05.1.454.CMB.2.raw
  modified_base (202)..(202): a, c, t, g, unknown or other
  modified_base (248)..(248): a, c, t, g, unknown or other
  modified_base (301)..(301): a, c, t, g, unknown or other
  modified_base (375)..(375): a, c, t, g, unknown or other
  modified_base (396)..(396): a, c, t, g, unknown or other
  modified_base (408)..(408): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtancctggtaccagcagaaatctggccaggcctcccaggcctcctctatttaccgngcatcccaccgagggcccacgtggtctcccagacacggttcaggtggcggtggatttgggactagtagttttcnctcaccatcagccgaccctanagagtagaagtntgttgctagtttattcgtgacctagactaaattattaacttacgtcggtacctggtccgttacggtaccggtttccggacccggtaaccggggtaacccgtaaagggggttacggaaaacttaccgaaaaccgtaaacgttcggtacggtaaccttacggacccgtaaccctagtttccgttacgttcctttaccg

SEQ ID NO: 396251 - DNA, 499 bp, Homo sapiens
  misc_feature: GZ8MTXP02IE48X.21.27.C05.1.454.CMB.2.raw
  modified_base (199)..(199): a, c, t, g, unknown or other
  modified_base (294)..(294): a, c, t, g, unknown or other
  modified_base (351)..(351): a, c, t, g, unknown or other
  modified_base (362)..(362): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggatgattgtgatgacgcagtctccagccaccctgtctgtgtctccgaggggggancgccaccctctcctgcacagccagtcagtctatcgctgactggtagcctggtaccagcagaaatctggccaggctccaggctcctcatttaccgngcatccacacgggccactgtgtcccagacaggttccagtgcggtggatttggggacnggtagttttcncttcaccatcagcgccctacagagtgaagatgttgctagtttattctgcctagctaatatatactgctgcgtcacgttcgacgacggacaggtgaaactacaaacgactacgtgctgacactactctgttactctac

SEQ ID NO: 396252 - DNA, 600 bp, Homo sapiens
  misc_feature: GZ8MTXP02IK66X.21.27.C05.1.454.CMB.2.raw
  modified_base (325)..(325): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatcgtaccggggaaatgtcgctggacaacaatggttagattggattaggcagtccccgtgagagcctgagtgctggagctatatacgtntcagtgtatgaagactatgcagtatttcgtggtgaggtcgggtcgtcttaccaccgactaccacccccgagaaccctacggttacccaaagaacttacgacggtccttacccctaccaacccttaagttcgtactcgtaccaccgtacccgaacgaccacgggtcttaacgttttattttgtacgtacgtaaaggacgggatacgacgtaacgttcggtacgtaaccttacccgtacgtttacgacccttccggtacggggaccttaaacggggg

SEQ ID NO: 396253 - DNA, 718 bp, Homo sapiens
  misc_feature: GZ8MTXP02F44M0.21.27.C05.1.454.CMB.2.raw
  modified_base (202)..(202): a, c, t, g, unknown or other
  modified_base (300)..(300): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactgtagcctggtacagcagaatctggccaggcctcccgaggcctcctctactttaccgngcactcccaccgaggggccctacgttcggtcgtaccccaaggaccgtacgggtttccgaagggttcggggtcggggttagggtacggttttcgggggacctagggttacggtttttccaccgttaccgaacctaacttcccgaacggtcccgtaccccttaacgaaggtacggttaagaaacggtagtttcggttaggttaccgttaaggttttaacttttccgtacggtaccctaggtactaaaatttaacgtttaaaactttaccgtcggtaccgttcggtaccgttacggtaaccgggttccggaccggtaaccggggaacccgtaaggggtaacggtaaaacgtacgtaaaaccggtaacgttcggtacggtaactacggaccctaaccgtacttcgttacgttacctttaccg

SEQ ID NO: 396254 - DNA, 701 bp, Homo sapiens
  misc_feature: GZ8MTXP02IW38G.21.27.C05.1.454.CMB.2.raw
  modified_base (203)..(203): a, c, t, g, unknown or other
  modified_base (237)..(237): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctancgctgactggttagcctggtaccagcaagaaatctggccaggcctcccgaggcctcctctactttaccgtgccactcccaccgacggggccctacgtggtacgtccccgaagaccgtacggttaccgaggttcggggacgggttagggtaacgttttcggggacgtaggtttacggtttttcctccttaccgaccgtattcccgaacggcccgtaccctaacgaacggaggttaagaaaggttattggtttaggtacttagttttactttcgtacggtacctaagtaactaaattaattaaacttaccgttcggtaccttcggtaccggttaccggtaaccgggtttccgggacccggtaaacgggggaacccgtaaagggggttacggaaaacgttaaccgaaaacggtaacgttcgggtacggcctacggacctaacctattccgttacgtttccctttacg

SEQ ID NO: 396255 - DNA, 648 bp, Homo sapiens
  misc_feature: GZ8MTXP02GKX8N.21.27.C05.1.454.CMB.2.raw
  modified_base (202)..(202): a, c, t, g, unknown or other
  modified_base (297)..(297): a, c, t, g, unknown or other
  modified_base (394)..(394): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtacagcagaatctggccaggctcccaggctcctctatttaccgncactccaccgacgggccacgtggtccgtacccgagacgtacggttacgagggtcgggcggggtaggtagtttaggggactagggttacgtttttccncctaccgaacctatccgacgcccgtaccctaacgaggtaggtagaagtagttggttacgtacttagttttactttcgtcgtaccgtaagtaactaaaattaactttaaacgttacgttcggtccttcggtaccgttacggtaccggttaccggaacccggtaaccggggtaaccggtaaagggtaacggtaaaacgtaaccgaaaacgtacgtaggtacggtaacgtacgaccgacctatcgttacgttactac

SEQ ID NO: 396256 - DNA, 696 bp, Homo sapiens
  misc_feature: GZ8MTXP02IIABW.21.27.C05.1.454.CMB.2.raw
  modified_base (369)..(369): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccatggggtgtcctgtcacagatcaaactacagcagtctggtccaggactggtgacggcccctcgcacgtaccctttcactcacctgtgacatcgtaccggggaaatgtcgctggacaacaagtggttaggaattggattaggcacgtccccgtgagaggtccttggagtggcttggaagaccttatactacgtcccagtggtatagaagactatgcagtnttcgtgtggacgtcgggtcgtctcaccctatcccaacccagaccaccgtacaaaggaactcgaacggttccctcccgtacccaaaccttaagtcgttaccttacgtcctaaccccgttacccccggaaccgtaaccgtaccggttaacccgtttaagttttttacgttttacgggtaacggtaaccggtaaaagggtaacggggtactttaaccgaaaccgtttacgtttaacccggggttacgtaacccctttaacccgtttacccgtttacgttacccggttacccggtacgggggttaccccgtaagggggttttaacccccgg

SEQ ID NO: 396257 - DNA, 521 bp, Homo sapiens
  misc_feature: GZ8MTXP02IY187.21.27.C05.1.454.CMB.2.raw
  modified_base (201)..(201): a, c, t, g, unknown or other
  modified_base (363)..(363): a, c, t, g, unknown or other
  modified_base (373)..(373): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctccccaggcctcctcatttaccgtgcatccaccagggcccacgtggtgtccccagacaggttccaggtggcggtggatttgggacngtagttttcnctcaccatcagcgccctacagagtagaagatgttgctagtttattctgccagactaataataattactaggcctgcgtcgtcgttcgccgacgggaccaggtaggaaactacaaaacgactaggtggctgccacatctgttcttctac

SEQ ID NO: 396258 - DNA, 611 bp, Homo sapiens
  misc_feature: GZ8MTXP02I0PLE.21.27.C05.1.454.CMB.2.raw
  modified_base (202)..(202): a, c, t, g, unknown or other
  modified_base (238)..(238): a, c, t, g, unknown or other
  modified_base (374)..(374): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgntgactggttagcctggtaccagcagaaatctggccaggctccaggcctcctcatttaccgtgcatcccacagggccacgtggtctcccagactaggttcaggtggcggtggtactttgggactagtagtttttccnctacacctatccacgccgaccctagagtagtagaagtgttgttacgtacgttagtttacttcgtacgtacctagtactaaattaatttaaacttacgtcggtaccgtggtccggtaccggtaccggtccggacccgtaaccggggtaacccgtaaaggggtacggaaaacgtaaccgtaaaacggtaacgtggtacggtaacgtcgaccgtaccgtagttccgttacgttctttacg

SEQ ID NO: 396259 - DNA, 557 bp, Homo sapiens
  misc_feature: GZ8MTXP02HW3KZ.21.27.C05.1.454.CMB.2.raw
  modified_base (204)..(204): a, c, t, g, unknown or other
  modified_base (303)..(303): a, c, t, g, unknown or other
  modified_base (315)..(315): a, c, t, g, unknown or other
  modified_base (380)..(380): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctcctgcacagccagtcagtctatcgctgactggttagcctggtaccagcagaaatctggccaggcctccaggcctcctctatttaccgngcactccaccgngggccacgtggtcgtcccagaccgaggttcaggtggcggtggtagtttgggactagtagttttcncgtacacatccacgccgccctacagacgtagagtattgtgtctagtttatttctcgtaccagtactaattataattacgtgcgtgcgtcgtacgttcggaccgtaacgggaccgaagggtaacgaaacgtacgaaaacgtaacgtggtagaactcgacacctatccgtacgttcttc

SEQ ID NO: 396260 - DNA, 561 bp, Homo sapiens
  misc_feature: GZ8MTXP02I11VT.21.27.C05.1.454.CMB.2.raw
  modified_base (355)..(355): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtggaattggattaggcagtccccgtgagaggccttgagtggcttggaagcctattatacgtccagtggtatgaagactatgcagnttctgtgagcggtcgtctcacatccacccagacacgtacaagatcgagtctccctacacctaatcgtctcgtacacctacccgacgacacggtactacgttttaatttcgtgtacaaggtaagggcttacgaactacgttacggtacgtaaccttaaccgtcctttacgaccttccggtacggggaccgtacggggtttaaaccgg

SEQ ID NO: 396261 - DNA, 631 bp, Homo sapiens
  misc_feature: GZ8MTXP02JS5XP.21.27.C05.1.454.CMB.2.raw
  modified_base (203)..(203): a, c, t, g, unknown or other
  modified_base (301)..(301): a, c, t, g, unknown or other
  modified_base (374)..(374): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcagaaatctggccaggctcccaggctcctcatttaccgngcatcccaccacgggccacgtggtcgtcccagacaggttcaggtggcggtggagtttgggactagtagtttcnctcaccatcagccgaccctacgagagtgaagtatggttacgcttagtttttactttcgtcgtaccctagtactaaattacttaaagtttacgtcggtacccttgggtccggttaccggttaaccgtttccgttcggacccgtaaccgggggtaacccgtaaaggggttacggtaaaacgttaccgaaaaaccggtaacgttacgggtaacggtaccgttacggacccgtaaccctacgttaccgttacgttttcccc

SEQ ID NO: 396262 - DNA, 641 bp, Homo sapiens
  misc_feature: GZ8MTXP02I8K5X.21.27.C05.1.454.CMB.2.raw
  modified_base (224)..(224): a, c, t, g, unknown or other
  modified_base (352)..(352): a, c, t, g, unknown or other
  modified_base (356)..(356): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttnactcacctgtgacatctccggggaaatgtcgctggcacaatggtgaattggattaggcagtccccgtgagaggcctgagtggcttggaaggacctattatacgtccagtggtatgaagactatgcagnttcngtgagcggtcgtctcgaccatcaccccagaccacgtaccaagaactcgaacggtcctaccctaccaccttaaatcgttacctacgtccaaccttcccgaaccgtaaccgtaaccggggtacctaagggtttttaaacttttttcggacgttaccgtaaaagggtacgggggtaacgttacctaacggtaacgtttaccgggtacggtaaaccttaacccgtttccgtttacggtaacccgtttcccggtacgggggttacccccaagggggttttaaaaccccgg

SEQ ID NO: 396263 - DNA, 499 bp, Homo sapiens
  misc_feature: GZ8MTXP02H0BF7.21.27.C05.1.454.CMB.2.raw
  modified_base (198)..(198): a, c, t, g, unknown or other
  modified_base (244)..(244): a, c, t, g, unknown or other
  modified_base (294)..(294): a, c, t, g, unknown or other
  modified_base (312)..(312): a, c, t, g, unknown or other
  modified_base (348)..(348): a, c, t, g, unknown or other
  modified_base (358)..(358): a, c, t, g, unknown or other
tcagtcgtcgctcgcacgaccggtgctcgatttagacgcgatcgaagggtttggggaactgctcagttaggacccagacggagccatggaagccccagcgcagcttctcttcctcctgcttctctggctcccagacaccactggagtgattgtgatgacgcagtctccagccaccctgtctgtgtctccaggggggancgccacctctcctgcacagccagtcagtctatcgctgactggttancctggtaccagcagaaatctggccaggctcccaggctcctcatttaccgncatccaccaggccatggngtcccagacaggttccagtggcggtgatttgggacngtagttttcnctcaccatcagcgccctacagagtgaagatgttgctagtttattctgccagactaaattataattactggcctgcgtcgacgttcgccgacgggaccaaggtcgaaatacaaacgactgtgctgcacatctagtcttacac

SEQ ID NO: 396264 - DNA, 660 bp, Homo sapiens
  misc_feature: GZ8MTXP02GRZZP.21.27.C05.1.454.CMB.2.raw
  modified_base (202)..(202): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggcncgccaccctctcctgcacagccagtcagtctatcgctgactggttagcctggtaccagcaagaaatctggccaggctcccaggcctccgtactactttaccgtgaccactccccaaccgacggggccctaacgtcgggtacgtccccaagtaccaggtttccaaggtcgggcggttggtaagtttggggactaggttagtttttcctacgttccaacctatccgaacgtcccgaccccttaagagtagtagaaagtattgttaggacttagtttactttctcgaccctaagactaaattaattaaacttacgtcggtaccttggaccgttcggaaccgtttccgggacccgtaaaccgggggtaccgtaaaaggggtacgggtaaaaacttaaccgaaaaccgtaaacgttcggtacggcgttacggacctaccaactttcgtacgtttcctttaacc

SEQ ID NO: 396265 - DNA, 578 bp, Homo sapiens
  misc_feature: GZ8MTXP02IFVOK.21.27.C05.1.454.CMB.2.raw
  modified_base (355)..(355): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctgcagtaccctttcactcacctgtgacatcgtaccggggaaatgtcgctggcaacaatggtggaattggattaggcagtccccgtgagaggcctgagtggcttaggaggactatatacgtccagtgtatgaagactatgacagnttctgtgagtcggtcgtctcactatccacccagacacgtacaaagaactcgacgtcctccctaccaacctaatcgtactcgtaccacctcccgaacgactacggtactagttttactttggacgtacgtaaaggtacgggtactaccgtaactacgttcggtacgtaccttaaccgtccgttacgtaccgttccgtacggggtaccgtacggggtttaaccgg

SEQ ID NO: 396266 - DNA, 557 bp, Homo sapiens
  misc_feature: GZ8MTXP02JSU0C.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggttggaattggattaggcagtccccgtgagaggcctgagtggcttggaagctatatacgtccagtgtactgaagactatgacagattctgtgagcggtcgtctcaccatccaccccagacacgtacaagaatcgaacgtcctccctacccacctatgtctcgtcgacctcccgacgacacggcttagtttattttgcgtactaaggagggactacacgtacgttcggtactaccttaaccgtccttacggaccttccggtacggggtaccgtaaggggtttaacccgg

SEQ ID NO: 396267 - DNA, 561 bp, Homo sapiens
  misc_feature: GZ8MTXP02H2SDB.21.27.C05.1.454.CMB.2.raw
  modified_base (200)..(200): a, c, t, g, unknown or other
  modified_base (304)..(304): a, c, t, g, unknown or other
  modified_base (399)..(399): a, c, t, g, unknown or other
  modified_base (426)..(426): a, c, t, g, unknown or other
  modified_base (433)..(433): a, c, t, g, unknown or other
  modified_base (446)..(446): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccacctgtctgtgtctccgaggggganccgccaccctctcctgcacagccagtcagtctatcgctgactggttagcctggtaccagccaagaaatcgtggccaggcctccaggctcctcgtactttaccgngcactccaccgagggccacgtggtcgtcccagacacggttcagtcggcggtgagtttcgggactagttagtttctcgtcacatcacgcgccctanagagtgaagtatgtgctagtttatctnacagtanaagtataattacngcctgcgtcgtacgtcggaccgacgggaaaccagggtacgtaaacgtacgaaaaaccgacgttcggtacggaacttaccggaacctaccgtaacttccggtcgtttctttacccg

SEQ ID NO: 396268 - DNA, 662 bp, Homo sapiens
  misc_feature: GZ8MTXP02JGXS1.21.27.C05.1.454.CMB.2.raw
  modified_base (203)..(203): a, c, t, g, unknown or other
  modified_base (305)..(305): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcagaaatctggccaggcctcccaggcctcctctactttaccgngccactcccaaccgacgggcccacgtggtccgtccccagactacgggttcagggtcggcgggttggtagtttggggactaggttacgtttttcgcctaccacctatccacgccgaccctaacgaggagtagaaagtgttaggttgtacttagtttactttcgcgtacctagacctaaattaattaaacttacgtggtaccttggtaccggttaccgtaccgggtttccgggaaccccggtaaccgggggtaaacccgtaaagggggttaacggaaaacttaaccggaaaaccggtaaaccgttggtaacgggcgttacgacccgtaacccgtagttccttacggttacctttacccg

SEQ ID NO: 396269 - DNA, 616 bp, Homo sapiens
  misc_feature: GZ8MTXP02JD2J1.21.27.C05.1.454.CMB.2.raw
  modified_base (204)..(204): a, c, t, g, unknown or other
  modified_base (314)..(314): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgcccaccctctcctgcacacgccagtcagtctatcgctgactggttacgccgtggtaccagcaagaaatcgtcggccaggcctcccgaggcctcctctactttaccgngacactcccaccgacgggcccacgtcggtcgtacccgagacgtacggttcagggtcgggtcggtaggtagtttaggggactaggttacgttttcctcctaccacgtatcacgccgtaccctagagtagtagaagtagttgttgacgttagtttactttcgtacgtaccagtactaaattattaacttacgtcggtcctggtcgtaccggtacggttccggaccgaacgggtacgaagggtaacggaaactacgaaaacgtacgtaggtacggcgtacgacctacgtatacgttcgttactac

SEQ ID NO: 396270 - DNA, 682 bp, Homo sapiens
  misc_feature: GZ8MTXP02GZ67T.21.27.C05.1.454.CMB.2.raw
  modified_base (199)..(199): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggcctccccgaggcctcctctattttacccgtgcactcccaccgagggcccacgtggtcgtccccagaccgtaggttcccaggtcgggacgggtgggtagtttggggaactagggttaggtttttcctccgtacctaacccgtaatccgaacggcccgtacccttaaccgaggtaaggtaggaaaggtattggttaggtaccttaaggtttttactttccgtaggtacccctaaggtaccttaaaatttaacttaaagtttaacccgttcgggtaccccgttgggtacccgttaccgggtaaccggtttcccgggacccgtaaccgggggtaccgtaaaaggggtacgtaaaacgtacgaaaacgtaacgtaggtcgacgtcgaccaaccgtattctcgtttcctactacc

SEQ ID NO: 396271 - DNA, 570 bp, Homo sapiens
  misc_feature: GZ8MTXP02H52QU.21.27.C05.1.454.CMB.2.raw
  modified_base (199)..(199): a, c, t, g, unknown or other
  modified_base (295)..(295): a, c, t, g, unknown or other
  modified_base (372)..(372): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggtagctggtaccagcagaaatctggccaggctcccaggcctcctcatttaccgngcctatccaccgagggcccagtggtcgtcccagacaggttcaggtggcggtggtatttggggactggtacgttttcnccgtacacctatcacgccgtaccctagacgagtcgaagtattgtgctagtttattcgtgccagactaatactaattacgtgcctgtcgtcgtacgttcggacccgtaacgggacgtaaagggtacgaaaacttaccgaaaacgtacgtacgggtcgacgttaacggctaaccctagttctacggttacttactaaccg

SEQ ID NO: 396272 - DNA, 566 bp, Homo sapiens
  misc_feature: GZ8MTXP02IGO39.21.27.C05.1.454.CMB.2.raw
  modified_base (223)..(223): a, c, t, g, unknown or other
  modified_base (366)..(366): a, c, t, g, unknown or other
  modified_base (392)..(392): a, c, t, g, unknown or other
  modified_base (401)..(401): a, c, t, g, unknown or other
  modified_base (455)..(455): a, c, t, g, unknown or other
  modified_base (472)..(472): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttnactcacctgtgacatctccggggaaatgtcgctggcaacaatggttggaattggattaggcacgtccccgtgagaggccttggagtggcttggaaggtaccttattagtacgtcccgagtggtatcgaagtactagtgcagtnttctgtcgagtcgggtctctccaacntccaacccngtaacacgtaccaagatcacgtctcctacactatgtactgcactcccgagtacnggtctagtttatttcgngtacaggaggacttaccgattacgttcggtacgaaccttaaccgttaccgttcggtaacctcccggttcggggacccgtaaggggttaacccgg

SEQ ID NO: 396273 - DNA, 529 bp, Homo sapiens
  misc_feature: GZ8MTXP02ITYFA.21.27.C05.1.454.CMB.2.raw
  modified_base (224)..(224): a, c, t, g, unknown or other
  modified_base (358)..(358): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttnactcacctgtgacatctaccggggaaaatgtcgctggcaacaatggttggaattggattaggcagtccccgtgagaggccttgagtggcttggaggacctattatacgtcccagtggtactgaagctatgcagnttctgtgagtcggtcgtctcaccatcacccagacacgtacaagaatcagtcctcctaccaccttaatgttactcgtcacctcccgacgacacgactagtttatttgtgtacagaggactacactacgttcgtacgtactaacctctacgactcgtacgggcctaggttacg

SEQ ID NO: 396274 - DNA, 581 bp, Homo sapiens
  misc_feature: GZ8MTXP02GKO9X.21.27.C05.1.454.CMB.2.raw
  modified_base (202)..(202): a, c, t, g, unknown or other
  modified_base (248)..(248): a, c, t, g, unknown or other
  modified_base (283)..(283): a, c, t, g, unknown or other
  modified_base (290)..(290): a, c, t, g, unknown or other
  modified_base (358)..(358): a, c, t, g, unknown or other
  modified_base (379)..(379): a, c, t, g, unknown or other
  modified_base (390)..(390): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggtancctggtaccagcagaaatctgcaggctccagctcnattacgncatccacgagggccacgtggtctcccagacaggttcagtggcggtggatttgggactagtagttttcncgtccacatcagccgccctanagagtagaagntgttgctagtttatttcgcgtaccagtactaaattaacgtaaatttaccgtggtaccctggtacccgttacggtaaccggtttccgggacccgtaaacgggggtaaccctaaaaggggtacggtaaaaacttaccgaaaaacgtaaaccgtggtacggaacgtacgacaccctagtctacggttcttaccg

SEQ ID NO: 396275 - DNA, 713 bp, Homo sapiens
  misc_feature: GZ8MTXP02IW5ET.21.27.C05.1.454.CMB.2.raw
  modified_base (203)..(203): a, c, t, g, unknown or other
  modified_base (314)..(314): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctcctgcacagccagtcagtctatcgctgactggttacgcctggtaccagcaagtaaactcgtcggccacggcctacccgaggcctcctctactttaccgnaccactacccaccgacgggcctacgtcggtccgtacccagtaccgtacggttcagggtcgggtcgggtaggtagtttcggggactaggttacgtttttcctccgttaccaaccgtatccgacgtcccgtacccctaacgaggtaggtaagaagtgttagttacgtacgttagttttactttcgtacgtaccgtagtactaaatttaacttaaacgttaccgtacggtaccgttcggtacccggttaccggttaccggtttacccgggaacccggtaaaccggggtaaccgtaaaacggggttaacggtaaaacgttaaaccgtaaaaaccggtaaccgttagggtaccggtaacgtaccggaccgtaaccgtacgttccgtttaccgttacctttaccg

SEQ ID NO: 396276 - DNA, 617 bp, Homo sapiens
  misc_feature: GZ8MTXP02HJ8VJ.21.27.C05.1.454.CMB.2.raw
  modified_base (202)..(202): a, c, t, g, unknown or other
  modified_base (381)..(381): a, c, t, g, unknown or other
  modified_base (416)..(416): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccacctctcctgcacagccagtcagtctatcgctgactggttagcctggtaccagcagaaatctggccaggcctccaggcctcctctatttaccgtgcactcccacgagggccagtggtcgtcccagactacggttccaggtgggcggttggacgtttggggcctaggtagttttcnctcaccatcacgccgtaccctagacgagtgaagtntgttgacttagtttacttcgtgcctaggtactaagttactaaactttcgtcgggtcctaggtcgttaccggacggtttccggacccggtaacggggaacccgtaaaggggtaccggtaaaattaccgaaaaacggtaccgttaagggtcgtaaccgttcggtacccaaccgttaacttccgttacggtttcctttaaccgg

SEQ ID NO: 396277 - DNA, 567 bp, Homo sapiens
  misc_feature: GZ8MTXP02JREZO.21.27.C05.1.454.CMB.2.raw
  modified_base (359)..(359): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgaccctttcactcacctgtgacatcgtaccggggaaatgtcgctggcaacaatggtggaattggattaggcagtccccgtgagaggccttgagtggcttggaaggacctattatacgtccagtgtatgaagactatgcagtnttcgtgtgagcgtcgtctcacatccacccagacacgtaccaagactcgacgtcctccctaccacctaaatcgtactgtccactcccgacgacacggctagttttactttgcgtacaagggtacggtactaccactacgtttacggtcgtaaccttaaccctccgttacgaccgttccgtaccgggggaccgtaaggggtttaacccgg

SEQ ID NO: 396278 - DNA, 619 bp, Homo sapiens
  misc_feature: GZ8MTXP02FQY2S.21.27.C05.1.454.CMB.2.raw
  modified_base (352)..(352): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacatggtagaatggattaggcagtccccgtgagagcctgagtgcttggaagcctattactacgtccagtggtatgaagactatgacagtnttctgtgagtcgtcgtctcaccatccacccagaccacgtaccaaagaactcgaggtacctaccctacccaaccttaatcggtacctcgtacccgaccttacccccggaacgtacccaacggggtacttacgtttttaatttttcggacgttaccgaaaaggtacgggtacttacgacgttaacgtttccggggtataacccttaacccggttacctttacggaacccgttccggtacgggggtacccgtaacgggggttttaaaccg

SEQ ID NO: 396279 - DNA, 527 bp, Homo sapiens
  misc_feature: GZ8MTXP02GVITB.21.27.C05.1.454.CMB.2.raw
  modified_base (300)..(300): a, c, t, g, unknown or other
  modified_base (487)..(487): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggtggaattggattaggcagtccccgtgagnggcctgagtggcttggaaggacctattatacgtcccagtggtatgaagactatgacagattctgtgagtcggtcgtctcacatccacccagacacgtcaagaatcacgtctccctaccacctaatgtctgtcactcccgacgacacggctagtttatttgcgacaagaggtactcactagttcggtnaccgtaactcttacgactccgtacggccgaagggttaccg

SEQ ID NO: 396280 - DNA, 576 bp, Homo sapiens
  misc_feature: GZ8MTXP02JGFGA.21.27.C05.1.454.CMB.2.raw
  modified_base (366)..(366): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaatgtcgctggcaacaagtggtggaattggattaggcacgtccccgtgagaggcctgagtggcgttggaaggtacctattactacgtcccaggtcggtatgaagactatgacagnttctgtgagcggtcgtctcaccatccaccccagaccacgtaccaagatcagtcctaccctaccacctaatcgtctcgtccacctcccgaaccgacgaccggacttagttttacgtttagtcgtacgtaaaggtggactacaactacgttcggtataccgttaacccgtcgttacgtaccgttccgtacggggtccgtaacgggttaaccg

SEQ ID NO: 396281 - DNA, 544 bp, Homo sapiens
  misc_feature: GZ8MTXP02GPF21.21.27.C05.1.454.CMB.2.raw
  modified_base (198)..(198): a, c, t, g, unknown or other
  modified_base (265)..(265): a, c, t, g, unknown or other
  modified_base (295)..(295): a, c, t, g, unknown or other
  modified_base (364)..(364): a, c, t, g, unknown or other
  modified_base (438)..(438): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctccagacaccactggagtgattgtgatgacgcagtctccagccaccctgtctgtgtctccgagggggancgccaccctctcctgcacagccagtcagtctatcgctgactggttagcctggtaccagcagaaatcnggccaggctcccaggctcctcatttaccgncatcccacaggcccactggtctccagacaggttccaggtggcggtggatttggggactagtagttttcnctcaccatcagccgccctacagagtagaaagtatgttagctagtttattctgtccagactaatattaattacgngcctgcgtcgacgttcggaccgaacgggacctaaagggtacggaaactacgaaaacgacgttacggcggtactaacgacacccgtatctacggtaccttctaaccg

SEQ ID NO: 396282 - DNA, 520 bp, Homo sapiens
  misc_feature: GZ8MTXP02JQEI1.21.27.C05.1.454.CMB.2.raw
  modified_base (201)..(201): a, c, t, g, unknown or other
  modified_base (301)..(301): a, c, t, g, unknown or other
  modified_base (369)..(369): a, c, t, g, unknown or other
  modified_base (440)..(440): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggcctcccgaggcctccctcatttaccgngccatcccaccagggccactggtctcccagcaggttcagtggcggtggatttgggctagtagttttcnctcactatcacgcgccctacagagtagaagtatgttgacttagtttattctgcctagctaatataattacngtcctgcgtcgtacgtcggcgtacgggacaagggtacgaaatacgaaaacgactgaggcgtgacacgatcctagtcttac

SEQ ID NO: 396283 - DNA, 600 bp, Homo sapiens
  misc_feature: GZ8MTXP02IVL6H.21.27.C05.1.454.CMB.2.raw
  modified_base (200)..(200): a, c, t, g, unknown or other
  modified_base (247)..(247): a, c, t, g, unknown or other
  modified_base (296)..(296): a, c, t, g, unknown or other
  modified_base (373)..(373): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggaccagcagaaatctggccaggcctccaggcctctcatttaccgncatccacagggtcccagtcggtcgtcccagacgaggttcccaggtggcggtggtatttggggactaggtcgttttcnctccacctatcagccgaccctagagagtgaagtagtgttgctagtttattctgaccctagtactaaattattaaatttacgtcggtacctggtccgtacggtaccggtttccgggacccgtaaccggggaccgtaaaaggggttacggaaaactaccgaaaacggtacgtcggtacgggtacctaaggacccaacctacgttccgttacgtttacctttactaaccg

SEQ ID NO: 396284 - DNA, 562 bp, Homo sapiens
  misc_feature: GZ8MTXP02GYHPC.21.27.C05.1.454.CMB.2.raw
  modified_base (203)..(203): a, c, t, g, unknown or other
  modified_base (304)..(304): a, c, t, g, unknown or other
  modified_base (386)..(386): a, c, t, g, unknown or other
  modified_base (412)..(412): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgcccaccctctcctgcacagccagtcagtctatcgctgactggtagcctggtaccagcagaaatcgtggccaggctcccaggcctcctctatttaccgngcactcccaccgagggccacgtcggtcgtcccaagacacggttcaggtcgggcggtggtatttggggactaggtagttttcncttacacctatcaagcccaccctaanagacgtagaaagattggttagtaaagttttattcgtgacctagactaaataattaaagttactggtcctgcgtcgaccgttccggccgaacgggaccaagggtaggaaactcgaaaacgtactgtcgactgacacgatctcgtcttctac

SEQ ID NO: 396285 - DNA, 610 bp, Homo sapiens
  misc_feature: GZ8MTXP02I6TG7.21.27.C05.1.454.CMB.2.raw
  modified_base (202)..(202): a, c, t, g, unknown or other
  modified_base (472)..(472): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgactggttagcctggtaccagcaagaaatctggccaggcctcccgaggcctcctctactttaccgtgccactcccaccgacgggtcccacgtcggtacgtccccaaggtacacgggtttcaggtgggcggttaggtagtttggggactagttacgttttcctactccacctatccgaacgcccgacccctaagaggtagttagaaagtgttgttacgtcttagtttctttcncgtacaagtacaaattataacttacgtcggtcctggccgttacggtaccggttccgaccgtacgggaaccgtaaagggtacgaaaactacgaaaacgtacgtggtacgcgtacaccgacctatccgtcgtaccttacg

SEQ ID NO: 396286 - DNA, 815 bp, Homo sapiens
  misc_feature: GZ8MTXP02JP26I.21.27.C05.1.454.CMB.2.raw
  modified_base (201)..(201): a, c, t, g, unknown or other
  modified_base (303)..(303): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccacctctcctgcacagccagtcagtctatcgctgactggtagcctggtaccagcagaaatcgtggccaggcctccgaggcctcctctacgttttaccgngtacctactcccgaaccgtacggggtccctaacgttcgggtaccgtaccccgtaaggtaccgtacggggtttccgaagggttcgggtaccgggttaggggtaacgttttacggggaccgttaacgggtttacgtttttacccgtaccgttaccgtaacccgtacgttacccggtaaacgtcccgttaacccccgttaaacggtaacggtaacggttaacggtaaacggttaacgttcgggtttacgtaaccgtttaacggtttttaacgtttccgtacggtaacccgttaacggtaccttaaaacgtttacgtttaaaacgtttaccgtacgggtacccgtttaggtacccggtttaccggttaaccggggtttacccgggacccggttaaaaccgggggtaacccgtaaacggggttaaccggtaaaaccgttaaccggtaaaacggtaaccggttcggtacggtaaccgttacggaccctaacgtacgttaccgttacgtcctttaaccg

SEQ ID NO: 396287 - DNA, 579 bp, Homo sapiens
  misc_feature: GZ8MTXP02HD86T.21.27.C05.1.454.CMB.2.raw
  modified_base (274)..(274): a, c, t, g, unknown or other
  modified_base (285)..(285): a, c, t, g, unknown or other
  modified_base (294)..(294): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcacatgtgatgatgnagtccgtgagngctgagtgntgagactatatacgtccagtggtatgaagactatgcagattctgtgagcggtcgtcgtccaccatccaccccagaccacgtacccaaagaactacgacggtcctaccccgtaccaacccgttaaatcggttactcgttcaacctcccgaacgaccacgggtctaaggttttacttttcgagtaccgtaaaggacgggtatccgaaactacgttaccggttagtaaaccttcccttaccgttacgtaccgttcccggtacggggtacccaacggggtttaacccgg

SEQ ID NO: 396288 - DNA, 604 bp, Homo sapiens
  misc_feature: GZ8MTXP02IIDWR.21.27.C05.1.454.CMB.2.raw
  modified_base (200)..(200): a, c, t, g, unknown or other
  modified_base (394)..(394): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctccgaggcctcctctatttaccggcactccaccgacgggcccacgtggtcgtccccgagtacgacggtttccaggtcgggcgggttaggtagtttacggggactggttacgtttttccncttaccaccctatccacgtcccgccctacgagagtagaagtatgttgacttagtttacttctgtaccagtactaaatacttaacttacgtggtacctggtcgtacggtacgttccggaccgaacggggtaacctaaagggtacgaaacgttaccgaaaacgtacgtacggtagcgtaacgaccgtaacctactcgtcgttactactaccg

SEQ ID NO: 396289 - DNA, 671 bp, Homo sapiens
  misc_feature: GZ8MTXP02JQKWV.21.27.C05.1.454.CMB.2.raw
  modified_base (203)..(203): a, c, t, g, unknown or other
  modified_base (308)..(308): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccagcaagaaatcgtggccaggcctcccgaggcctcctctactttaccgngcctactccccgaccgacggggccctacgtcgggtaccgtccccaaggtacctacgggtttcaggttcgggcgggttgggtacgtttggggactaggttacgttttccacgtccaccatccgacgtcccgaccctacgagagtagaagtagttggttcgtacgttagttttactttccgtacggtacctacgtactaaaattaatttaaacgtttacgtacggtccttcgggtccggttacggttaacccggttcggaaccccggtaacgggtaaccggtaaaggggttacgaaaacgtaccgaaaacggtacctgggttacggcgttacggacctacccgtattccttcggtacctttaccg

SEQ ID NO: 396290 - DNA, 535 bp, Homo sapiens
  misc_feature: GZ8MTXP02F3YFP.21.27.C05.1.454.CMB.2.raw
  modified_base (356)..(356): a, c, t, g, unknown or other
  modified_base (495)..(495): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacaatggtggaattggattaggcagtccccgtgagaggccttgagtggcttggaaggacctattatacgtccagtggtatgaagactatgcagntctgtgagcggtcgtctcaccatcaccccagacacgtaccaagaactcaggtcctaccctaccaccttaaatcgtctgtaccactaccccgacgacacggctagtttatttgatcgaaggaggtactcactacgttcgngtaactccgtccttgactccgtcgggacgtacgggtaacg

SEQ ID NO: 396291 - DNA, 527 bp, Homo sapiens
  misc_feature: GZ8MTXP02FRCVX.21.27.C05.1.454.CMB.2.raw
  modified_base (203)..(203): a, c, t, g, unknown or other
  modified_base (290)..(290): a, c, t, g, unknown or other
  modified_base (299)..(299): a, c, t, g, unknown or other
  modified_base (366)..(366): a, c, t, g, unknown or other
  modified_base (399)..(399): a, c, t, g, unknown or other
  modified_base (424)..(424): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagcctggtaccatcagaaatctggccaggctccagctcctnatttaccgngcatccacagggccactggtcgtcccagcaggttcagtggcggtggatttggggactgtagttttcnctcacctatcacgccgccctacagagtagaagnttgttgcttagtttattctgacagntaaatattaattacgtggtcctgtcgttcgacgttcgccgacgggaccaaggtacgaaaactacgaaaacgactggtacggctagccacactcgtctcttacg

SEQ ID NO: 396292 - DNA, 613 bp, Homo sapiens
  misc_feature: GZ8MTXP02H0RZE.21.27.C05.1.454.CMB.2.raw
  modified_base (199)..(199): a, c, t, g, unknown or other
  modified_base (235)..(235): a, c, t, g, unknown or other
  modified_base (313)..(313): a, c, t, g, unknown or other
  modified_base (472)..(472): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgntgactggttacgcctggtaccagcaagaaatcgtcggacccaggcctccccgaggtccctcctactacttttacccgngccactcccaccgacgggcccacgtcggtacgtaccccagacgtaggttccgaggtcggcggtggtagtttggggactaggttacgtttttcaccttacaacctagtaccacgcccgaccctaagacgagtagaagtagttgtgtactagtttattcgngtacctagactaaattattaaacttacgtggtacctgtaccgtacgtaccggttccgaccgaacgggtaccgaaaggtacggaaaactacgaaaacggtaactcggtagaccgtgacacctagtcttacgtactttacacg

SEQ ID NO: 396293 - DNA, 750 bp, Homo sapiens
  misc_feature: GZ8MTXP02H0A3I.21.27.C05.1.454.CMB.2.raw
  modified_base (204)..(204): a, c, t, g, unknown or other
  modified_base (305)..(305): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctcctgcacagccagtcagtctatcgctgactggttagcctggtaccagcagaaatctggccaggcctcccgaggcctcctcactttaccgngccatccccaccgagggcccacgtggtcgtccccagtacctacggttcgaggtgggccggggttggtagttttaggggaccttagggttacgttttttccctccgttaccaaccctaagttcccaacggtcccgtacccccgttaacgaaggtaacggttaggaaaaggttacgtttggtttacgtaccgtttaaggtttttaactttccgttacggtacccctaaggtaaccttaaaatttaacttaaaacgttttaaccgtaccggggtacccgtttacgggtcccggtttacccgggttaaccgggtttcccgggggaacccccggtaaaccgggggtaaacccgtaaagggggttaacggaaaaccgttaaccgaaaaaccgtaacgttcggtacggtaacgtacggacctacccgtaattccgttacgtttccctttacc

SEQ ID NO: 396294 - DNA, 551 bp, Homo sapiens
  misc_feature: GZ8MTXP02FF19G.21.27.C05.1.454.CMB.2.raw
  modified_base (357)..(357): a, c, t, g, unknown or other
  modified_base (493)..(493): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaatgtcgctggcaacaatggttggaattggattaggcagtccccgtcgagaggccttgagtggcttggaaggacctattatacgtccagtggtatgaagactatgcagnttcgtgtgagcgtcgtctcaccatccaccccagacacgtaccaaagaactcaggtcctccctacccacctaaatcgtactcgtccacctccccgacgaccgacggctagtttattttcgtagcgaaagagggtacnctacgacttcggagtacctaaccgtccttcgacctccgtacggggccaggggtaaccg

SEQ ID NO: 396295 - DNA, 565 bp, Homo sapiens
  misc_feature: GZ8MTXP02GA5ZX.21.27.C05.1.454.CMB.2.raw
  modified_base (203)..(203): a, c, t, g, unknown or other
  modified_base (389)..(389): a, c, t, g, unknown or other
  modified_base (409)..(409): a, c, t, g, unknown or other
  modified_base (419)..(419): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctcccaggcctcctctactttaccgtgccactcccaccgaggggcccacgttcggtcgtccccaggacctaggttcaggtggcggtggatttggggactaggtacgttttcnctcaccatcagcgaccctanagagtgaagnttgtgctagtttattcgtgccagcaattatatactggcctgcgtcgacgttcggaccgtacgggaccgtaagggtacggaaaactcgaaaaacggtacctgggtacggaacttcggacctaacccgtatccgttcgttcctttacc

SEQ ID NO: 396296 - DNA, 671 bp, Homo sapiens
  misc_feature: GZ8MTXP02GEOYO.21.27.C05.1.454.CMB.2.raw
  modified_base (202)..(202): a, c, t, g, unknown or other
  modified_base (300)..(300): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggctccgaggcctcctctatttaccgncactacccaccgacgggccacgttcggtccgtacccgagtacgtacggttcgaggtcgggcggttaggtagtttaggggactaggttacgtttcctcctaccgacctatacgacgcccgtaccctaagaggtagtagaagtgttgttacgtacgtttagttttacttcgacgtacctagtaactaaatttacttaaacgttaccgtcggtaccgttaggtccggttaccggttaccggttcccgggaacccggtaaccggggtaaaccgtaaaggggttaaacggtaaaactaaccggtaaaacggtacgttacggtacgggtaaccgtaccgaacctaaccgttacgttaccgttacgtttacctttacg

SEQ ID NO: 396297 - DNA, 626 bp, Homo sapiens
  misc_feature: GZ8MTXP02F2FOE.21.27.C05.1.454.CMB.2.raw
  modified_base (202)..(202): a, c, t, g, unknown or other
  modified_base (303)..(303): a, c, t, g, unknown or other
  modified_base (399)..(399): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgactggtagcctggtaccagcagaaatctggccaggctcccgaggcctcctctactttaccgngcactcccaccgacgggcctacgtcggtcgtacccagtacgtacggttcgaggtcggggcgggttaggtagtttggggactaggttacgttttccnctaccaacctatacgacgtcccgtaccctaagaggtagtagaagtagttggttagtacttagttttactttcgtgacctagtactaaattaattaacttcgtcggtccgtcgtaccggtaccggtaccggttccgggacccggtaaccgggtaacgtaaagggtaaacggaaaactaaccgaaaacgtacgtggtacgtcgtacgacctactacttctcgttcttac

SEQ ID NO: 396298 - DNA, 521 bp, Homo sapiens
  misc_feature: GZ8MTXP02FWS2A.21.27.C05.1.454.CMB.2.raw
  modified_base (199)..(199): a, c, t, g, unknown or other
  modified_base (296)..(296): a, c, t, g, unknown or other
  modified_base (369)..(369): a, c, t, g, unknown or other
  modified_base (404)..(404): a, c, t, g, unknown or other
  modified_base (498)..(498): a, c, t, g, unknown or other
  modified_base (502)..(502): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggctcccaggctcctcatttaccgngcatccaccagggcccactggtctccccagactaggttccaggtggcggtggatttggggactgtagttttcnctcaccatcagccgccctacagagtgaagatgttnctagtttattctgaccagctaaattattaattactggacctgcgtcgacgttcggcaacgggtaccaaggtgaaactcgaaaacgacgtacggngacngacactatcgtcgtctcac

SEQ ID NO: 396299 - DNA, 576 bp, Homo sapiens
  misc_feature: GZ8MTXP02JYU85.21.27.C05.1.454.CMB.2.raw
  modified_base (203)..(203): a, c, t, g, unknown or other
  modified_base (300)..(300): a, c, t, g, unknown or other
  modified_base (375)..(375): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtacagcagaaatctggccaggcctcccaggctcctctatttaccgnccatcccaccgagggccacgtggtctcccagacacggttcaggtggcggtggacgtttgggactgtagttttccncgtcacatcacgccgccctacgagagtagacgatgttgcttagtttattctgacctagtactaaatataacttacgtggtacctggtcgtacgtacggttccggacccgtaacggggacccgaagggttaacggaaaactacgaaaacgtaacgttcggtacggccgtacggacctaccgtacttcgtacgttctttaacc

SEQ ID NO: 396300 - DNA, 543 bp, Homo sapiens
  misc_feature: GZ8MTXP02I1URI.21.27.C05.1.454.CMB.2.raw
  modified_base (224)..(224): a, c, t, g, unknown or other
  modified_base (354)..(354): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttnactcacctgtgacatctaccggggaaatgtcgctggcaacaatggtggaattggattaggcagtccccgtgagaggccttgagtggcttggaagcctattatacgtcccagtgtatgaagactatgcagnttctggtgagcgggtgtctcaccatccacccagacacgtaccaagaactcaaggtcctccctccacctaatcgtctgtcacctcccgacacacggctagtttatttgtagctaaggagggactcgaactcgttcggtgtaccttaaccgtcccgttagacctccgtacggggcctacggggtttaaccg

SEQ ID NO: 396301 - DNA, 802 bp, Homo sapiens
  misc_feature: GZ8MTXP02I8H49.21.27.C05.1.454.CMB.2.raw
  modified_base (203)..(203): a, c, t, g, unknown or other
  modified_base (305)..(305): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtacgcctggtaccagcaagaaatctggccaggcctcccaggcctcctctactttaccgngccactcccgaccgtacgggccctacgtcgggtccgtaccccgaagtaccgtacggggtttccaggggtcggggtccggggttaggggtaacggtttttcggggaccgttaagggtttacggttttttccgtacccttaccgtaaaccctaattcccggaaacgtcccccgtaaccccgttaaaccgaaggtaacggtaagggtaaaagtagtttcgggtttacggacccgtttaaggtttttaacttttccggtacggtaacccctaaaggttaaccttaaaagttaagtttaaaactttaccggtccggggttacccgttcgggtaccgggtttaccgggtaaacccgggtttcccggggaaacccccggtaaacgggggtaaaaccccgtaaagggggttaacgggaaaaacttaaccggtaaaaccggtaaacgttcgggtaacggtcgttaccgaccgttaaccgtactttccgtcggtttacctttacccg

SEQ ID NO: 396302 - DNA, 599 bp, Homo sapiens
  misc_feature: GZ8MTXP02F5ZZK.21.27.C05.1.454.CMB.2.raw
  modified_base (203)..(203): a, c, t, g, unknown or other
  modified_base (304)..(304): a, c, t, g, unknown or other
  modified_base (402)..(402): a, c, t, g, unknown or other
  modified_base (414)..(414): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcaagaaatctggccaggcctcccaggcctcctctactttaccgngcactccaccgagggccacgtggtcgtccagacaggttcaggtgggcggtggtagtttgggactagtagtttctctaccactatcacgccgaccctanagagtagaagtnttgttgcttagtttactttcgcgacctagtactaaattaacttaaattaccgtggtaccttggtaccggttccggtaaccgggttccgggacccgtaaccggggtaaccgtaaagggtaacgggaaaactacgaaaacgtacgtggtacggccgtcgacctaccgtagttcgtacgttctttacc

SEQ ID NO: 396303 - DNA, 599 bp, Homo sapiens
  misc_feature: GZ8MTXP02FTE3P.21.27.C05.1.454.CMB.2.raw
  modified_base (223)..(223): a, c, t, g, unknown or other
  modified_base (234)..(234): a, c, t, g, unknown or other
  modified_base (366)..(366): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttnactcacctgtnacatcgtccggggaaaatgtcgctggcaacaatggtggaattggattaggcagtccccgtgagaggccttgacgtggcgttggaagggacctatttatacgtcccagtggtatgaagactatgcagtattcngttgagcggtcgtctcaccatccacccagaaccactaccaagaactcagtcctccctaccaacctaatcgtactcgtaccacctaccccgacgacgacggacttacgtttattttgtacgtacgtaaaggtaagggtactacgaactacgtttaccggtacggttaaacctaaccctttaccgttacgtacccggttacccgttcgggggaccccgtaggggtttaaacccgg

SEQ ID NO: 396304 - DNA, 572 bp, Homo sapiens
  misc_feature: GZ8MTXP02GI09M.21.27.C05.1.454.CMB.2.raw
  modified_base (357)..(357): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaaactacagcagtctggtccaggactggtgaggccctcgcagaccctttcactcacctgtgacatcgtaccggggaaatgtcgctggcaacaatggtggaattggattaggcagtccccgtgagaggccttgagtggcttggaagacctattatacgtccagtgtatgaagactatgcagtnttcgtgtgagtcgtacgtctcaccactccaccccagacacgtaccaagaatcagtcctccctacctaacctaatcgtctcgtaccaccgtacccgacgaccgacggtactagtttactttgacgtacaaaggacggactacgaactacgttaccggtcgtaacctaaccgttccttacgtaccgtccgtacgggggaccgtacggggtttaaccg

SEQ ID NO: 396305 - DNA, 646 bp, Homo sapiens
  misc_feature: GZ8MTXP02HVX38.21.27.C05.1.454.CMB.2.raw
  modified_base (202)..(202): a, c, t, g, unknown or other
  modified_base (302)..(302): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagctggtaccagcagaaatctggccaggcctcccgaggcctcctctactttaccgngaccactcccaccgacgggccacgtcggtcgtaccccaggactacggttcaggtgggcggtggtagtttggggactaggttacgtttctccgtacacctatccaagtcccgaccctacgagtacgtagaaacgtattggttgacttagtttaactttcgacggtccaaggtactaaaattagttaaacttaccgtcggtacctggtccggttacgtaaccgggttcggacccggtaaacggggacccgttaaaggggtaacgtaaaacgtaaccgtaaaacggtaccgttaggttacggaaccgttacggaacctaaccgtaacttcgttcgtttactttaccg

SEQ ID NO: 396306 - DNA, 541 bp, Homo sapiens
  misc_feature: GZ8MTXP02JOK3W.21.27.C05.1.454.CMB.2.raw
  modified_base (413)..(413): a, c, t, g, unknown or other
  modified_base (486)..(486): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatgggtgtcctgtcacagatcaaactacagcagtctggtccaggactggtgaggccctcgcagaccctttcactcacctgtgacatctccggggaaatgtcgctggcaacaatggtggaattggattaggcagtccccgtcgagaggccttgagtggcttggaaggacctatatacgtccagtgtatgaagactatgcagatctagtgagcggtcgtctcaccatcacccagacacgtcaagatcagtctccctcacctaancgtactgtcactccgacgacacggctagtttacttttgcgtactaagacggggatacgacaacgtttccggtnaaccgttaacctccgttacggacctccgttacggggaccctaggggtttaaaccg

SEQ ID NO: 396307 - DNA, 623 bp, Homo sapiens
  misc_feature: GZ8MTXP02GOBHD.21.27.C05.1.454.CMB.2.raw
  modified_base (362)..(362): a, c, t, g, unknown or other
  modified_base (379)..(379): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggttggaattggattaggcagtccccgtgagaggcctgagtggcttggaaggctattatacgtccagtgtatgaagtactatgacagtattcgngtgagcgtcgtctcacntccacccagacacgtacaagaactcacgtcctccctacctactaactcgttctacgtaccaccgtccccgaacgacctacggtacttacgttttacgttttcgacgtaaccgtaaagggtacggggtaacttacccgaaacttacggtttaccgggtaacgtaaccccgtttaacccgtttacccgttacggttaacccgttccggttaccgggggaacccgtaacgggggttttaaaccccgg

SEQ ID NO: 396308 - DNA, 580 bp, Homo sapiens
  misc_feature: GZ8MTXP02HN6RO.21.27.C05.1.454.CMB.2.raw
  modified_base (201)..(201): a, c, t, g, unknown or other
  modified_base (302)..(302): a, c, t, g, unknown or other
  modified_base (379)..(379): a, c, t, g, unknown or other
  modified_base (423)..(423): a, c, t, g, unknown or other
  modified_base (437)..(437): a, c, t, g, unknown or other
  modified_base (543)..(543): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccaccctgtctgtgtctccgaggggganccgccaccctctcctgcacagccagtcagtctatcgctgactggttagcctggtaccagcagaaatcgtggccaggcctccaggcctcctctatttaccgncatcccacgagggccagtggtctacccagactcggttcaggtcggcggtggtagtttggggactagttagttttccnctccaccatcagtccgaccctagagagtagaagtattgttacgnttagtttatttcgngtacctaagtactaaaattacgttaaatttacgtcggtactggtccgtcgttaccggttcggaccgtaacgggaccgaaagggttacgaaactaccgaaaaccgtnttacggagccgtgaccacgtatcttcgttaccttacg

SEQ ID NO: 396309 - DNA, 558 bp, Homo sapiens
  misc_feature: GZ8MTXP02F7GI2.21.27.C05.1.454.CMB.2.raw
  modified_base (203)..(203): a, c, t, g, unknown or other
  modified_base (289)..(289): a, c, t, g, unknown or other
  modified_base (377)..(377): a, c, t, g, unknown or other
  modified_base (408)..(408): a, c, t, g, unknown or other
  modified_base (428)..(428): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggctccaggcctccnctactttaccggcactcccaccgacgggcccacgtggtcgtaccagacaggttcagtgggcggtggtatttgggactagtagttttcnctcacatcacgccgccctagagagtagaagnttgtgtcttagtttatttcngacctagactaattaataattacgtggtcctggtcgtcgtacggttcggaccgtaacgggaccgaagggtacggaaacttacgaaaacgtaactggtacggctacgaccgactatacgtcgttctttacc

SEQ ID NO: 396310 - DNA, 655 bp, Homo sapiens
  misc_feature: GZ8MTXP02JD9NJ.21.27.C05.1.454.CMB.2.raw
  modified_base (204)..(204): a, c, t, g, unknown or other
  modified_base (327)..(327): a, c, t, g, unknown or other
  modified_base (431)..(431): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgcccaccctctcctgcacacgccagtcagtctatcgctgacgtggtacgccgtggtaccagacaagaaactcgtcggaccgacggtcctcccgacggtcctcccttacgtacgtttaccgngacctactaccccgaccgacgggccctacggtcggtacgtacccgagtacgtacggttcgagggtcgggtcgggttggtacgttgggactagttacgttttccncgtaccactatccgacgtcccgtaccctaagagtaggtagaagtgttgtacgtacttagttttacttcgtacgtactagtactaattaattaaacttcgtcggtaccgtggtccgttacggtaccggtccggaccggtaaccgggaacgtaagggtacgtaaaacgtaacgaaaacgtacgtacggtacggaacgtacgaccacctagttccgtacgtacttcg

SEQ ID NO: 396311 - DNA, 557 bp, Homo sapiens
  misc_feature: GZ8MTXP02JE1OP.21.27.C05.1.454.CMB.2.raw
  modified_base (358)..(358): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagacccctttcactcacctgtgacatcgtaccggggaaatgtcgctggcaacaatggtggaattggattaggcagtccccgtgagaggcctgagtggcttggaaggacctattatacgtcccagtggtatgaagactatgcagnttctgtgagtcggtcgtctcaccatccaccccagacaccgtacaagaactcaggtcctccctccacctaatcgtctgtcactcgccgacgacgacggctagtttattttgtggacaaaggtacgggatacgactacgttcggtacgaacccttacccccgttagacccgtccgtcgggggacccgtaggggtttaaccg

SEQ ID NO: 396312 - DNA, 621 bp, Homo sapiens
  misc_feature: GZ8MTXP02JT1TV.21.27.C05.1.454.CMB.2.raw
  modified_base (203)..(203): a, c, t, g, unknown or other
  modified_base (303)..(303): a, c, t, g, unknown or other
  modified_base (388)..(388): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggancgccaccctctcctgcacagccagtcagtctatcgctgactggtagctggtaccagcagaaatctggccaggcctcccgaggcctcctctactttaccgngcactcccaccgacgggcccacgtcggtcgtcccaggacacggttcaggtgggcggtggtagtttcgggactaggtacgttttcnctcacatcgacgcccgaccctaacgagtaagtgaaagtatggttagcttagttttatttcgtgtacccagtactaaattattaaacgtttacgtcggtacccgttggaccggttccgggttaaccggttccggggaccccgtaaaccgggggtaacccgaaaggggttaacggaaaacttaccggaaaacgtaccgttggacggtcgtacgacctaaccatctacgttctccg

SEQ ID NO: 396313 - DNA, 568 bp, Homo sapiens
  misc_feature: GZ8MTXP02H5GBG.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatcgtaccggggaaatgtcgctggacaacaatggtaggaatggattaggcacgtccccgtgagaggcctggagtggacgttggaaggtacctattatacgtccaggtcgtatgaagactatgacagtattcgtagtgagtcgtcgtactacacctatccacccgagaccacgtaccgaaagactcgacgtcctaccctcctaaactatacgttctacgtcaccgtaccgacgacacggtcttagtttatttgtacgtcgaaggtaggactacgacttacgtcgtacgactaaccgtcgttacgtaccgtcggtcggtacgaacggtttaccg

SEQ ID NO: 396314 - DNA, 554 bp, Homo sapiens
  misc_feature: GZ8MTXP02F7CY9.21.27.C05.1.454.CMB.2.raw
  modified_base (343)..(343): a, c, t, g, unknown or other
  modified_base (354)..(354): a, c, t, g, unknown or other
  modified_base (506)..(506): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtggaattggattaggcagtccccgtgagagccttgagtggcttggaaggctattatacgtccagtgtatgaanactatgacagnttctgtgagtcggtacgtctcacatccaccccagacacgtaccaagaactcagtcctccctaccaacctaaattcgtctcgtacacctacccgacacaccggtctagtttagttttgactacgtaagagaacgatccaactagttccggtanaaccgttacctaccttagacccttccggtagggaccgttaaacggggg

SEQ ID NO: 396315 - DNA, 647 bp, Homo sapiens
  misc_feature: GZ8MTXP02HJNGE.21.27.C05.1.454.CMB.2.raw
  modified_base (200)..(200): a, c, t, g, unknown or other
  modified_base (290)..(290): a, c, t, g, unknown or other
  modified_base (301)..(301): a, c, t, g, unknown or other
  modified_base (384)..(384): a, c, t, g, unknown or other
  modified_base (428)..(428): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggcctcccaggcctccnctatttaccgngcatcccacgacggcccacgtggtcgtcccagacgtaggttccaggtggcggtggtagtttggggactaggttacgtttttcnccttaccacctatcgacgcccgaccctacgagtagtagaaagtntgttagacttagttttattcgtcgtacctaagtactaaagttaattaaacgttaacgtggtacctaggtccggttacggtaccggtttccgggacccgtaaccgggggtacccgtaaaaggggttacgggaaaaacttaaccggaaaaaccggtaacgttacggttacggaccgtaacggaccgtaaccgtacttacgttcgttacctttaccgtaccg

SEQ ID NO: 396316 - DNA, 654 bp, Homo sapiens
  misc_feature: GZ8MTXP02JUV2E.21.27.C05.1.454.CMB.2.raw
  modified_base (537)..(537): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccttgctgggcctcccatggggtgtcctgtcacagatcaaactacagcagtctggtccaggactggtgaggccctcgcacgtaccctttcactcacctgtgacatcgtaccggggaaatgcgcgtggacaactaagtggtaggtaattggtaagttaggctaccgtccccggtagaggtacggtccgttggaggtggtcgttagggaacggtaccttattactaccgtcccaggtcgtagtagaagtactagtgacagtagttctaggtgacgtcggtcgtctccgaacctactacccacccagaccacgtaccaaagactcgacgtccctaccctaccaccttaatcgtctacgtacctaccgtcccgaacgaccgacggtcttacggttttatttacgngtaaccgtaaggtacggtactccgaaacgttacgttccgggtaacttaccctaacccgttaccgttacggtaccccgttccgggtaccggggtacccgtaacggggttttaacccgg

SEQ ID NO: 396317 - DNA, 656 bp, Homo sapiens
  misc_feature: GZ8MTXP02JFICW.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagtaccctttcactcacctgtgacatcgtaccggggaaatgtacgctggacaacagtggtgaattggataggcagtccccgtgagaggtcctgagtggcttggaaggtacctatatacgtccaggtcgtatgaagtactagtgactagattcgtgtggagtcggtcgtctaccgaccatacccaaccccagaccaccgtaccaagaactcgtaacggtccctaccccttaccaaacccttaaacgttcgtaccgtacgttaccctaccgttaccccgaacgaaccggtaccggtacttaaccgtttttagttttcgtacgtaccgtaaaagggtacgggtaaactacgtaacgtacgtttaccggtaggtaacccgttaaccttacccgttacggtacccgttaccgggtaccggggtaccggtacggggtttaaacccgg

SEQ ID NO: 396318 - DNA, 706 bp, Homo sapiens
  misc_feature: GZ8MTXP02HZYK9.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctctgccaccgcagtcagtctatcgctgacttggttacgccgtggtaccagacaagaaatcgtcggaccacggcctacccgacggtccttccgtctacgtttaccgcgacctacgtcccaaccgacggaccctacgttcggtccgtacccgaagacgtaggttcccgaggtcgggtacgggtaggttacgtttaggggacgtaggttacgtttttcacctaccgaacctataccgacgcccgtaccctaacgaggtagtagaaagtagttgttacgtacgttaagtttttacttcgtacgacctaagtactaaaattaattaaacgttacgtcggtccgttaggtacccggttcggttaacccggttccggaccccggtaaccggggtaaaccgtaaaggggtaacggtaaaacgtaaccgtaaaaccggtacgttacggtacggtaccgtaacggaccaaccgtacttccgttacgtttaccttacctacg

SEQ ID NO: 396319 - DNA, 537 bp, Homo sapiens
  misc_feature: GZ8MTXP02H7BBG.21.27.C05.1.454.CMB.2.raw
  modified_base (400)..(400): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggttggaatggattaggcagtcccgtgagaggccttgagtggcttggaaggacctatatacgtcccagtggtatgaagactatgcagattctgtgagcggtcgtctcaccatcacccagacacgtacaagancagtctccctcactaatgtctcgtcacctcccgacgaccacggctacgtttattttgtcgtacagaggtactacgactacgtcggttcgacctaaccgtccgttacgaccttccgtcggggacctacgggttaaccg

SEQ ID NO: 396320 - DNA, 618 bp, Homo sapiens
  misc_feature: GZ8MTXP02FSW4J.21.27.C05.1.454.CMB.2.raw
  modified_base (315)..(315): a, c, t, g, unknown or other
  modified_base (396)..(396): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggggacccgcccaccctctcctgcacagccagtcagtctatcgctgacgttggtacgcctggtaccagacaagaaatcgtcggccaggcctcccgagtcctcctctactttaccgtnacactccacgtacggcctacgtggtcgccagacgtacggttcaggtgggtcggtggtagttgggactaggttacgttttcncctaccacctatccgacgcccgtaccctacgagtaggtagaagtgttgttagtacttagtttacttcgtcgaccagtactaaattaattaacttaccgtcggtcctcggtccggttaccggtaccggttccggacccggtaaccggggaaccgtaaagggtacggtaaaactacgaaaacgtacgtggtacggcgtacgactacctactcgtcgttacctcg

SEQ ID NO: 396321 - DNA, 632 bp, Homo sapiens
  misc_feature: GZ8MTXP02G620Y.21.27.C05.1.454.CMB.2.raw
  modified_base (200)..(200): a, c, t, g, unknown or other
  modified_base (303)..(303): a, c, t, g, unknown or other
  modified_base (379)..(379): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagccgtggtaccagcagaaatctggccaggcctccccgaggcctcctcattttaccgngcactccaccgacgggcccacgtggtcgtacccagactaggttccaggtggcggtggagtttgggactgtgtttcnctcaccatcagccgacctacgagtagtagaagtattggttgacttagtttacttcgtacggcctaagtactaaattaacttaaagtttaccgtcggtcctagtccggttaccggtaaccggtttcccgggacccgtaacggggtaaccgaaaggggttaacggaaaacgttaccggaaaacggtaaacgttcggtaacgggtccgtaacgtaccgaaaccgtacttcggttacgtttcctttaccgttacccg

SEQ ID NO: 396322 - DNA, 509 bp, Homo sapiens
  misc_feature: GZ8MTXP02FR7BL.21.27.C05.1.454.CMB.2.raw
  modified_base (202)..(202): a, c, t, g, unknown or other
  modified_base (298)..(298): a, c, t, g, unknown or other
  modified_base (329)..(329): a, c, t, g, unknown or other
  modified_base (368)..(368): a, c, t, g, unknown or other
  modified_base (386)..(386): a, c, t, g, unknown or other
  modified_base (415)..(415): a, c, t, g, unknown or other
  modified_base (501)..(501): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggctcccaggctcctcatttaccgncatcccaccagggccactggtctcccagacnggttcagtgggcggtggatttggggactagtagttttcnctcacatcagcgccctanagagtgaagattgttgctagtttatttcngccagcaattaattaattacgtggcctgcgtcgtacgtcggacgacgggacaaggtacgaaatcaaacgactggtgcgtgacactntctctctc

SEQ ID NO: 396323 - DNA, 681 bp, Homo sapiens
  misc_feature: GZ8MTXP02F7IWN.21.27.C05.1.454.CMB.2.raw
  modified_base (216)..(216): a, c, t, g, unknown or other
  modified_base (313)..(313): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacccgccacctctccngcacagccagtcagtctatcgctgacttggtacgccgtggtaccagacaagaaatcgcggaccgaggcctcccgaggccttcctactactttaccgngaccactcccaccgacgggccctacgtcggtactacccgagtacgtacggttcgaggtcgggcgggttggtagtttcggggactaggttacgttttcctcctacacctatccgacgtcccgtaccctaagaagtagtagaaagtagttggttacgtacttaagttttactttcgtacgtaccctaagtactaaattaaacgttaaacgttaccgtacggtacccttggtaccggtaccggtaaccggttcccgggacccgtaaccggggaaaccgtaaagggtaacggtaaaactaaccgtaaaaccgtaacgtaggttacggaaccgtacggaccctaaccgtacttaccgttacgttccttaaccg

SEQ ID NO: 396324 - DNA, 646 bp, Homo sapiens
  misc_feature: GZ8MTXP02GSAY4.21.27.C05.1.454.CMB.2.raw
  modified_base (205)..(205): a, c, t, g, unknown or other
  modified_base (317)..(317): a, c, t, g, unknown or other
  modified_base (408)..(408): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggggacnccgccaccctctcctgcacagccagtcagtctatcgctgactggttacgccgtaggaccagacaagaaatcgtggaccaggcctcccgaggtcctcctactacgtttaccgngacactcccgaaccgacgggtaccacgttggtccgtacccgaaggacgtacggttacaggtggcggtagtagtttgggactagtcgtttcnctaccactatcacgccgaccctagagtagtagaagtagttgttacgacttagttttacttcgtacgtacgtacgtactaaattaaattaaacttaacgtacggtaccgtacgtacggtacggtaccggtaccggtaccggtaaccgggtaacggtaaacgggtaaacggtaaaacgtaaacgtaaaacgtaaacgtacggtacggtaacgtacgacactactacgtacgttacttacg

SEQ ID NO: 396325 - DNA, 561 bp, Homo sapiens
  misc_feature: GZ8MTXP02HE87N.21.27.C05.1.454.CMB.2.raw
  modified_base (202)..(202): a, c, t, g, unknown or other
  modified_base (298)..(298): a, c, t, g, unknown or other
  modified_base (367)..(367): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggctccaggctcctcatttaccgncatccacagggccatggcgtcccagacaggttcaggtggcgggtgagtttggggactaggtagttttcnctcaccattcagccgaccctagagagtagaagatgttgcgttagtttatttcgcgtaccagtactaaaattataaatttcggagtccctaggtccgtaccggtacggttccggacccgacggggaaccgtaagggtaacggaaacttaacgaaaacggtactaggtacggcctagaccactatcctgttactcg

SEQ ID NO: 396326 - DNA, 631 bp, Homo sapiens
  misc_feature: GZ8MTXP02GYZ7X.21.27.C05.1.454.CMB.2.raw
  modified_base (388)..(388): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgacggccctcgcacgtaccctttcactcacctgtgacatcgtaccggggaaatgtcgctggacaacaagtgggttggaattggaattagggcctacggtccccggtagacggacggtccttggagtggcgttagggaaggtacctattactacggtccagtggtatagaagactagtgactagnttactggtgagtcggtcgtctacaccgtactccaccccagacacgtaccaagaactcgacgtcctacctacactatcgtctacgtccactccgacgacgacggtcttaagttttactttggacgaccgtaaaggtacgggtactacgtaactacggtttaccggtactaacccttaaccgtttccccgttaggtaacccgttccgggtacgggggtacccgttaaaacgggggtttaacccgg

SEQ ID NO: 396327 - DNA, 632 bp, Homo sapiens
  misc_feature: GZ8MTXP02G7GQK.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccatggggtgtcctgtcacagatcaaactacagcagtctggtccaggactggtgacggccctggcacgtaccctttcactcacctgtacgactagtcgtaccggggaaatgtcgcgtggacaaacgtaagtggttaggaattggaattaggctacgtccccgtagaggtacggccttggagtggtcgttaggaacgtacctattactaccgtccaggtgtaagtagaaagtctaatgactagtattcgtaggtgacgtcgggtactctaccaccatacccacccgagacaccgtacaaagtactacgacgtcctacctaccaaccttaatcgtactcgtccaaccgacccgagacgacggtacttaggttttatttcggacgtaacgaaaggtacggtacttacgaaaccgttcgttaccggttcaaaccgttccgttacctttacgacccgttcggacgggtacccggtaaaggtttacccgg

SEQ ID NO: 396328 - DNA, 561 bp, Homo sapiens
  misc_feature: GZ8MTXP02I9E0S.21.27.C05.1.454.CMB.2.raw
  modified_base (203)..(203): a, c, t, g, unknown or other
  modified_base (301)..(301): a, c, t, g, unknown or other
  modified_base (335)..(335): a, c, t, g, unknown or other
  modified_base (372)..(372): a, c, t, g, unknown or other
  modified_base (390)..(390): a, c, t, g, unknown or other
  modified_base (399)..(399): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggctcccaggcctcctctatttaccgngcatccaccgagggcccactggtctcccagaccnggttcaggtggcggtggatttgggacagtagttttcnctcacatcagcgccctanagagtgaanatgttgctagtttatttctgccagactaattattaaattacgtggtaccctggccgtacggtacgttccggaccgaccgggaccgtaaaggtacggaaaacttaacgaaaacgtaacgtaggttacggaacgtacggaccacctatccgttcgttactttac

SEQ ID NO: 396329 - DNA, 686 bp, Homo sapiens
  misc_feature: GZ8MTXP02JMT3Q.21.27.C05.1.454.CMB.2.raw
  modified_base (204)..(204): a, c, t, g, unknown or other
  modified_base (328)..(328): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacnccgcccaccctctcctgccacacgccagtcagtctatcgctgacgttggttacgccgtggtaccagacaagtaactcgtacggaccacggtcctcccgacggtccttcctactacgtttaccgngacctactacccgaaccggacgggccctacgttcggtccgtacccgagtacgtacggttcgagggtcgggtcgggttaggtacggttacggggacgtaggtttacgtttcctacgtacctaacgtactaccgacgcccgtacccgtaagacggtagtagaagtacgttggttacgtactttacgtttactttcgacgtacctagtaacttaaattaacgttaaacttacgtacggtacgttcggtacgttaccggtaccggttaccggacccggtaaacgggacgtaaagggtaacggaaaactaacggaaaacgtacgtcggtacgaacgtacgactacgtacgtacttcgtactac

SEQ ID NO: 396330 - DNA, 607 bp, Homo sapiens
  misc_feature: GZ8MTXP02FL737.21.27.C05.1.454.CMB.2.raw
  modified_base (200)..(200): a, c, t, g, unknown or other
  modified_base (386)..(386): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggcctcccaggcctcctcatttacccgtgctactcccaccgaggggcccacgtgggtcgtccccagacctaggttccaggtgggcggtggagtttggggactggtacgttttcnctcaccatcgagcccgccctacagagtagaagtatgttcgtcttagttttattctgaccagtactaaattattaaacttacgtggtaccctggtcgtacgtaccggtttccggacccggacggggtaacccgtaaaggggtacggtaaaacgtaccgaaaaccggtaacgtacgggtacggactaacggaccaaccgtactcgttacgtacctttcgtacc

SEQ ID NO: 396331 - DNA, 572 bp, Homo sapiens
  misc_feature: GZ8MTXP02G3KLL.21.27.C05.1.454.CMB.2.raw
  modified_base (160)..(160): a, c, t, g, unknown or other
  modified_base (223)..(223): a, c, t, g, unknown or other
  modified_base (327)..(327): a, c, t, g, unknown or other
  modified_base (360)..(360): a, c, t, g, unknown or other
  modified_base (473)..(473): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgaggccctgcagaccctttnactcacctgtgacatcgtaccggggaaatgtcgctgcacaatggttggaattggattaggcagtccccgtgagaggccttgagtggcttggaaggtcctattanacgtcccagtggtatgaagactatgcagattcngtgagcgtcgtctcaccatccacccagacaccgtacaagactcaacggtcctacccctacaccctaagtcgtactgtccacctcccgaacacgacggtacttagtttatttgngtacgtaaggaggtactacgtaactacgttcggtataacccgttaacccgttccgttacgacccgtttcccggtaggggacccgtacggggtttaaccg

SEQ ID NO: 396332 - DNA, 607 bp, Homo sapiens
  misc_feature: GZ8MTXP02GVFLU.21.27.C05.1.454.CMB.2.raw
  modified_base (203)..(203): a, c, t, g, unknown or other
  modified_base (250)..(250): a, c, t, g, unknown or other
  modified_base (270)..(270): a, c, t, g, unknown or other
  modified_base (298)..(298): a, c, t, g, unknown or other
  modified_base (372)..(372): a, c, t, g, unknown or other
  modified_base (391)..(391): a, c, t, g, unknown or other
  modified_base (421)..(421): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatcnggccaggctccagctcctcatttaccgngcactccaccgagggcccagtggtcgtccccagactaggttcaggtggcggtggatttgggactagtagtttcnctcacatcagccgccctanagagtgaagatgttgcttagtttatttcgngacctagtactaattaattaaattacgtggtaccgtgtccgttacggtaccgtttccgggacccgtaacggggacccgaaaggggttacggaaaaacgttacccgaaaaacggtaaaccgttgggtaacggtaaccgttacgggtacccaaccctaagttaccgtttcggtttacccttttaaccg

SEQ ID NO: 396333 - DNA, 596 bp, Homo sapiens
  misc_feature: GZ8MTXP02JSQS4.21.27.C05.1.454.CMB.2.raw
  modified_base (199)..(199): a, c, t, g, unknown or other
  modified_base (380)..(380): a, c, t, g, unknown or other
  modified_base (404)..(404): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatctggccaggcctcccgaggcctcctctatttacccgtgcatcccaccgagggcccacgtggtctcccagacaggttccaggtgggcggtggtagtttggggactggtacgttttcncttcacctatccagccgccctaanagagtagaagtatggttgacgttagttttacttcgtagcccaagactaaattattaaactttactcgggtccttggccgttcgtacggtttcccgggaccgaaccggggtaaccaaaggggtacgaaaacgtccgaaaacgtacgtggtacggcttaacggacctaccgtacttcgtacgtcctttacgtac

SEQ ID NO: 396334 - DNA, 562 bp, Homo sapiens
  misc_feature: GZ8MTXP02IYV5V.21.27.C05.1.454.CMB.2.raw
  modified_base (203)..(203): a, c, t, g, unknown or other
  modified_base (213)..(213): a, c, t, g, unknown or other
  modified_base (302)..(302): a, c, t, g, unknown or other
  modified_base (374)..(374): a, c, t, g, unknown or other
  modified_base (392)..(392): a, c, t, g, unknown or other
  modified_base (402)..(402): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctntcctgcacagccagtcagtctatcgctgactggttagcctggtaccagcagaaatctggccaggctcccaggcttcctctatttaccgngcatcccaccacgggccacgtcggtcgtcccagacaggttcaggtggcggtgagtttgggctagtagtttcnctcacatcagcgccctanagagtgaagntagttgctagtttatttcgtgtccagtactaattataaacttacgtggccttggcgttcgtaacggttccggaccgtacggggaaccaaaggggtcggtaaaacgtaccaaacgtaaacgtggtcggcgttacggactacctagtcctacgttctttacg

SEQ ID NO: 396335 - DNA, 544 bp, Homo sapiens
  misc_feature: GZ8MTXP02ICG4Y.21.27.C05.1.454.CMB.2.raw
  modified_base (308)..(308): a, c, t, g, unknown or other
  modified_base (449)..(449): a, c, t, g, unknown or other
  modified_base (454)..(454): a, c, t, g, unknown or other
  modified_base (464)..(464): a, c, t, g, unknown or other
  modified_base (481)..(481): a, c, t, g, unknown or other
  modified_base (488)..(488): a, c, t, g, unknown or other
  modified_base (506)..(506): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtcctccttcctcatcttcctgcccgtgctgggcctcccatggggtgtcctgtcacagatcaaactacagcagtctggtccaggactggtgacggccctcgcagaccctttcactcacctgtgactatcgtaccggggaaatgtacgctggcaacatggttaggaattggattaggctacgtccccggtgaggnggccttggagtggcttagggaaggtaccttatactacgtacccgtagtggtactagaagactatgtacagtattcgtgtgagtcggtacgtctacaccctatccacccagacacgtacaaagatcacgtctaccacactangtctntcactccganacaggctagttatttgntacgagnggactcgactcgtacgtnaactccgttctacgactaccgtcgggactacggtaccg

SEQ ID NO: 396336 - DNA, 557 bp, Homo sapiens
  misc_feature: GZ8MTXP02IDZAQ.21.27.C05.1.454.CMB.2.raw
  modified_base (487)..(487): a, c, t, g, unknown or other
  modified_base (507)..(507): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgtaccctttcactcacctgtgacatcgtaccggggaaatgtcgctggcaacaatggtggaattggattaggcagtccccgtgagagcctgagtggcttggaagacctattatacgtcccagtcgtatgaagactaatgcagtattctggtcgagtcggtcgtctcacccgtatccacccagaacacgtaccaagaactcaggtcctccgtaccacctaatcgtctacgcactcccgaacgacacgcttatttacgttttagcgacgaaggnggtaattcgactactcggtntaacctaacctccgttacgtacttccgtacgggtaccacgggtttaaccg

SEQ ID NO: 396337 - DNA, 569 bp, Homo sapiens
  misc_feature: GZ8MTXP02IHCII.21.27.C05.1.454.CMB.2.raw
  modified_base (353)..(353): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacaatggtgaattggattaggcagtccccgtgagaggccttgagtggcttggaagacctattatacgtccagtggtatgaagactatgcagnttctgtgagtcggtcgtctcaccatccaccccagacacgtacccaaagaactcaggtcctccctaccaccctaatcgtcctagtccacctccccgacgaccacggtctacgtttattttgtacgtacgaaggtagggacttcgactacttccggtagtaccttaaccctaccgtttcgaccgttccgtacgggggtccctaagggggtttaacccg

SEQ ID NO: 396338 - DNA, 562 bp, Homo sapiens
  misc_feature: GZ8MTXP02JR9PM.21.27.C05.1.454.CMB.2.raw
  modified_base (357)..(357): a, c, t, g, unknown or other
  modified_base (375)..(375): a, c, t, g, unknown or other
  modified_base (400)..(400): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtcgacatccgtaccggggaaatgtcgctggcaacatggtgaatggatagcacgtccgtgagacgctgagtggcgtaggagacctattatacgtccaggtgtatagaagtactatgacagtnttctgtgagcgtcgtacncacactccacccagacacgtacaanactcgacgtcctccgtacactaagtctctgtccacgtacccgacgtaccacggtcttaagtttatttgcgaacgtaggaggtactacaacgttacgttcggtactacccgttaaccgttcgttacgtaccgtaccggtcggggaccgtaacggggtttcccg

SEQ ID NO: 396339 - DNA, 584 bp, Homo sapiens
  misc_feature: GZ8MTXP02FU7FG.21.27.C05.1.454.CMB.2.raw
  modified_base (202)..(202): a, c, t, g, unknown or other
  modified_base (298)..(298): a, c, t, g, unknown or other
  modified_base (374)..(374): a, c, t, g, unknown or other
  modified_base (393)..(393): a, c, t, g, unknown or other
  modified_base (403)..(403): a, c, t, g, unknown or other
  modified_base (421)..(421): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggctcccaggctcctcatttaccgncatcccaccaggggcccacgtggtcgtcccagaccaggttcaggtggcggtggatttggggactaggtagttttcnctcacatcagccgccctanagagtgaagntgttgctagtttattctncctaagctaaattattaaacttacgtggtacctggtaccgtaccggtacgttcgggacccaacgggggtaaccctaaaggggtacggaaaaacttccggaaaaacgtaccgtaggttagggaaccttacggacctacccgtagtttcctacggttctttaccg

SEQ ID NO: 396340 - DNA, 599 bp, Homo sapiens
  misc_feature: GZ8MTXP02HRP8Q.21.27.C05.1.454.CMB.2.raw
  modified_base (159)..(159): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtntcctgtcacagatcaaactacagcagtctggtccaggactggtgacggccctcgcagtaccctttcactcacctgtgacatcgtaccggggaaatgtcgctggacaacaagtgggttaggaattggattaggcacgtccccgtgaggaggtcctggagtggcgttggaaggacctattactacgtccaggtgtatagaaagactagtgacagtattcgtagtgagtcgtcgtctcaccactccaccctagacacgtaccaaagtaactcgacgtcctaccctaccaccttaatcgtctacgtccaccgtcccgaacgacgacgtacttagttttatttcgacgtaccaaaggtacggtaactacgtaaacgtcgttacggtacgtaccttaaccgtccgttacgtacgtccggtaccggggaccgtaacgggtttaaccg

SEQ ID NO: 396341 - DNA, 768 bp, Homo sapiens
  misc_feature: GZ8MTXP02GH3C9.21.27.C05.1.454.CMB.2.raw
  modified_base (201)..(201): a, c, t, g, unknown or other
  modified_base (270)..(270): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggtagccgtggtaccagcaagaaatcgnggccacggcctccgaggtcctcctctacgtttaccgtgcctacgtccccgaaccgacggggccctaacggttcggtcgtaccccgaagtaccgtagggtttccgaagggttgggacggggttagggtaacggttttggggaccgtaggtttaacggtttttcctaccgttacccaacctactcccgtaacggtcccgtacccccgtaagaacggtaaggttaggaaaacggtcgtttaggtttacggtactttaacggttttttactttaccgtacggtaccttaaggtaaaccttaaaatttaaacttaaacgtttaccgttcggggtacccttagggttcccggtttaccgggtaacccgggttttcccggggaacccggttaaaacccgggggaacccgtaaaagggggttaaacggtaaaacctaaccggtaaaacgttaaccgtgggttaccggaacttcggaacctaccgtacttcgtttacgtcctttacc

SEQ ID NO: 396342 - DNA, 586 bp, Homo sapiens
  misc_feature: GZ8MTXP02F1XZY.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtacggggaaatgtcgctggacaacaatggtggaattggattaggcagtccccgtcgagaggccttgagtggcgttggaaggacctattatacgtccagtgtatgaagactatgcagattctgtgagcggtacgtctcaccatccacccagacacgtaccaagaactcgacgtcctccctacccaacctaaatcgtctgtaccacctacccgacgacacggtactagtttaattttgtcgtacgaaaggtagggtactactacgtacgtttacggtacgtaacccttaaccgttacccgttcgtaacccgttccggtacggggtacccgtaaggggtttaacccgg

SEQ ID NO: 396343 - DNA, 587 bp, Homo sapiens
  misc_feature: GZ8MTXP02I17FB.21.27.C05.1.454.CMB.2.raw
  modified_base (224)..(224): a, c, t, g, unknown or other
  modified_base (428)..(428): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttnactcacctgtgacatctaccggggaaatgtcgctggcaacaatggtgaattggattaggcagtccccgtgagaggccttgagtggcttggaaggacctattatacgtcccagtgtatgaagactatgcagattctgtgagcggtctcgtcaccatccacccagacacgtacaagaatcacgtcctcctaccactaatcgttacncgtctacctcccgaacgacacggctacgtttaatttcgtcgtacaaggtagggactaccgtacttaacgtttacggtacggtaaaccttaacccttcccgtttacggtacccgttaacccgggttcggggtaccccgttaacgggggttttaaacccgg

SEQ ID NO: 396344 - DNA, 621 bp, Homo sapiens
  misc_feature: GZ8MTXP02IE19Q.21.27.C05.1.454.CMB.2.raw
  modified_base (203)..(203): a, c, t, g, unknown or other
  modified_base (250)..(250): a, c, t, g, unknown or other
  modified_base (302)..(302): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttancctggtaccagcagaaatcgtggccaggctcccgaggctcctcatttaccgngccatcccaccgagggccactggtctcccagacacggttcagtggcggtggtagtttggggactaggtagtttttctcctcacactcaacgccgtcccctaacaggacgtagaagtagttggtttgacgttagtttactttctacgaccaagtacctaaaatttattaaacttacgtggtacccttggtaccgttccggttaacgggttcccggacccgtaaccgggggaacccgtaaaggggttacgggtaaaacttacgaaaaccgtaacgttcggtaggctacggacctaccgtatcctttacgttacttttaccg

SEQ ID NO: 396345 - DNA, 828 bp, Homo sapiens
  misc_feature: GZ8MTXP02GK3MQ.21.27.C05.1.454.CMB.2.raw
  modified_base (203)..(203): a, c, t, g, unknown or other
  modified_base (240)..(240): a, c, t, g, unknown or other
  modified_base (303)..(303): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgntgactggtagcctggtaccagcaagaaatctggccaggcctcccaggctcctctatttaccgngacactcccaccgacggggccacgttcggtcgtaccccaaggtaccgtaagggtttccgagggttcggggccgggtttaggggtaacgtttttcgggggacccgttaagggttaaccggtttttttccaccgtttacccaaacccgtagtttcccgaaacgggtcccggtacccccttaaaggaacggtaaggttaacgggaaaagtacgtttgggtttacggtaccgtttaaagggttttttaacttttccgtcgggtacccctaaaggtacccttaaaaatttaacgttaaaacgtttaaccggttcggtacccgttaggggtccccggttacgggtaacccgggttttacccggggaacccccgggttaaaccgggggaaaacccccggttaaaagggggttaaccgggtaaaaaaccgttacccggtaaaaacccgggttaaaccggttcgggttacgggtaaccgttaccgggtaacctaacccggttaacttccggtttaacggtttccctttaacccg

SEQ ID NO: 396346 - DNA, 675 bp, Homo sapiens
  misc_feature: GZ8MTXP02FMQO3.21.27.C05.1.454.CMB.2.raw
  modified_base (362)..(362): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagaccctttcactcacctgtgacatcgtaccggggaaatgtcgctggacaacaatggttaggaattggattaggcagtccccgtgagaggcctgagtggcttggaagctattatacgtccagtgtatgaagactatgacagtattcnggtagacgtcggtacgtctcaaccgtactacccacccaagacctaccgtaccaaagaactacgacggtaccctaccctacctaaacccgtaaagttcgtccgttacggtacccaccttacccccggaacgtaacccgaccggggtaactttacggtttttaacgtttttacggtacgtaaccgtaaggggtaaaggggtactttaccgaaaccgttacggtttacggtaccggttaaaccgtttaacccttccgtttaacggtaaccccgttccggttacgggggtacccgtaacgggggttttaaacccggg

SEQ ID NO: 396347 - DNA, 629 bp, Homo sapiens
  misc_feature: GZ8MTXP02IWEZI.21.27.C05.1.454.CMB.2.raw
  modified_base (371)..(371): a, c, t, g, unknown or other
  modified_base (385)..(385): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatgggtgtcctgtcacagatcaaactacagcagtctggtccaggactggtgacggccctcgcagaccctttcactcacctgtcgacatcgtaccggggaaatgtcgctggcaacatggtggaattggattaggcacgtccccgtagagaggccttggagtggcgttaggaacgggtaccttagttactacgtcccaggtcggtactgaagctatgacagnttctgtgagcggtntctcacgatccacccagaccacgtaccaaaggatccaacggttcctacccgtaccaaacccttaagtcgttacctcgtaccctacctaccccgaacgtaccgacggtaccttagttttacgtttgtacgacgtaaggaacgggttactacgaacttacggttccgggtaactaacccgtttaacccgttccgtttacgtaacccggttaccgtcgggggtacccgtaacggggttttaacccgg

SEQ ID NO: 396348 - DNA, 755 bp, Homo sapiens
  misc_feature: GZ8MTXP02I0U0Z.21.27.C05.1.454.CMB.2.raw
  modified_base (310)..(310): a, c, t, g, unknown or other
tcagtcgtcgctcgcacgaccggtgctcgatttagacgcgatcgaagggtttgggggcagagcctgctgacttctggctgaccagggcagtcaccggagctccagacaatttctgtctccttcctcatcttcctgcccgtgctgggcctcccagtggggtgtcctgtcacagatcaaactacagcagtctggtccaggactggtgacggccctcgcacgtaccctttcactcacctgtcgacatcgtaccggggaaatcgtcgcgtggacaactagtggttagaattggattaggctacgtcccgtgagnggtccttggagtggtcttagggaagtacctattacgtacgtcccgtaggtcggtatagaacgactatacgacaggttattcgtggtagtaacgggtcgttccgtacgtacctaaccacgttacccaacccccgtagaacccgtaaccgttaccaaaagaacttacgtaccggttcccctaccccctaccgtaaacccttaagttccggttaccttctacccgtacccgttaccccggaaccgtaaccgaccggttacctttaaaggtttttacgttttacgacgtaacgtaaaacgggtacggggtaactaccgtaaacgtttacggtttaccgggttaaacttaaccccgtttaccgttaaccccggtttaacgtacccggtttacccggggtaaccgggggttaccccgtaaaacggggggttttacccgtttttaaccccgg

SEQ ID NO: 396349 - DNA, 572 bp, Homo sapiens
  misc_feature: GZ8MTXP02HXGC0.21.27.C05.1.454.CMB.2.raw
  modified_base (484)..(484): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtacggggaaatgtcgctggcaacaatggttggaattggattaggcagtccccgtgagaggcctgagtggcttggaaggacctattatacgtccagtggtatgaagactatgcagattctgtgagcggtcgtctcaccatccacccagaccacgtaccaaagaactcaaggtcctccctaccaaccctaaatcgtactgtacacctcccgacgaccacggctagtttatttgtagtcgaaaggngggaactcgaactacgttacggtacgaaccttaaccgttaccgtttacgaccttaccggtcgggggtaccctaagggggtttacccgg

SEQ ID NO: 396350 - DNA, 759 bp, Homo sapiens
  misc_feature: GZ8MTXP02FH05Q.21.27.C05.1.454.CMB.2.raw
  modified_base (202)..(202): a, c, t, g, unknown or other
  modified_base (300)..(300): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatctggccaggcctccaggcctcctcactttaccgncatccccaccgacgggcccacgttcgggtctccccagacctacgggtttccagggtcgggcgggttgggtacgttttgggggacctagggttaacgttttttcctaccgttacctaacccgtacttccgaacggtccccggtacccccttaaacgaacgggtaacggttagggaaaacggtaagtttgggtttacggtaccgtttaaagggttttttaactttttaccggtcggtaccctaacggtacctaaaatttaaacgtttaaaactttaccgttacgggggtaccccttagggtcccggttaccgggtaaccgggttttccccggggaaccccggtaaaccgggggtaaacccgtaaagggggttaacggaaaaacgttaccggaaaaaccggtaaaccgtgggttacgggaacgttacggaacctacccgtattccgttacgttcctttaccg

SEQ ID NO: 396351 - DNA, 586 bp, Homo sapiens
  misc_feature: GZ8MTXP02GOLLC.21.27.C05.1.454.CMB.2.raw
  modified_base (203)..(203): a, c, t, g, unknown or other
  modified_base (303)..(303): a, c, t, g, unknown or other
  modified_base (371)..(371): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctcccgaggcctcctctatttaccgngcactcccaccgacgggccacgtggtctccagacaggttcagtggcggtgatttgggctagtatttcnctcactatcagccgccctacgagagtgaagtattgtgtcttagttttacttcgtcgtacctagtactaaattacttaaattacgtcggtctcggtcgtcgtaacgggttccggaccgtaacggggaacctaaaggggtacgaaaacgttaccgaaaaacggtaacgtggtaggtaaccgttacggacctaaacctactcgttacgttctttaccg

SEQ ID NO: 396352 - DNA, 758 bp, Homo sapiens
  misc_feature: GZ8MTXP02FMMD4.21.27.C05.1.454.CMB.2.raw
  modified_base (203)..(203): a, c, t, g, unknown or other
  modified_base (318)..(318): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggganccgccaccctctcctgcacagccagtcagtctatcgctgactggttagcctggtaccagcaagaaatcgtggcccaggcctccccgaggtcccttccctactaattttacccggngacctactccccgaaccggacgggccctacggttcggtccgtacccgaggtacgtaccgggttacgagggttcggggtcggggttaggtaacggtttacggggactagggttacgtttttaccaccgtacctaaccgtactccgacgtcccgtacccgtaagaaggtaaggtaagaaaggtagtttagttacgttacgtttaagttttactttacgtcgtaacctagtaacttaaaagtttaaacgtttaacgtttaccgtcggtaccgttcggtacccggttacggttaacccggttacccgggaacccggtaaacccggggtaaaccggtaaaacggggtaaacggtaaaacctaaaccggtaaaaaccggttacgttacggtacggtaaccgtacggaaccctaaccgttacgttacctttacgtttacctttaccg

SEQ ID NO: 396353 - DNA, 635 bp, Homo sapiens
  misc_feature: GZ8MTXP02HT6Y0.21.27.C05.1.454.CMB.2.raw
  modified_base (203)..(203): a, c, t, g, unknown or other
  modified_base (480)..(480): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcaagaaatctggccaggcctcccgaggcctcctcatttaccggcatcccaccagggccagtggtctcccagactaggttcaggtgggcggtaggagtttggggactaggtagttttcctcgtaccactattccgacgccgtaccctaacgagtacggtagaaagtattgttagacttagtttactttcgtgaccaagtactaaattacttaaattacgnggtaccctaggccggttacggtaccggtttcggaccccggaacggggtaacccgtaaaggggtacgtaaaaacgttaaccgaaaaccggtaaccgttggtacgggtaaccttcggaaccctacccgtaagttccgttacggtttaccctttaccg

SEQ ID NO: 396354 - DNA, 589 bp, Homo sapiens
  misc_feature: GZ8MTXP02G77TB.21.27.C05.1.454.CMB.2.raw
  modified_base (222)..(222): a, c, t, g, unknown or other
  modified_base (379)..(379): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggcctgcagaccctttnactcacctgtgacatcgtaccggggaaatgtacgctggcaacaagtggtagaattggattaggcagtccccgtgagaggctgagtggctggaaggacctatactacgtccaggtgtactagaagtactatgacagtattcgtgtgagcgtgctcacntcacccagacacgtacaagactcacgtctcccgtacctacctaatcgttctcgtaccaccgttcccgacgaccgtacggtccttaagtttacgtttttgacgtacgtaaaggtagggaacttacgaacgttacgttccggtacgttaacctaaccgttccgttacgtaccgttacccggtacggggtacccgtaagggggtttaacccgg

SEQ ID NO: 396355 - DNA, 594 bp, Homo sapiens
  misc_feature: GZ8MTXP02HCW1D.21.27.C05.1.454.CMB.2.raw
  modified_base (304)..(304): a, c, t, g, unknown or other
  modified_base (343)..(343): a, c, t, g, unknown or other
tcagtcgtcgctcgcacgaccggtgctcgatttagacgcgatcgaagggtttgggggcagagcctgctgacttctggctgaccagggcagtcaccggagctccagacaatttctgtctccttcctcatcttcctgcccgtgctgggcctcccatggggtgtcctgtcacagatacaaactacagcagtctggtccaggactggtgacggccctcgcacgtacccttcactcacctgtgacatcgtacggggaaatgtcgctggcaacatggtgatggatagcagtcccgtgagagtctgagtgntaggaagtactattatacgtccagtggtatgaagtactntgacagtattcgtgtgagtcgtacgtcacaccactaccacccagaccgacgtaccaaagactctacggtccctacccgtacctaaccgttatcggtcttacgtccaacccgtcccgaacgaccgacggtacttacgtttttcgttttcgagtaccgtaaaaggtcgggtaatccgtaacgtagttaccggactaccttacctcgttacgtaccgttccggtacgggaccgtacggggtttaaactttccgg

SEQ ID NO: 396356 - DNA, 690 bp, Homo sapiens
  misc_feature: GZ8MTXP02HIBT0.21.27.C05.1.454.CMB.2.raw
  modified_base (202)..(202): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccacctgtctgtgtctccgaggggggacnccgccacctctctgcacacgccagtcagtctagtcgctgacgttggttacgccgtacggtaccagacaagaaactcgtcggaccaggcctcccgaggtcctcctactactttaccgcgactactcccgaccgacgggcctacgtcggtaccgtacccgaagacgtacggttacgagggtcgggcgggttaggtaggtttacggggactaggttacgtttttcctcctacctaacctatcgacgcccgtaccctaagaggagtaagaagtagttgttagtacgtttagttttacttcgtacgtaccgtaagtaactaaaagttaattaaactttacgtacggtaccgttacggccggttaccggttaccggttaccgggtacccggtaaaccggggtaaccgtaaagggtaaacggaaaacgtaaaccgaaaaacgtacgtaggtacggtaaccgtacggacctacctattccgtacgtttaccttacg

SEQ ID NO: 396357 - DNA, 563 bp, Homo sapiens
  misc_feature: GZ8MTXP02JPT93.21.27.C05.1.454.CMB.2.raw
  modified_base (354)..(354): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtccggggaaaatgtcgctggcaacaatggtggaattggattaggcagtccccgtgagaggcctgagtggcttggaaggacctattatacgtccagtgtatgagactatgcagnttctgtgagcggtcgtctcaccgatccacccagacacgtcaagatcagtctccctaccacctaaatcgtactgtccacgtcccgacacgacggtctacgtttattttgcgtacaagagggtaacttcgaactacgttccgggtactacccttaaccctccgtttacggacccttccggttacggggaccgtaacggggtttaaacccgg

SEQ ID NO: 396358 - DNA, 566 bp, Homo sapiens
  misc_feature: GZ8MTXP02H114J.21.27.C05.1.454.CMB.2.raw
  modified_base (160)..(160): a, c, t, g, unknown or other
  modified_base (354)..(354): a, c, t, g, unknown or other
  modified_base (452)..(452): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgaggcctcgcagaccctttcactcacctgtgacatctaccggggaaaatgtcgctggcaacatggtgaattggattaggcagtcccgtcgagaggccttgagtggcttggaagacctagttatacgtcccagtggtatgaagactatgcanttctgtgagtcggtcgtctcaccatccaccccagaccacgtacccaaagaactcgacgtctccctccacctaaatgttactgtacactcccgacgacncggctacgtttatttgtgtactaaggaggtaactcgaactacgtttacggtacgtaccttaaccgtacccttacgaccttccggtcggggtacccgtacggggtttaaacccgg

SEQ ID NO: 396359 - DNA, 717 bp, Homo sapiens
  misc_feature: GZ8MTXP02FORMU.21.27.C05.1.454.CMB.2.raw
  modified_base (205)..(205): a, c, t, g, unknown or other
  modified_base (221)..(221): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacnccgcccaccctctccngccacacgccagtcagtctatcgctagtacgttggttacgccgtacggtaccagacaagtaaactcgcggccgacggtccctacccgacggtcccttacccttacgttaccgtttaccgtcgtacctacctaccccgaaccggaccgggtacctacggttcggtaccgtaccgaagtacgtacggttcgtagggtcgggtacgggttaggttacggttaggggacttacggtttacggtttttcctaccgtacctaacctactaccgaccgcccgtacccgtacgaggtagtagaagtgttcgttagtagttagtttcttcgtacgtaccgtaagtaactaaattaagttaacttacgtcggtaccgttacggtaccggttaccggtaccggttaccgggaccggtaaccggggaacgtaaagggtaaacgtaaacgtaaacggtaaacgtacgtcggtacgtccgtacgacctaccgtacttcgtacgttctacc

SEQ ID NO: 396360 - DNA, 836 bp, Homo sapiens
  misc_feature: GZ8MTXP02H7R9J.21.27.C05.1.454.CMB.2.raw
  modified_base (202)..(202): a, c, t, g, unknown or other
  modified_base (317)..(317): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgacgttggttacgccgtggtaccagacaagaaactcgtcggccaggcctccccgaggtcctcctctaacgtttaccgnaccactccccaaccgacgggaccctacgtcgggtacctacccgaaagtaccgtacgggtttaccgaggggttcggggaccggggttgggttaacggttttacgggggaccttaaggggtttaccgttttttcccgttaccgtaaccctaacccgtaactttacccgaaaccggcccccggtaaccccccgtttaaacggaaacggggtaacggtttaaacgggaaaaagttcggtttaagggtttcgtaacccgttttaagttttttacgtttaccgttacgggaaccctaaagggttaaaccttaaaaacgtttaaactttaaacgtttaacccggttcgggtcccgttacggggtacccggtacccgggttaccgggtttaccccggggaaacccgtaaccgggggtaacccggtaaaagggtaaacggtaaaacgtaaacccgaaaaccggtaaacgtcgggtacggaacctacggtaacccgaccctaacgtttccgtcgtttaccctttacccg

SEQ ID NO: 396361 - DNA, 791 bp, Homo sapiens
  misc_feature: GZ8MTXP02HDYFU.21.27.C05.1.454.CMB.2.raw
  modified_base (201)..(201): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggganccgccaccctctcctgaccacgacgccagtcagtctacgtcgtctgtacgtggttacgccgtacggtaccagacaaagtaactcgtacggaccgacggtccctaccgacggtcccttacctactttaaccgtttccgacgacctacctaccccgaacgaccggggaccctacggttcggtccgtaccgaaggtaccggtaggttccgaggggttcgggtcggggttaggttacgggtttacggggacgttaggttttaccgttttcctaccgtaccgtaaccgtagttaccgaccggtacccctaaaccccgttaaagagggtaacgttaaagggtaaagtttcggtttaaggttcgttaacgtttaaacgtttttctttaccggacgtaaacctagttaaactaaaactttaggtttaaaacttcgggttccgtcgttcgggtacccggttacgggttaacccgggtccgggaacccgggtaaaacggggtaaccgttaagggggtaaaactaacgtaaaaccgtaaacggttacgtcgggtaacgtaacggttcaaccccgtatacgtttcgttccgtttacttaccg

SEQ ID NO: 396362 - DNA, 741 bp, Homo sapiens
  misc_feature: GZ8MTXP02J4PIL.21.27.C05.1.454.CMB.2.raw
  modified_base (206)..(206): a, c, t, g, unknown or other
  modified_base (222)..(222): a, c, t, g, unknown or other
  modified_base (335)..(335): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagcccaccctgtctgtgtctccggaggtcgggacnccgcccaccctctccngccacagtccagtccagttctatcgctgtacgttggtacgcctggtacccagacaggtaaatccgtggccacggccctccccgaggtcccttcccttactacgttttacccgngccaacctccccgaacccgtacggggtcccgtaccgttcgggtcgtaccccgtacggtaacccgtagggtttcgtcgggtggggttcggggtacgtttagggttcgggtaacgttaggtttccgtttccttcctccctacgacctacgacgcccgtacccgacgacggtagtaggtaagtgttaacggtttgtacgtttagttttacttaacgtttccggttacaccgttacaaacttactaggttaacttaacgttcgtaacccggttggtcccggtccggtaacccgggtcgtaccggggttacccaacgggttaccgggaaccgtaacgtaaacgggttaccgaaaacggtaaccggtaaacgtacgggttactaaccgggtcctaacggtccgtttaacccg

SEQ ID NO: 396363 - DNA, 568 bp, Homo sapiens
  misc_feature: GZ8MTXP02GL4TN.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactcagcagtctggtccaggactggtgaggccctgcagaccctttcactcacctgtgacatctaccggggaaatggtcgctggcaacaatggtaggaatggattaggcagtccccgtgagaggcctggagtggcttggaggacctattatacgtccagtggatgaagactatgcagattctgtgagcggtctcgtcaccatccacccagacacgtcaaagactcgacgtcctaccctccaacctaatcgtctcgtccacctcccgacacgtacgctacgtttagtttcgcgttacaaggtagggtacttaccaacgtacgtttcggtacgtaaccttcccgttaccttacgtaccgttccggtacggggacccgtacgggggtttaaacccg

SEQ ID NO: 396364 - DNA, 534 bp, Homo sapiens
  misc_feature: GZ8MTXP02IKT4X.21.27.C05.1.454.CMB.2.raw
  modified_base (202)..(202): a, c, t, g, unknown or other
  modified_base (268)..(268): a, c, t, g, unknown or other
  modified_base (283)..(283): a, c, t, g, unknown or other
  modified_base (293)..(293): a, c, t, g, unknown or other
  modified_base (363)..(363): a, c, t, g, unknown or other
  modified_base (383)..(383): a, c, t, g, unknown or other
  modified_base (386)..(386): a, c, t, g, unknown or other
  modified_base (392)..(392): a, c, t, g, unknown or other
  modified_base (490)..(490): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgacttggttagctggtaccagcagaatcnggcagctccagctcntatttaccgncatccaccgagggcctacgtggtcgtcccagacaggttccagtggcggtgtagtttgggactgtgtttcnctcacatcagccgaccctanagntagaanttgttgctagtttattcgtcgtccagtactaattaataaactttcgtaggctagtcgttcgtacgttccgggccgacgggtaccaaggtacggtaaanaccgaacgtaacttggacgtctcgacacgtatccgttctactcg

SEQ ID NO: 396365 - DNA, 692 bp, Homo sapiens
  misc_feature: GZ8MTXP02F1RZR.21.27.C05.1.454.CMB.2.raw
  modified_base (203)..(203): a, c, t, g, unknown or other
  modified_base (249)..(249): a, c, t, g, unknown or other
  modified_base (304)..(304): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtancctggtaccagcagaaatcgtggccaggcctcccaggcctcctctactttaccgngcactcccaccgacgggcccacgttggtccgtacccagacgtacggtttcaggtcgggtcgggttggtacgtttaggggactaggttacgtttttcctacctcctaacccgtaattccgaaacgtcccgtaccccgtaacgaaggtacggtaggtaaagtagttaggtttcgtacgtttaaggttttactttcgtacgtaccctaagtaacttaaattaaattaacgtttaaccgtcgggtaccttggtaccggttcggtaaccgggtttccgggaacccggttaaccggggaaccgtaaaggggtacggtaaaacgttaacgaaaaccggtaacgtcggttacggaacttacggacccgtaacgtacttccgttcgttacctttccg

SEQ ID NO: 396366 - DNA, 505 bp, Homo sapiens
  misc_feature: GZ8MTXP02ITJHG.21.27.C05.1.454.CMB.2.raw
  modified_base (199)..(199): a, c, t, g, unknown or other
  modified_base (296)..(296): a, c, t, g, unknown or other
  modified_base (361)..(361): a, c, t, g, unknown or other
  modified_base (370)..(370): a, c, t, g, unknown or other
  modified_base (388)..(388): a, c, t, g, unknown or other
  modified_base (435)..(435): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccaggggggancgccacctctcctgcacagccagtcagtctatcgctgactggttagcctggtaccagcagaaatctggccaggctcccaggcctcctcatttaccgngcatccaccagggcccacgtggtcgtccccagaccaggttcccaggtggcggtggatttgggacngtagtttcnctcaccatcagcgcctanagagtgaagatgttgctagtttattctgcctagctaattatattacngctgcgtcgacgttcgcgacggacaggtagaactacaaacgtactacgtgctgcacatctcgtcttctac

SEQ ID NO: 396367 - DNA, 698 bp, Homo sapiens
  misc_feature: GZ8MTXP02HQ20T.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgacggccctcgcacgtaccctttcactcacctgtcgacatcgaccggggaaatgcgctggcaacaagtggtggaatggattaggcacgtccccgtgagagcctgagtggcttggagtactattatacgtccagtcggtatagaacgactaagtgacgagtattcgtggtagacgtcggttcgtctaccgacctactacccaaccctaagaccctaaccgtaaccaaacggaactaccggtacggttacccctacccccgtaccctaaaccttaaacgttcgtttaccgtacgttacccgaccccgttaccccgaaacccggtacccgtaaccggttaccgtttaagttttacgtttttagacggtaaccgtaaaaggtacggggtaaccttacgtaaaccgtttacgttaccggggtttactaacccttaacccgttcccgttacggtaacccgtccgggtaccggggtaaccggttacgggggtttaacccgg

SEQ ID NO: 396368 - DNA, 600 bp, Homo sapiens
  misc_feature: GZ8MTXP02GMYIU.21.27.C05.1.454.CMB.2.raw
  modified_base (202)..(202): a, c, t, g, unknown or other
  modified_base (306)..(306): a, c, t, g, unknown or other
  modified_base (397)..(397): a, c, t, g, unknown or other
  modified_base (451)..(451): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgacttggttacgcctggtaccagcaagaaatctggccaggcctccgaggcctcctctactttaccgngccactccgaccgacgggccctacgttcggtcgtccccgaggtactacggttcaggtgggcggtggtacgtttgggactagtacgttttcncgtcactatcacgctaccctagagagtagaaagtgtgttgacttagtttcttcncgtaccagtactaattataattacgtaggtcctgtcgtcggtacgttcggaccgtaacgggtaccgtaaagggtacgaaaacgtacgaaaacggtaacgtggtacggtaacgtacggtacctacctacgttcgtcggttacctttaccg

SEQ ID NO: 396369 - DNA, 794 bp, Homo sapiens
  misc_feature: GZ8MTXP02I9DWA.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgcccaccctctcctgccacacgccagtcagtctatcgctgtacgttggttacgccgtacggtaccagacaaagtaactcgacggaccgacggtccctacccgacggtcccttccttacttaaccgtttacccgcgtacctaccgtaccccgaaccggaccgggtccctacggttcgggtaccgtacccgaaggtaccgtacgggttacgtaggggtcggggtacggttaggttacggtttacgggacgttacggtttacgttttcctaccgtacctaacctacgtacccgaccgtacccgtacccgtaacgaacggtacggtaagtaaagtacgttaggttacgtacgtttacgtttactttacgtacgtaccgtaagtaacttaaagttaacgttaaacgttacgtacggtaccgttcgggtacccggttaccggttaccgggtacccgggaacccggtaaaccggggtaaaccggtaaaggggtaaacggtaaaacgtaaaccggtaaaaccggttaacgttacgggtaaccggtaaccgtacgtaacccgtaccgttacgttaccgtttacgtttacctttaccg

SEQ ID NO: 396370 - DNA, 570 bp, Homo sapiens
  misc_feature: GZ8MTXP02GCV8G.21.27.C05.1.454.CMB.2.raw
  modified_base (380)..(380): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgccgtgctgggcctccatggggtgtcctgtcacagatcaaactacagcagtctggtccaggactggtgaggccctcgcagaccctttcactcacctgtgacatcgtaccggggaaatgtcgctggcacaatggtgaattggattaggcagtccccgtgagaggcctgagtggcttggagactattatacgtccagtggtatgaagactatgacagtatctgtgagcggtcgtctcacatcacccanacacgtacaagatcgagtacctcctaccaacctaatcgtctacgtccactaccccgacgacacggtacttagtttacgtttacgtcgtacgtaaaggagggtactacgtaactacgttacgggtctaacctaaccgttcccgttacgtaaccgtccggttacgggggacccgtacggggtttaaacccgg

SEQ ID NO: 396371 - DNA, 586 bp, Homo sapiens
  misc_feature: GZ8MTXP02F23LT.21.27.C05.1.454.CMB.2.raw
  modified_base (222)..(222): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttnactcacctgtgacatctccggggaaatgtcgctggcaacatgtggaatgataggcagtccccgtcgagagccttgagtggcttggaaggacctattatacgtcccagtggtactgaagactatgcagatctgtgagcggtcgtctcaccatccgaccctagaccacgtaccaagtaatcaaggtcctccctacacctaatcgtctgttccactcccgacgacacgggtactacgtttattttgtcgtacgaaaggtagggtactaccgtaactaacgtttaccgggtacgtaaccctaacccgttcccgtttacggtaacccgttcccgtttacgggggacccttaacgggggtttaaacccgg

SEQ ID NO: 396372 - DNA, 617 bp, Homo sapiens
  misc_feature: GZ8MTXP02FG132.21.27.C05.1.454.CMB.2.raw
  modified_base (309)..(309): a, c, t, g, unknown or other
  modified_base (397)..(397): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacccgcccaccctctcctgccacagccagtcagtctatcgctgactggtacgccgtggtaccagacaagaactcgtggccaggcctccgagcctcctctactttaccgncactcccaccgacgggccacgttggtcgcccagtacgtacggttcaggtcgggcggttaggtacgtttgggactaggttacgttttcnctacctacatcacgcccgtaccctagagtagtagaagtagttgttagtcttagtttacttcgtacgacctagtactaaattaataacgttacgtcggtccttcggccggttaccggtaccggttcccggacccggtaacgggaaccgtaaagggtacgaaacgttaaccgaaaacgtacgtaggtacgcgtacgacctaccgtactctcgttaccttacg

SEQ ID NO: 396373 - DNA, 787 bp, Homo sapiens
  misc_feature: GZ8MTXP02HAFSW.21.27.C05.1.454.CMB.2.raw
  modified_base (201)..(201): a, c, t, g, unknown or other
  modified_base (237)..(237): a, c, t, g, unknown or other
  modified_base (302)..(302): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgntgactggttagcctggtaccagcaagaaatctggccaggcctccaggcctcctctactttaccgngaccactacccgaccgacggggccctacgtcggtacgtaccccaggtacctacggggtttacaggttcgggcggggttagggtacggttttaggggacgtaggttacggttttttcctaccgttacctaacccgtaattcccgaaacgggtccccgtacccccttaaacgaacgggtaacggttaacggtaaaacggttaacgtttcggggttttacgtaccgttttaaagggtttttaactttttccgacgggttaaccctaaagggttaaacctaaaatttaaagtttaaaacgtttaccgttacggggttcccttacgggtacccggtttaccggtaaacccgggtttcccgggaacccggtaaaacccggggtaaacccgtaaaaggggtacggtaaaaacgttaccggaaaaaccgtacggttacggttacggaaccttcggaacctaaccgtaacttccgttcgtttacctttaacccg

SEQ ID NO: 396374 - DNA, 665 bp, Homo sapiens
  misc_feature: GZ8MTXP02JUTSQ.21.27.C05.1.454.CMB.2.raw
  modified_base (201)..(201): a, c, t, g, unknown or other
  modified_base (237)..(237): a, c, t, g, unknown or other
  modified_base (311)..(311): a, c, t, g, unknown or other
  modified_base (427)..(427): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccacctctcctgcacagccagtcagtctatcgntagacgtggtacgccgtaggaccagacaagaaatcgcggaccacggcctcccgagccttcctctactttaccgngcctactcccgaaccgacggaccctacgtcggtcctacccgagacgtaggttaccgagggtcgggtcggtaggtagttagggactgttactttcactacactatcacgccacctanagtagtagaagtatgtatacgttagtttacttcgacgactaagtactaaattaacgtttaacgttaccgtcggtccttacggtaccggttccggtaccggttaccgggaacccggtaaaacggggtaaaccgtaaaaggggtaacggtaaaacttaaaccggaaaacggtaacgttacgggtacggtaccgtaacgaaccgtaaaccgtacgttaccgtacgttaccttaccgtaacg

SEQ ID NO: 396375 - DNA, 717 bp, Homo sapiens
  misc_feature: GZ8MTXP02H3DSA.21.27.C05.1.454.CMB.2.raw
  modified_base (204)..(204): a, c, t, g, unknown or other
  modified_base (305)..(305): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgcccaccctctcctgcacagccagtcagtctatcgctgactggttagcctggtaccagcaagaaatctggccaggctcccgaggctcctctatttaccgngaccatcccaccgacgggcccacgtcggtcgtccccgagactaggttcaggtgggcgggttggtagtttcgggacgtaggttacgtttttcctacgtaccaccaattccagcccgtaccctagtaggaagttagaaaagtgttaggtttcgactttaaggtttttactttacgtacggtaccctaaggtaccttaaaagtttattaaaagtttaaccgtcggtacccgtttgggtacccggtttaccggtaaccggggttttcccggggaaccccgtaaaccggggggtaaacccttaaaagggggttaaccggtaaaaacgttaccccgtaaaaaggtaaacgtttcgggtacgggtaaccgttacggaaccctaaccctaacgttccctttaggtaaccccttttacccg

SEQ ID NO: 396376 - DNA, 551 bp, Homo sapiens
  misc_feature: GZ8MTXP02JIN24.21.27.C05.1.454.CMB.2.raw
  modified_base (326)..(326): a, c, t, g, unknown or other
  modified_base (353)..(353): a, c, t, g, unknown or other
  modified_base (396)..(396): a, c, t, g, unknown or other
  modified_base (403)..(403): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtggaattggattaggcagtccccgtgagaggccttgagtggctggagacctattanacgtccagtgtatgaagactatgcagnttctgtgagcggtcgtctcacatccacccagacacgtacagancagtccncctacacctaatcgtctcgtcactccgacgacacgtctaagttttctttgcgtacaagtaggactacgactacgttaccgggtataaccgttaacccgttaccttacgtaccgtacccgtcgggggtaccctaacggggtttaacccg

SEQ ID NO: 396377 - DNA, 584 bp, Homo sapiens
  misc_feature: GZ8MTXP02FRMDE.21.27.C05.1.454.CMB.2.raw
  modified_base (365)..(365): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgacatcgtaccggggaaatgtcgctggcaacaatggttggaattggattaggcagtccccgtgagaggcctgagtggcttggaaggcctattatacgtccagtcggtatgaagactatgcagtattcngtgagcgtcgtctcaccatccacccagacacgtacaagatcgagtctccctaccactaatcgtctcgtaccacctcccgacgaccacggtacttacgtttaagttttgacgtaccaaaggtacgggtactactacgtacgtttacgggtactaaccttaaccgttccgttacgtaccgttacccggtacgggggtacccgtaacggggttttaacccgg

SEQ ID NO: 396378 - DNA, 665 bp, Homo sapiens
  misc_feature: GZ8MTXP02IG925.21.27.C05.1.454.CMB.2.raw
  modified_base (199)..(199): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctcagccacctgtctgtgtctccgagggggancgccaccctctcctgcacagccagtcagtctatcgctgactggttagcctggtaccagcaagaaatctaggccaggcctcccgaggcctcctactacgtttacccgtgacctactacccaaccgacggggccctaacggtcggtaccgtacccgaagacgtacggggtttccaagggtcgggtcgggttaggtaagtttcggggactaggttacgtttttccaccgttacgaccctatccgaacgtcccgacccttaacgagtaaggtagtaaagtagttggttacgtacttagtttttaagtttccgttacggtaccctaagtacctaaaagttaaacttaacttacgtacggtcctaggtccgtaccgtacgttccggaccgtacgggaaacctaaagggacgtaaacgtaacgaaaacgtacgtaggtcgaacgtagacctacgactttctacgtttcttacc

SEQ ID NO: 396379 - DNA, 688 bp, Homo sapiens
  misc_feature: GZ8MTXP02IJFH5.21.27.C05.1.454.CMB.2.raw
  modified_base (202)..(202): a, c, t, g, unknown or other
  modified_base (212)..(212): a, c, t, g, unknown or other
  modified_base (313)..(313): a, c, t, g, unknown or other
  modified_base (439)..(439): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctntcctgcacagccagtcagtctatcgctgactggttagctggtaccagcaagaaatcgtcggccaggcctaccccgaggccttcctctacgttttacccggngaccactccccgaaccgacggggccctaacgtcgggtaccgtaccccaaggtaccgtacgggtttaccgagggttcgggacggggttaggttaggtttcggggacttaggttaacggttttttccncctaccgactatccgaacgtccgaccctaagagtagtagaatagttggttcgtaacgtttagttttacgtttacgtacggtaacctaacgtaactaaagtttaattaaacgtttaccgtcgggtaccctggtacccggttacggtaccggttaccggacccggtaaaacggggtaccgtaaagggttaacgaaaacttaaaccgaaaacgtaacgtggtacgcgtacgacctactagtctcgttacttc

SEQ ID NO: 396380 - DNA, 587 bp, Homo sapiens
  misc_feature: GZ8MTXP02IKA15.21.27.C05.1.454.CMB.2.raw
  modified_base (204)..(204): a, c, t, g, unknown or other
  modified_base (214)..(214): a, c, t, g, unknown or other
  modified_base (250)..(250): a, c, t, g, unknown or other
  modified_base (267)..(267): a, c, t, g, unknown or other
  modified_base (296)..(296): a, c, t, g, unknown or other
  modified_base (372)..(372): a, c, t, g, unknown or other
  modified_base (378)..(378): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctntcctgcacagccagtcagtctatcgctgactggtanctggtacagcagaatcngccaggctccaggctcctctatttaccgngcatcccaccgagggccacgtggtcgtccccagtacaggttcaggtgggcggtggagtttgggactgtagttttcnctcacntcagcgccctacgagagtagaagattgttgctagtttatttctcgacctagtactaattattaaattacgtggtacctgtaccgttcgtaccggttccggaccgaacggggtaccgaaaggggtacggaaaacgttaccgaaaaccgtaaacgttggtacgggtccgttacggaccctaacctactttccgttacgtttacctttaccg

SEQ ID NO: 396381 - DNA, 736 bp, Homo sapiens
  misc_feature: GZ8MTXP02GRJ69.21.27.C05.1.454.CMB.2.raw
  modified_base (201)..(201): a, c, t, g, unknown or other
  modified_base (309)..(309): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggtacgcctggtaccagcaagaaatcgtggccacggcctaccgacggtcctcctctacgtttaccgngactactcccaccgacgggcctacgttcggtcgtaccccaagtaccgtacggttcgaggtcggggtacgggttagggtagttttggggaccgtagggtttaacggtttttcctaccgtaccgtaacctacgttaccgaacggtcccgtaccccttaaacggaaggtacggtaaggtaaacgtacgtttggttacgtacgttaagttttactttccgtacgtaccgtaagtaccttaaaattaattaaacgttaacgttcggtacctttacggtaccggttaccggtaaccgggtttccgggacccggtaaaaccgggggtaaaccgttaaaggggtaaacggtaaaaacttaacggaaaaccgtaaaccgttgggttaccgaacgttcgaaacctaccgtaacttcggtttacgtttcctttaaccg

SEQ ID NO: 396382 - DNA, 598 bp, Homo sapiens
  misc_feature: GZ8MTXP02JO31F.21.27.C05.1.454.CMB.2.raw
  modified_base (224)..(224): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagtaccctttnactcacctgtgacatcgacgggaaatgtcgctggcaacatggtagaatggattaggcagtcccgtgagacgcttgagtggcttggaacgtactattagtaccgtcccagtggtatgaagtactagtgacagtattcgtgtgagtcggtcgtactcgacctagtccacccagacacgtacaagatcgagtcctaccctaccacctaatcgttctcgtacacctcccgacgacacggtcttaggttttacttttgacgtacgtaaggacgggtactaccgtaactacggttaccggtacgtaacccgttaacccgttacccgttacggtacccgttaccgggtaccgggggtacccgtaaggggttttaaccccgg

SEQ ID NO: 396383 - DNA, 727 bp, Homo sapiens
  misc_feature: GZ8MTXP02GNEWU.21.27.C05.1.454.CMB.2.raw
  modified_base (204)..(204): a, c, t, g, unknown or other
  modified_base (313)..(313): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgcccaccctctccctgcacagccagtcagtctatcgctgactggttacgcctggtaccagcaagaaatcgtggccaggcctcccgaggcctccgtctagtttaccgngacactcccaccgacgggccacgtcggtcgtacccagacgtaggttcaggtggcggtggtagtttggggactaggtacgttttcctactcctaccatccgacgtcccgtaccccctaagtaaggtaggttagaaagtgttggtttacggactttaagttttacgtttaccgttacgacccgtaagttacttaaaaacgtttaatttaaaacgtttccgtacggggttacccgttcggtacccggtttaccggaacccgggttttacccggggaaccccggtaaaccgggggtaaaacccgttaaaagggggtaccgggtaaaaaactaccggtaaaaacccggttaggttacgggttaccgggtaacctacggaacccgtacccgtaactttccgttacggtttaccctttacc

SEQ ID NO: 396384 - DNA, 719 bp, Homo sapiens
  misc_feature: GZ8MTXP02JUPDN.21.27.C05.1.454.CMB.2.raw
  modified_base (198)..(198): a, c, t, g, unknown or other
  modified_base (244)..(244): a, c, t, g, unknown or other
  modified_base (407)..(407): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggatgattgtgatgacgcagtctccagccaccctgtctgtgtctccgagggggancgccaccctctcctgcacagccagtcagtctatcgctgactggtancctggtaccagcagaatctggccaggcctcccgaggcctcctcactttaccgtgccatcccaccgagggcccacgttggtcgtaccccagacctaggtttcccgaggttcgggaccgggttggggtagtttttacgggggaacctagggttacgttttttccnccgttaccaacccgtagttccgaacgcccgtaccccctaagaagtacggtaggaaagtagttggtttacgaccgtttaggttttactttccgtacggtaccctaaggaccttaaaattaactttaaacgtttaccgtcgggtacccttcgggtaccgttaccggtaaccggtttcccggaccccggtaacccggggtaaacccgtaaagggggtacggtaaaacgtaaaccggaaaaccggtaacgtacgggttaccggaccgtaacggaccctaacccgtacgttccgtacgtttacccgttcttaacccg

SEQ ID NO: 396385 - DNA, 665 bp, Homo sapiens
  misc_feature: GZ8MTXP02IWDL4.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgaggccctcgcacgtaccctttcactcacctgtgacatacgtaccggggaaatcgtacgcgtggacaacaagtggtaggtaagttggagttaggcacgtccccgtgagacgccttagagtggacgttaggaaggtacctattacgtacgtaccgaggtcgtagtagaaagtactaagtgacgtaagtagttcgtggtacggtacgtccgggtcgtactaccgaacgtacgtaccctaacccgaaggacctaaccgtacaaacggtaacttcgaaacggtcctaccctaccctaacttaactcgttcgtctacctaccgacccgtacgactacggtacttaggttttattacggtacgtacgtaaggtagggtactactaacgtacgtttaccgggacgttaacctttaaccctccgtttacgtacccggtcggtaccgggggtaccgtaacgggtttaaccgg

SEQ ID NO: 396386 - DNA, 537 bp, Homo sapiens
  misc_feature: GZ8MTXP02HRCY8.21.27.C05.1.454.CMB.2.raw
  modified_base (355)..(355): a, c, t, g, unknown or other
  modified_base (470)..(470): a, c, t, g, unknown or other
  modified_base (477)..(477): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggcccttgcagaccctttcactcacctgtgacatctccggggaaaatgtcgctggcaacatggtggaatggattaggcagtccccgtgagaggccttgagtggcttggaagacctattatacgtcccagtggtactgaagactatgcagntttctagtgagtcgtcgtctcaccatccaccctagacacgtaccaagatcaacggtcctccctacccacttaatcgttctgtcactcccgacgactacggctagtttattttagngtcaagnggtactcgtacattcggtatacgtaacctctacgactccgtcgggaccgtagggttaacg

SEQ ID NO: 396387 - DNA, 546 bp, Homo sapiens
  misc_feature: GZ8MTXP02H0S93.21.27.C05.1.454.CMB.2.raw
  modified_base (324)..(324): a, c, t, g, unknown or other
  modified_base (352)..(352): a, c, t, g, unknown or other
  modified_base (375)..(375): a, c, t, g, unknown or other
  modified_base (492)..(492): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggcctcgcagaccctttcactcacctgtgacatcgtaccggggaaatgtcgctggcaacaatggtggaattggattaggcagtccccgtgagagccttgagtggcttggagactattanacgtcccagtgtatgaagactatgcagnttctgtgagcggtcgtctcaccntccacccagacacgtccaaagatcaacggtctccctacacctaatcgtctgtcacctcccgacgacacggctagttttatttgtgtacgtaagtagggactcaacgtagttccggtnaaccttaaccgtccttacggaccttccgtacggggtcctaaggggtttacccgg

SEQ ID NO: 396388 - DNA, 725 bp, Homo sapiens
  misc_feature: GZ8MTXP02FNKJO.21.27.C05.1.454.CMB.2.raw
  modified_base (204)..(204): a, c, t, g, unknown or other
  modified_base (313)..(313): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccacctctcctgccacagccagtcagtctatcgctgacttggttacgccgtggtaccagcaagaaactcgtggccaggcctcccgaggcctcctctactttaccgngacactccaccgacgggcctacgtcggtcgtccgagacgtacggtcaggtcggtcggtggtagtttggggactaggttacgttttcctacctaccaactactaccgacgtcccgtaccctaacgaacggtaaggtaggaaagtagttcggttacgtacgttaagttttactttaccgtacgtaccgtaagtactaaagttaacttaaacgtttaccgtcgggtacccgttacggtaccggttaccggtaaccgggtttacccggggaaccccggtaaaccgggggtaaacccgtaaaacgggggttaaacggtaaaaaccgttaaaccggtaaaaaccggttaacggttacgggttacgggtaaccgtacggaccctaaaccgtacgttccggttacgtttaccgtttaccg

SEQ ID NO: 396389 - DNA, 612 bp, Homo sapiens
  misc_feature: GZ8MTXP02G4MRF.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggactggtgacggccctcgcacgtaccctttcactcacctgtgacatcgtaccggggaaatgtcgctggacaacgaagtggtaggaattggattaggcacgtccccgtagagaggcctgagtggcgttaggaagtacctattactacgtccagtgtatagaagtactatgacagtattcgtgtgagtcggtcgtcctcaacctatacccaacccagaccaaccgtaccaaagactacacgtcctaccctaccaacctaaatcgtctacgtaccaccgtccccgaacgaccgtacgtacttagttttagttttcggacgtaacgaaacggtaggtactacgtaacgtacgttacggtactaacctaacccttcgttacgtaccgtccggtacggggaccgtaacggggtttaaccg

SEQ ID NO: 396390 - DNA, 903 bp, Homo sapiens
  misc_feature: GZ8MTXP02IWVHN.21.27.C05.1.454.CMB.2.raw
  modified_base (202)..(202): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggcncgccaccctctcctgcacacgcctagtcagttctagtcgctggacttggttacgtccgtggtaccagacaagtaatcgtcggccacggcctcccgacggtcctcctacttactttaccgtcgacctactacccgacccgacgggtcctacgttcggtccgtaccccgaaggtaccgtaccggttaccgagggttcggggtcggggtttaggttacggttttacggggacgttaacgggtttacggtttttccctacccgttaccctaacccgtacgttaccgaccggtaccccgtacccccgtaaagaaacgggtaacggttaaggtaaaacggttacggtttacgggtttacgtaaaccgttttaacggtttttaaccgtttttaccgttaccgttaaccccggttaacggttaaactttaaaacgttttaaaccgtttaaaacgtttaacccggtttacggggttacccggtttaccggggtacccgggtttacccggggttaccgggggttttaccccggggaacccgggttaaaacccgggggtaaaacccggttaaaacgggggttaaacggtaaaaaccgttaaacccgggtaaaaacccgggttaaaccgggtttcggggttaaccggggtaaccgttaacccggtaacccgttaacccgttacggtttcccgtttaccggtttaccctttacg

SEQ ID NO: 396391 - DNA, 633 bp, Homo sapiens
  misc_feature: GZ8MTXP02I8SV5.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactgggtgaggccctgcagaccctttcactcacctgtgacatcgtaccggggaaatgtcgctggacacaatggtggaattggattaggcagtccccgtgagaggccttgagtggtcgttggaaggtacctattactacgtccagtggtatgaagtactatgacagtattcgtaggtgagtccgggttcgtcgtaccaccgtatacccacccgaagacacgtaccaaagactcgacgtcctccctaccaccttaatcgttctcggtacctacccgtcccgaacgacctaccggtacttacgttttagttttcgtacgtacgaagggtacgggtacttaccgaaacgttacgtttaccggggtaccttaacccgttaacccgtttcctacggttacccgttccggtacgggggtaccccggttaagggtttaacccgg

SEQ ID NO: 396392 - DNA, 594 bp, Homo sapiens
  misc_feature: GZ8MTXP02G7K5T.21.27.C05.1.454.CMB.2.raw
  modified_base (321)..(321): a, c, t, g, unknown or other
  modified_base (336)..(336): a, c, t, g, unknown or other
  modified_base (344)..(344): a, c, t, g, unknown or other
  modified_base (348)..(348): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagtaccctttcactcacctgtgacatcgtaccggggaaatgtcgctggcaacaatggtgaattggattaggcagtccccgtgagaggctgagtgctggagactattanacgtccagtgatgancatgcagnttcnggtgagtcggtactctacacgatccacccagaccacgtaccaagactcgaacgtcctcccgtacacctaaatcgtactcgtacctaccgtaccccgaacgtaccgacggtacttaagtttttaacgttttgacgtaaccgaaaggtagggaactttcggaacttacgtttaccgggacgttaaaccctaaccgtttacccgtcggttaccctccggtacgggggtaccctaaggggtttaacccgg

SEQ ID NO: 396393 - DNA, 770 bp, Homo sapiens
  misc_feature: GZ8MTXP02JHT3F.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgaggccctcgcagaccctttcactcacctgtcgactatccgtacggggaaatgtcgctaggacaactaagtggtaggaagttggattaggctacggtccccgtgacgacggtccgttaggaggtggcgtttagggaaacgggtaccttaagtttacgtaccgtcccgtaggttacggtaagtacggaaagtactaagtcggaccgtaagtgtttaccgtaggtacggtacggtccggggttccgtaccgttaccgaacccgtacttaccccgaaacccccgtaagaacccgtaacccgggttaacccaaacggtaaaccgttacccgaacgggttaccccttaccccgtaaccctaaacccgttaaacgttcgtttacccgtacgttaccctaaccccgttaccccggaaaccggtacccgtaaccggggtactttaacggtttttacgtttttacggacggtacgtaaaagggtacgggtaacttacgtacggttacgttacgggtactaccgttaaccgtcgtttacggaccgttccggtacggggtaccgtacgggtttaaccgg

SEQ ID NO: 396394 - DNA, 654 bp, Homo sapiens
  misc_feature: GZ8MTXP02JPKUY.21.27.C05.1.454.CMB.2.raw
  modified_base (202)..(202): a, c, t, g, unknown or other
  modified_base (239)..(239): a, c, t, g, unknown or other
  modified_base (303)..(303): a, c, t, g, unknown or other
  modified_base (390)..(390): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgntgactggttagcctggtaccagcagaaatctggccaggcctcccgaggctcctctatttaccgngcactcccaccgagggcccacgtggtcgtccccagacacggttcaggtgggcgggtggtagtttggggactaggtacggtttttccncgttacaaccgtatccgaacgcccgacccccttaacgaggtagtagaagtagttcgttaggcttaagttttatttcgtggtaccctaagtacctaaaatttataaaactttaccgtgggtacccttggcccggttaccggtaccggtttccgggaacccgtaccgggggtaacccgtaaagggtacgggaaaaacttaccgaaaaacggtaccgttaggtacggaaccgtcggaacctacctactaccgttcgttacctttacg

SEQ ID NO: 396395 - DNA, 542 bp, Homo sapiens
  misc_feature: GZ8MTXP02HQ4GD.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggtggaattggattaggcagtccccgtgagaggccttgagtggcttggaaggacctatatacgtcccagtgtatgaagctatgcagtattctgtagagtcggtcgtctcaccatccacccagacacgtacaaacgatcagtcctccctacacctatcgtctgttcacctcccgacgacacggtactagtttactttgtgtacaaggtaggactcaacgtacttcggtatactaaccttcttaaaacgcctacgtcggggactacggggttaaccg

SEQ ID NO: 396396 - DNA, 607 bp, Homo sapiens
  misc_feature: GZ8MTXP02JTRMK.21.27.C05.1.454.CMB.2.raw
  modified_base (301)..(301): a, c, t, g, unknown or other
  modified_base (356)..(356): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgaccctttcactcacctgtgacatcgtaccggggaaatgtcgctggcaacaatggtggaattggattaggcagtccccgtgagnggcctgagtggcgtggaaggactatatacgtccagtggtatgaagactatgcagnttcgtgtgagcgtcgtctcaccactccaccccagaccacgtaccaaagactcacggtcctccctaccacgttaactcgtctcgttaccaccttaccccgacgtaccgtaccgggtcttagttttaacgttttcgacgtaccgtaaaggtacgggtacttacgtaacgtacgtttaccgggttactaaccgttaacccgttccgtttacgacccgttacccggtcggggtaccgtaacggggtttaacccgg

SEQ ID NO: 396397 - DNA, 624 bp, Homo sapiens
  misc_feature: GZ8MTXP02FV303.21.27.C05.1.454.CMB.2.raw
  modified_base (202)..(202): a, c, t, g, unknown or other
  modified_base (269)..(269): a, c, t, g, unknown or other
  modified_base (303)..(303): a, c, t, g, unknown or other
  modified_base (382)..(382): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggtagcctggtaccagcagaaatcgnggccaggcctccccaggcctcctctatttaccgngcactcccaccgagggcccagtcggtctcccagacacggtttcaggtggcggttggacgtttggggctagtagttttcnctcacatcagccgccctagagtagtagaagattggttacgacttagtttactttcgacgtacctaagacctaaattaacttaaatttaccgtaggtaccctgggccgttaccggtaaccgtttccgggacccggtaacggggaaacccgtaaagggtaacggtaaaactaacccgtaaaacggtaaccgttaggtcggaaccgttacggaccctaaccgtagttcttacgttacctttcccg

SEQ ID NO: 396398 - DNA, 696 bp, Homo sapiens
  misc_feature: GZ8MTXP02J1KS9.21.27.C05.1.454.CMB.2.raw
  modified_base (203)..(203): a, c, t, g, unknown or other
  modified_base (216)..(217): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggacnccgccacctctcnncacacgccagtcagttctatcgctgtacgttggttacgccgtacggtaccagacaagaactcgtacggaccgacggtccctacccgacgtccttcctacttacgtttaccgcgacctacctacccgaccggacgggacctacggtcggtccgtacccgaagtaccgtacggttacgaggtcggggtacgggtaggtaggttacgggacgtagtttacgtttactctacctactactccgaccgtacccgtaccgtacgaaggtagtaagagtagttagttacgtacttagtttacttacgtacgtaactagtaacttaaattaacttaacgttacgtcggtacgttcggtaccggttaccggtaccggtaccgggaacccggtaaacggggtaaccggtaaagggtaaacgtaaaacgtaaccgaaaacggtaacgtggtacggaacgtacgaccgtactacgtcgttacttacttacc

SEQ ID NO: 396399 - DNA, 760 bp, Homo sapiens
  misc_feature: GZ8MTXP02HH9RC.21.27.C05.1.454.CMB.2.raw
  modified_base (204)..(204): a, c, t, g, unknown or other
  modified_base (317)..(317): a, c, t, g, unknown or other
tcagtcgtcgctcgcacgaccggtgctcgatttagacgcgatcgaagggtttgggggaggaactgctcagttaggacccagacggagccatggaacgccccagcgcagcttctcttcctcctgcttctctggctcccagacaccactggagtgattgtgatgacgcagtctccagcccacctgtctgtgtctccgagggggacncgccacccgtctcctgccacagccagtcagtctatcgctgactggttacgccgtggtaccagacagaaatcgtaggaccaggcctccgacggtcctccctctacgtttaccgngaccactaccccgaccggtacgggccctacggtcggtaccgttccccgaaggtaccgtacggttccgaggtcggggtacgggttaggtaggtttacggggaccttaagggtttcgtttttcctcccttaccgtaaccccgtattacccggacggtacccgtacccccgtaaagaggtaaacgtaggtaaaggtagttaggttacggtaacgtttagtttttaacgtttccgggtacgttaccccggaaggttaaccttaaaacggtttaaattaaacgtttaaccgtaccggggttccttacgggtaccgttccggtacccgggtttaccggacccgggtaaaaccgggttaccggaaacgggttaacggtaaaaccgtacgtaaaaccggacgttcggttcggaactcgaccgtacctacgtaccgtttgttacctttcccg

SEQ ID NO: 396400 - DNA, 620 bp, Homo sapiens
  misc_feature: GZ8MTXP02GRPLB.21.27.C05.1.454.CMB.2.raw
  modified_base (199)..(199): a, c, t, g, unknown or other
  modified_base (247)..(247): a, c, t, g, unknown or other
  modified_base (301)..(301): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgactggttancctggtaccagcagaaatctggccaggcctcccaggcctcctctatttacccgngcatcccaccgaggcccacgtggtcgtcccagactaggttccagtggcggtggtatttggggactggtagttttcctcgtcacctatcagccgaccctacgagtacgtagaagtattgttgacttagtttactttctaggtccaagactaaattattaaacgtttacgtcggtccttggaccgttacggtaaccggtttccggggacccgtaacgggggaaaccctaaaggggtagggtaaaacttaccgaaaacggtaaaccgtggtacggtaccttaaggaccctaacccgtatccttacggttcctttactacccg

SEQ ID NO: 396401 - DNA, 639 bp, Homo sapiens
  misc_feature: GZ8MTXP02JPER8.21.27.C05.1.454.CMB.2.raw
  modified_base (203)..(203): a, c, t, g, unknown or other
  modified_base (403)..(403): a, c, t, g, unknown or other
  modified_base (624)..(624): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgcacagccagtcagtctatcgctgactggttagccgtggtaccagcaagaaatcgtggccaggcctcccgacggtcctccctctacgtttacccgtgaccactcccgaccgacgggcccacgtcgggtcgtacccagtacgaggttcaggtgggcggtggtagtttggggactagtacgttttcnctcacctatcgacgccgtacccctaagaggacgtagaaagtagttggtttacgacttagtttttactttacgtcgtacccgtaagtacttaaaattacgttaaacgtttacgtcggggtaccttgtacccgggttaccgttaccgggttccggaccggaaccggggtaccaaagggttaacggaaaacttacgaaaacgtactggacggtctcgactaacnttccgtcgtttctac

SEQ ID NO: 396402 - DNA, 516 bp, Homo sapiens
  misc_feature: GZ8MTXP02ILGAZ.21.27.C05.1.454.CMB.2.raw
  modified_base (200)..(200): a, c, t, g, unknown or other
  modified_base (236)..(236): a, c, t, g, unknown or other
  modified_base (253)..(253): a, c, t, g, unknown or other
  modified_base (287)..(287): a, c, t, g, unknown or other
  modified_base (348)..(348): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctcgagggggggancgccaccctctcctgcacagccagtcagtctatcgntgactggtagctgtacngcagaatctgcaggctccagctctcatttaccgncatccacgacggccacgtggctcccagactggttccagtggcggtggatttgggactggtntttttcgcttaccacctatcacgccgccctacagagtgaagtatgttagtctagtttattcgtgccagactaatattattacgtgcctgcgtcgaccgttcgaccgacgggaacaggtagaaactacgaaaacgctacggtgactgacacactgtacttcttctaccg

SEQ ID NO: 396403 - DNA, 705 bp, Homo sapiens
  misc_feature: GZ8MTXP02HTA8A.21.27.C05.1.454.CMB.2.raw
  modified_base (160)..(160): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatacaaactacagcagtctggtccaggactggtgacggccctcgcacgtaccctttcactcacctgtgactagtcgaccggggtaaatcgtcgcgtggacaacgaagtggtagtaattggagttacggcacgtcccgtgaaggaggtccttaggaggtggtacgttaggaaacggtaccttaagttacgtacgttctcgtaggtagtagtagaaagtacttaagtacgacgtagtaagtttcgtagttaggacgtcgggtaccgtccttaaccacccacgttacccaccccgtagaacccgtacgttaaaccaaaggtaacctaccggtaacgttccctacccctaccctaaaccttaagttcgttacctacgtaccctacccgtacccgaaacgtacctaccgggtactttacgttttagtttacggtcgaaacgtaggaacggtactacgtaacgtacggtttaccggacgtaaccgttaacccgtccgtttacggacccgttaccggtacggggtaaccgtttaaccgggg

SEQ ID NO: 396404 - DNA, 622 bp, Homo sapiens
  misc_feature: GZ8MTXP02FHXVW.21.27.C05.1.454.CMB.2.raw
  modified_base (199)..(199): a, c, t, g, unknown or other
  modified_base (266)..(266): a, c, t, g, unknown or other
  modified_base (297)..(297): a, c, t, g, unknown or other
  modified_base (419)..(419): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaatcnggccaggctcccaggctcctctatttaccgngcactcccaccgagggcccacgtggtctcccagacgtaggttccaggtgggcggtggtagtttggggactaggtacgttttctctcaacctatcagtcccgaccctaagagagtagaaagtntgttgacttagtttattcgtgacctagtactaaaattattaaacgtttacgtcggtaccttggtaccggttacggtaccggtttccgggacccgaaccggggtaacccaaaaggggttaaggaaaactaaccgaaaaccggtaacgttcggtacggacctaacggaccctaaccgtacttccgttacgttacctttactaacc

SEQ ID NO: 396405 - DNA, 616 bp, Homo sapiens
  misc_feature: GZ8MTXP02J3EPA.21.27.C05.1.454.CMB.2.raw
  modified_base (310)..(310): a, c, t, g, unknown or other
  modified_base (315)..(315): a, c, t, g, unknown or other
  modified_base (366)..(366): a, c, t, g, unknown or other
  modified_base (382)..(382): a, c, t, g, unknown or other
  modified_base (428)..(428): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccgagtggggtgtcctgtcacagatcaaactcagcagtctggtccaggactggtgacggccctggcacgtaccctttcactcaccgtgtgactagtccgtaccggggaaaatcggtcgcgtggcaaacagtggtagtaattggattaggctacgtcccgngaggngccttgagtggacgttggaggtaccttattacgtacgtaccgagtcggtanagagactagtgcagtntcgtagtgagtcggtctctcacactccacccagaccacgtacgaanactcgacggttacctccctacctactaactcgtctgtaccacctcccgacgtacacggtacttagtttacgtttaggactacgaaggacggtactacctaaacgtacgtttccgggtacgtacccttaaccgttccgttaccggtaccgttacccgggtcggggtaacccgtacggggtttaacccgg

SEQ ID NO: 396406 - DNA, 678 bp, Homo sapiens
  misc_feature: GZ8MTXP02H64IB.21.27.C05.1.454.CMB.2.raw
  modified_base (238)..(238): a, c, t, g, unknown or other
  modified_base (294)..(294): a, c, t, g, unknown or other
  modified_base (348)..(348): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacgccctcgcagaccctttcactcacctgtgacntcgtaccggggaaatgtcgctgcaacaatggtagatggattagcacgtccgtgagngctgagtgcgtggagactatatacgtccagtcgtatgaagactagtgacgagtnttcgtgtcggtagtcggtccgtactacccaaccctaccgtacccgaacccgtaacgaacccgtaacccgtaacgtaaaaccgtaacgtaacgtacccgttaccccgttacccctaacccgttaaaccttaaacgttccgtacgttacccgtaacccgtacccgttaacccggaaccgtaacccggtaacgttacgtttttaaccggttttagtttaccggtacggtaacgtaacggggtactaacgtacgtaacgttacggttacgtacgttacccgttcgttacgtaccgtaccgttacgggtaccggtaccggttaacggtttacccg

SEQ ID NO: 396407 - DNA, 636 bp, Homo sapiens
  misc_feature: GZ8MTXP02H0PN5.21.27.C05.1.454.CMB.2.raw
  modified_base (404)..(404): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgactgtgatgacgcagtctccagccaccctgtctgtgtctccgaggggggagccgccaccctctcctgcacagccagtcagtctatcgctgactggtacgcctggtaccagcagaaatctggccaggcctccccgaggcctccctactacgttttacccgtgactactccccaacgacgggcccacgttggtctaccccaggacctaggttcccaggtcgggcggttggtagtttggggaactggtacgtttttcnccgtaccacctatacacgcccgaccctacagacgtagaagtatgttgcgtagtttacttcgtacgtcagtactaaattattacttacgtggtccgtgtaccggtacggtaccggttccggaacccggtacgggaaaccgtaaggggtaacggtaaaactaaccggaaaacgtaccgtaggttacggacgtaacggaccctaactacgttcgttacgttacctttacgtcccg

SEQ ID NO: 396408 - DNA, 573 bp, Homo sapiens
  misc_feature: GZ8MTXP02JZXSO.21.27.C05.1.454.CMB.2.raw
  modified_base (347)..(347): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagaccctttcactcacctgtgacatcgtaccggggaaaatgtcgctggcaacaatggtgaatggattaggcagtcccgtgagaggccttgagtggcttggaaggcctattatacgtccagtgtatgaagactangcagattctgtgagcggtcgtctcgacccactcccaaccgacgaacctaccgtacaaacgtactacgtacgtccctccctacctaacctaagtcgtactcgtacctaccgtaccgacgaccgacggtcttagtttactttgactacgacggtaggtactacgacgttacgtcgtacgtaccgtaaccttcgtactacgtccgggtacggacggtaacggtttccgg

SEQ ID NO: 396409 - DNA, 724 bp, Homo sapiens
  misc_feature: GZ8MTXP02H4M4O.21.27.C05.1.454.CMB.2.raw
  modified_base (185)..(185): a, c, t, g, unknown or other
  modified_base (199)..(199): a, c, t, g, unknown or other
tcagtcgtcgctcgcacgaccggtgctcgatttagacgcgatcgaagggtttgggggagaactgctcagttaggacccagacggagccatggaagccccagcgcagcttctcttcctcctgcttctctggctccagacaccactggagtgattgtgatgacgcagtctccagccacctgtctgtntctccgagggggancgccaccctctcctgcacagccagtcagtctatcgctgactggttacgccgtggtaccagcaagaaatcgtcggccaggcctccgaggtcctcccttactacgtttacccgtgactactacccaccggacgggaccctacgttcgggtaccgttaccccgacggtaaccgtaccggggtttaccgaaggggttccggggtacggggtttagggttaacggttttacggggaccttaaggggttttaacgttttttcccgttaccgttaccgaaacccgtacttcccgaaacccggtacccgtaccccttaaacggaggtaacggtagtaaaggttacgttaggtttcgactttaggttttacttccgtagtaccctaggtaactaaaattaacttaaacgttcgtaccggtcgttcggtccggttaccggtacggttcccggaaccggtaaccgggaaacgtaagggtacgaaacgtacgtaaaacgcgttggacgtcgacgactacacgttcgtacgttctacc

SEQ ID NO: 396410 - DNA, 589 bp, Homo sapiens
  misc_feature: GZ8MTXP02FT154.21.27.C05.1.454.CMB.2.raw
  modified_base (357)..(357): a, c, t, g, unknown or other
  modified_base (463)..(463): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagtaccctttcactcacctgtgacatcgtaccggggaaatgtcgctggcaacatggtggaattggattaggcagtccccgtgagaggccttgagtggcttggaagacctattactacgtccagtggtatagagactatgcagtnttcgtgtagagcgtcgtctcactatccacccagaccacgtaccaaagtactcgagtcctccctacctaacctaaatcgtctcgtacctaccgtaccccgacgaacncggtactacgttttagtttgacgtacgaaaggacgggtactacgtaacttacgttacgtacgttaacctaacccgttcgttacgtacccgtccggtttacggggacccgtacgggtttaaacccgg

SEQ ID NO: 396411 - DNA, 537 bp, Homo sapiens
  misc_feature: GZ8MTXP02FO04B.21.27.C05.1.454.CMB.2.raw
  modified_base (298)..(298): a, c, t, g, unknown or other
  modified_base (355)..(355): a, c, t, g, unknown or other
  modified_base (462)..(462): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtgaattggattaggcagtccccgtgagnggcctgagtggcttggaaggacctattatacgtccagtggtatgaagactatgcagnttctgtgagcggtcgtctcaccatccacccagacacgtacaagatcacgtcctccctaccacctaatcgtctgtacacctcccgacgacacggtctagtttatttgngacgagaggactacacgtacgttcggtgtacctaacgtccgtacgtacgtccgtacggggccgtagggttaaccg

SEQ ID NO: 396412 - DNA, 537 bp, Homo sapiens
  misc_feature: GZ8MTXP02IQTJD.21.27.C05.1.454.CMB.2.raw
  modified_base (320)..(320): a, c, t, g, unknown or other
  modified_base (348)..(348): a, c, t, g, unknown or other
  modified_base (473)..(473): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacatggtgaattggataggcagtcccgtgagagcttgagtgcttggaagtcctattanacgtccagtgtatgaagactatgacagnttctagtggagcgggtcgtctcaccataccacccagacacgtacaagaatcagtctcctacactaatgtctgtcactacccgagacacggctatttatttgcgtcaaaggtggtacttacaaacncgttacggtactaccttaaccgtccttacggacctccggtcggggaccctaggggtttaacccg

SEQ ID NO: 396413 - DNA, 734 bp, Homo sapiens
  misc_feature: GZ8MTXP02ISHYO.21.27.C05.1.454.CMB.2.raw
  modified_base (202)..(202): a, c, t, g, unknown or other
  modified_base (307)..(307): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttagcctggtaccagcagaaactctcggccaggcctccccgaggcctcctctactttaccgngccatcccaccgacgggcccacgttcgggacgtccccgagtacgacggttcaggtgggtccgggtggtagtttcggggacgtaggtacgtttttcctcttaccgacctaacttcgacgcccgtaccccttaacgacgtacggttaggaaacgtagttacggtttacggtaccgtttaaggtttttaacttttcggtccgaaccgtacggtaactaaaactttaacgtttaaaactttacccggttacggtacccgttcgggtacccggttacccggttaccgggtttacccgggaccccggtaaaccgggggtaaaccgtaaacggggtaacggtaaaacgttaaaccgtaaaaaccgtaaacggttcgggtacggtaacgttacggaaccctaccgtaacgttccgttacggtttacctttacccg

SEQ ID NO: 396414 - DNA, 687 bp, Homo sapiens
  misc_feature: GZ8MTXP02IFG4V.21.27.C05.1.454.CMB.2.raw
  modified_base (446)..(446): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtgactatccgtaccggggaaatcgtcgctggacaactaagtgggtaggaattggaattaggcacggtccccggtagaggtacggccttggaagtcggtacgtttaggaacgggtaccttattacgtaaccgttccctaggtgtactagtaagtactagtgacagtattcgtggtacggtagtccgggttccgtacttcccaacccttacnccctaaccccgaagtaacccgaacgtaaccgaaacgtaaactaccgaacggttccctaccccttacctaaaccttaacgtcgttaccttccgtaccgtacccgtaccccgaacgtaccgtacggtactttaggttttacttttgactacgtaaagacggtactcgaactacgttcgtaactaccgtaacccgttacttacggtaccttccgggtacggggtaccgtaacgggggtttaccg

SEQ ID NO: 396415 - DNA, 584 bp, Homo sapiens
  misc_feature: GZ8MTXP02JV257.21.27.C05.1.454.CMB.2.raw
  modified_base (202)..(202): a, c, t, g, unknown or other
  modified_base (256)..(256): a, c, t, g, unknown or other
  modified_base (295)..(295): a, c, t, g, unknown or other
  modified_base (411)..(411): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgactgtagctgtaccngcagaaatctgccaggcctccgaggctctcatttaccgngcactccaccgagggccacgtggtctcccagactacggttcagtggcggttggtagtttggggactaggtagttttcctctcgacatcacgccgtaccctagaggtagtagaagtnttgttacgtcttagttttactttcgcgtaccagtactaaattagttaaattcgtcggtcctaggtccgttacggtacggttccgggaccgtaaccggggaacctaaggggtacggtaaaacttacggaaaaccgtacgtaggtcggctacggcacgtatccgtgtaccttccg

SEQ ID NO: 396416 - DNA, 707 bp, Homo sapiens
  misc_feature: GZ8MTXP02HR0DN.21.27.C05.1.454.CMB.2.raw
  modified_base (203)..(203): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacnccgccaccctctcctcgcacacgccagtcagtctacgtcgctgtacgttggtacgccgtacggtacagacaagaaactcgacggaccgacggtcctaccgacggtccttcctacttacgtttaccgcgtacctactacccgaaccggacgggtacctacgtcggtaccgtaccgagtacgtacggttacgaggtgggtacgggttaggtaggttagggacgttaggttactttctacctacctactactcgacgtcctacctaagagtagtagaagtagttgttagtacttagtttacgttacgtacgacgtaagtaacttaaatttaacgttaacgttacgtcgtaccgttacggtaccggttaccggtaccgggtacccggtaacccggtaaacgggtaaaccggtaaagggttaaacgtaaaacgtaaaccggtaaaacgtacggtacggtacggtaaccgtacgtaaccgtactacgtttaccgttacgtttacctaacg

SEQ ID NO: 396417 - DNA, 586 bp, Homo sapiens
  misc_feature: GZ8MTXP02FQQNZ.21.27.C05.1.454.CMB.2.raw
  modified_base (202)..(202): a, c, t, g, unknown or other
  modified_base (394)..(394): a, c, t, g, unknown or other
  modified_base (451)..(451): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccacctctcctgcacagccagtcagtctatcgctgactggtagcctggtaccagcaagaaactcgtggccaggcctcccgaggcctccctctactttaccgtgccactcccaaccgacgggccacgtcggtctcccgaagactacggttccaggtggcggttaggtagtttggggactagtacgttttcncgtcacatccagtccgaccctagacgagtagaagagttgtagtcttagtttatttcngtaccagtactaaagttattaagttacgtcgtacctggtaccgtcgtacgttccggaccgaacgggtaccgtaaaggtacgtaaattaaccgaaaacgtaacgtggtacggctacgactacattcgcttcttacc

SEQ ID NO: 396418 - DNA, 643 bp, Homo sapiens
  misc_feature: GZ8MTXP02JVIAL.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggggctcccatggggtgtcctgtcacagatcaaactacagcagtctggtccaggactggtgacggccctcgcagtaccctttcactcacctgtgacatcgtaccggggaaatgtacgctggacaacaagtggttaggaattggattaggcagtccccgtgagaggtcctgagtggcgttaggaacggtacctattacgtaccgtcccgaggtggtatgaagactatgcagtattcgtggtgagtcggtacgtctaccgacctactaccacccgtagaccacgtaccaaagaactcgtaacggtacctccctacctaccttaatcgtctagtcccaccgtacccgaacgacgtacggacttaggtttacgttttacgacgtacgtaaaggacgggtacttaccgaacgttacgtttaccggtaacgtacccttaacccgttacccgttacgtaacccgttcccgggttacggggtacccggttaaggggtttaaaccccgg

SEQ ID NO: 396419 - DNA, 789 bp, Homo sapiens
  misc_feature: GZ8MTXP02JR6NN.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtcgactatcgtaccggggaaatgtacgctggacaacgtaagtggtagaattggattaggcacgtccccgtgagacggcctggagtggtcgttaggaacggtaccttagttacgtaccgttcccaaggttcggtacgttagaaacgtacttaacgtggaccgtaagtatttccgtaggttacggtaagggtccgggttcgttaccgttacccgaaacccgtaacgttaccccaaacccccgaaggtaacccgaaacccggttacccaaaacgggtaaacttacccgtaaaccgggttcccccttaacccccggttacccccgtaaacccctttaaacgttccggttaccctaccgtacccgtaaccccgttacccccggaacggtaacccgtaaccgggtccctttaacggtttttagtttttacggaccgtaacggtaaaacggtacggggtaaactttacccgaacgtttaacgtttccggggtaactaacccgttaacctccgttacgtaacccgtcggtaccggggtaccgtaacggggtttaaccccgg

SEQ ID NO: 396420 - DNA, 640 bp, Homo sapiens
  misc_feature: GZ8MTXP02IQVYW.21.27.C05.1.454.CMB.2.raw
  modified_base (204)..(204): a, c, t, g, unknown or other
  modified_base (240)..(240): a, c, t, g, unknown or other
  modified_base (312)..(312): a, c, t, g, unknown or other
  modified_base (442)..(442): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctcctgcacagccagtcagtctatcgntgacttggttagcctggtaccagcaagaaatctggccaggcctccccgaggcctcctctacgttttacccgngcctatccccaaccgacggggccctacgtcggtcgtccccgaaggacctaggttccaggttgggacggtggtagtttggggactaggttacgttttcctaccgttaccacctatcacgccgtacccctanaggagtagaaagtcgttgttgaccttagtttactttcgtacgtcctaagtactaaattaataacttacgtcggtctacggtcgtacgtaccgttcgggacccgtaaacggggaccgtaaaggggtacgtaaaacgaccgaaaacgtaccgtgttacggaaccgtagacctaacgtactcgtttaccgttacttacccg

SEQ ID NO: 396421 - DNA, 518 bp, Homo sapiens
  misc_feature: GZ8MTXP02F5Y9M.21.27.C05.1.454.CMB.2.raw
  modified_base (200)..(200): a, c, t, g, unknown or other
  modified_base (298)..(298): a, c, t, g, unknown or other
  modified_base (321)..(321): a, c, t, g, unknown or other
  modified_base (363)..(363): a, c, t, g, unknown or other
  modified_base (383)..(383): a, c, t, g, unknown or other
  modified_base (427)..(427): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctccccaggctcctcatttaccgngcatccaccagggcccactggtntcccagacaggttccagtggcgtggatttgggatgagtttcnctcacctatcagcgccctanagagtgaagatgttgctagtttattctgccagcaatataattangcctgcgtcgacgttcggccacgggaccaaagggtaggaaaactacgaaaacgaactaggtcggctggcaaccgattctagttcttactac

SEQ ID NO: 396422 - DNA, 562 bp, Homo sapiens
  misc_feature: GZ8MTXP02I46FT.21.27.C05.1.454.CMB.2.raw
  modified_base (329)..(329): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggttggaattggattaggcagtccccgtcgagaggccttgagtggcttggaagcctattanacgtcccagtgtatgaagactatgcagattctgtgagcggtcgtctcaccatccacccagacacgtcaagatcagtctcctccacctaatgtactctcacctcccgacacgacgtctacgtttattttcgagtacaaggagggacttacgaactacgttaccgggtacgtaaccttaacccgttaccgttcgtacccgtccgtacgggggtacccgtaaggggtttaacccgg

SEQ ID NO: 396423 - DNA, 614 bp, Homo sapiens
  misc_feature: GZ8MTXP02GFMA2.21.27.C05.1.454.CMB.2.raw
  modified_base (199)..(199): a, c, t, g, unknown or other
  modified_base (232)..(232): a, c, t, g, unknown or other
  modified_base (265)..(265): a, c, t, g, unknown or other
  modified_base (284)..(284): a, c, t, g, unknown or other
  modified_base (294)..(294): a, c, t, g, unknown or other
  modified_base (364)..(364): a, c, t, g, unknown or other
  modified_base (383)..(383): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctancgctgactggttagctggtaccagcagaaatcnggccaggctccagctcctnactttaccgngcactccacaggcccagtggtctacccagactaggttccaggtggcggtgtagttgggactgtagtttcnctcacatcagccgccctanagagtagaagtatgttagacttagtttacttcgtacgtccaatactaaattaattaaaagttaaccgtcggtaccgttcgggtaccggttaccggtaccgggtttaccggacccggaaacggggtaaacccgtaaaaggggtacggtaaaaacttaacccgaaaaacgttaccgtaggttacggacttaacggaccaaccgttaatccgttacgtacctttacgtaacccg

SEQ ID NO: 396424 - DNA, 662 bp, Homo sapiens
  misc_feature: GZ8MTXP02HKWDK.21.27.C05.1.454.CMB.2.raw
  modified_base (202)..(202): a, c, t, g, unknown or other
  modified_base (251)..(251): a, c, t, g, unknown or other
  modified_base (313)..(313): a, c, t, g, unknown or other
  modified_base (412)..(412): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgccaccgcagtcagtctatcgctgactggttacnccgtggtaccagcaagaaatcgtggccaggcctacccgaggccttcctctacgttttaccgngcctactcccgaaccgacgggccctacgtggtccgtaccccgagacgtaggtccgaggtcggggtcggtaggtagtttcgggactaggttcgtttttcnctccgtaacctatccgacgcccgtccctaaagacggtagtagaaagttagtttggttacgtacgttagttttacttcgtacggtacctaaagacttaaattaacttaacgttacgtcggtacccgttggtaccggttacggtaaccggttccgggaaccgtaaccggggaaaccgtaaaggggtaacggaaaactaacggtaaaaccgtagtcggtacggactcgactaacgctcgtcgtactcttaccg

SEQ ID NO: 396425 - DNA, 581 bp, Homo sapiens
  misc_feature: GZ8MTXP02G6996.21.27.C05.1.454.CMB.2.raw
  modified_base (202)..(202): a, c, t, g, unknown or other
  modified_base (249)..(249): a, c, t, g, unknown or other
  modified_base (306)..(306): a, c, t, g, unknown or other
  modified_base (386)..(386): a, c, t, g, unknown or other
  modified_base (420)..(420): a, c, t, g, unknown or other
  modified_base (425)..(425): a, c, t, g, unknown or other
  modified_base (439)..(439): a, c, t, g, unknown or other
  modified_base (466)..(466): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttancctggtaccagcaagaaatcgtcggccaggcctcccgaggctccctctatttaccgngcactcccaacgacgggccacgtggtcgtcccagactacggttcaggtggcggttggtagtttgggactagttagtttcncgtcactatcagccaccctagagtagtagaagtntgttnacttagtttattcngacctagtactaaattataacttacgngacctggcgttacggtaccggttcggaccggtacgggaaccgtaggtaaacggtaaactacgaaaacgtacgtcggtacggaactacgacctacactttcgtcgttactttaccg

SEQ ID NO: 396426 - DNA, 706 bp, Homo sapiens
  misc_feature: GZ8MTXP02IP3ML.21.27.C05.1.454.CMB.2.raw
  modified_base (200)..(200): a, c, t, g, unknown or other
  modified_base (314)..(314): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggncgccaccctctcctgcacagccagtcagtctatcgctgactggttagcctggtaccagcaagaaactcgtcggccgacggcctccccgacggccttcccgtctactttaccggngccactccaccgacgggcctacgtcggtcgtcccgaacggacgtacggttcgaggtcgggtcggggttaggtaggtttgggacgtaggttacgttttccgtacctaccaacctattccacggtccgtaccctagaacggtaggtagaaaagtcgttggtttgtacgttacgtttttactttcgttaccgtaccgtaagtaaccttaaagtttaaattaaacgtttaaccgtcggtacccgttggtacggttccggttaaccgggttcccgggacccggtaaccgggggtaaacccggtaaaggggtaaacggtaaaactaaccgggaaaacgtaacggttcgggtaacgccgttacgacctaccgtacgttcccgttacgtttacctttacc

SEQ ID NO: 396427 - DNA, 658 bp, Homo sapiens
  misc_feature: GZ8MTXP02G2BIU.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatttctgtctccttcctcatcttcctgcccgtgctgggcctcccatggggtgtcctgtcacagatcaaactacagcagtctggtccaggactggtgacggccctcgccagtaccctttcactacacctgtgacatcgtaccggggaaatgtcgctggcaacagtggtgaattggattagcagtcccgtgagacggctgagtggcgttagggaacggtactagttactacgtacccgaggtcggtaatacggaaacgtactagtgacctaagtacgtttcgtagtaggtacggccgggttacgtacctacgaccctaacgtcccaaccccgtaagtaccaaccgtaccgaaaagtaaacgtccgtaacgtccctacccctaccgaaccttaaacttcggtacttaccgacctacccgtaccccgacgtaaccgtacgtacgttaacttttagttttgacgtacgtaaacggacgggtactacgtaactagttcggtaccgtccttacctcgtcgtaccgttcgcgggtacgtacgggttacgtttacccgg

SEQ ID NO: 396428 - DNA, 629 bp, Homo sapiens
  misc_feature: GZ8MTXP02JVFF8.21.27.C05.1.454.CMB.2.raw
  modified_base (200)..(200): a, c, t, g, unknown or other
  modified_base (300)..(300): a, c, t, g, unknown or other
  modified_base (383)..(383): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctcccaggcctcctctactttaccgngcatcccaccgagggcccacgtggtcgtcccagacgtaggttccgaggtggcggtggtagtttggggactaggtacgttttcnccgtcaacctatcacgtcccgaccctaacgagaggtagaaagtattggttagtacttaagttttactttccgtacgcccgtaagtacctaaattaattaaacgtttacgtacggtacccgttggtacccggttacggtacccggtttaccggaccccgaaacggggtacccgtaaaaggggttacgaaaacttacgaaaacggtaacgtggtacggactgaccacctacgtctcgttactctaccg

SEQ ID NO: 396429 - DNA, 679 bp, Homo sapiens
  misc_feature: GZ8MTXP02GPGMZ.21.27.C05.1.454.CMB.2.raw
  modified_base (304)..(304): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggagccgccaccctctcctgcacagccagtcagtctatcgctgactggttacgctggtaccagcagaaatcgtggccaggcctccccgaggcctcctctactttaccgngcactcccaccgacgggccctacgtcggtccgtacccagaccgtaggttccaggtgggtcgggttgggtagtttcggggaactaggttacgtttttcctcgttaccaacctatccaacggcccgtacccctaacgaggtaagtagaaagtagttgttagtacttagtttattcgtacgtacctaagtactaaattaacttaaacttacgtcggtaccttggtcccggttacggtaccggttaccgggacccggtaaccggggtaaaacccggtaaaagggggtaacggtaaaacgtaaccgaaaaacggtacgttacgggtacgggaccttaacggaaccctaccgtacttcgtacggtttaccttacttacccg

SEQ ID NO: 396430 - DNA, 796 bp, Homo sapiens
  misc_feature: GZ8MTXP02HSNI9.21.27.C05.1.454.CMB.2.raw
  modified_base (206)..(206): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggggacnccgcccaccctctcctgcacacgccagtcagtctatcgctagacgttggtacgccgtacggtaccagacaagaaactcgtacggccgacggcctacccgaggtccttccctacttaccgtttaccgacgtacctacctaccccgaaccggtacgggtaccctacggttcgggttaccgtaccccgaaggaccgttacgggttacgacgggttcggggtacggggttagggttacggtttcggggaccgttaggtttacgttttcctacccgtaccgtaacctacgtaccgaccgtacccgtaacccgtaacgaaaggtacggttaagtaaacgttagtttacggttacgtacgtttagttttactttacgtaccgtaccgtaaagttaacgtaaaactttacgttaacgtttaccggtcggtaccgttacggtcccggttaccgggttacccggttacccgggaaccccggtaaaccggggtaaaccggtaaacggggtaaacggtaaaaccgtaaccggaaaaccggtacgttacgggtacgtcgtaaccgaaccttaccgtacgttaccgtttacgtttacctttacg

SEQ ID NO: 396431 - DNA, 580 bp, Homo sapiens
  misc_feature: GZ8MTXP02FGK7Z.21.27.C05.1.454.CMB.2.raw
  modified_base (372)..(372): a, c, t, g, unknown or other
  modified_base (491)..(491): a, c, t, g, unknown or other
  modified_base (501)..(501): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagaccctttcactcacctgtgacatcgtaccggggaaatgtcgctggcaacaatggtaggaattggattaggcagtccccgtgagaggccttggagtgggcttaggaaagggtacctagttactaccgtccaggttggtatgaaagactatgcagtntctgtgagcgtcgtctcaccatcccacccagacacgtaccaagaactcgagtcctcccctacctacctaaatcgtctcgtccacctccccgaacgaccgacggacttagtttattttgngactaaaggnggtactacacgtacgttacggtctaccctaaccgtccgtttacgaccgttaccggtcggggaccgtacgggttaaccgg

SEQ ID NO: 396432 - DNA, 626 bp, Homo sapiens
  misc_feature: GZ8MTXP02HDTYR.21.27.C05.1.454.CMB.2.raw
  modified_base (220)..(220): a, c, t, g, unknown or other
  modified_base (317)..(317): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacccgcccaccctctccngcacagccagtcagtctatcgctgacgttggttacgccgtggtaccagacaagaaatcgcggaccacggcctccgaggtcctcctctactttaccgngacactcccaccgacgggcctacgtcggtcgtacccagtacgtacggtcgaggtcgggcggtggtagtttgggactagttcgtttctctaccactatcgacgccgtaccctagagtagtagaagtagttgttgtacttagtttacttcgtcgtacctagtaactaaattaagttaaacttacgtacggtccgtggtcgttacgtagttcgggtaccggacccggtaacgggaaccgtaaagggtaacggaaaacgtaaccgaaaacgtacgtaggtcggtacgtacgacctaccgtacttcgttacgtc

SEQ ID NO: 396433 - DNA, 790 bp, Homo sapiens
  misc_feature: GZ8MTXP02JBUIK.21.27.C05.1.454.CMB.2.raw
  modified_base (203)..(203): a, c, t, g, unknown or other
  modified_base (240)..(240): a, c, t, g, unknown or other
  modified_base (272)..(272): a, c, t, g, unknown or other
  modified_base (308)..(308): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggacnccgccaccctctcctgcacagccagtcagtctatcgntgactggtacgcctggtaccagcaagaaatcnggccaggcctacccgaggcctcctctactttaccgngaccactcccaccgtacggggccctacgttcgggtcgtaccccaaggtaccgtacggggtttaccagggttggggtaccggggttgggtaaggtttttcggggaccgttagggtttaacggttttttccgtacccgtaccgtaaaccctacgttcccgaaaccgggtccccgtaacccccgtttaaacggaaggtaacgggttaacggtaaaaagttgtttagggtttcgttaaccgtttaagtttttaactttttcggacgttaccgtaacgtaaccttaaaagtttaaatttaaaaccgtttaaccgtcgggtacccgttaggtacccggttacgggttaaccggtttaacggggacccgtaaaaccgggggtaaaccgtaaaaggggttacggaaaaaacgttaccgaaaaaacggtaaccgttggtaacggtccttacggaaccctaaccgtatttccggttacgttacctttaaccg

SEQ ID NO: 396434 - DNA, 681 bp, Homo sapiens
  misc_feature: GZ8MTXP02GE6FZ.21.27.C05.1.454.CMB.2.raw
  modified_base (308)..(308): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccggagggggagccgccaccctctcctgcacagccagtcagtctatcgctgactggttagccgtggtaccagcaagaaatcgtggccaggcctcccgaggtcctcctctactttaccgngcactcccgaccgacggcccacgtcggtcgtacccgagtacgtaggttccgagggtcgggcgggtaggtacgtttggggactagggttacgttttctctaccacctatccgacgccctacccgtacgaggtaagtagaaagtagttggttacgtacgttagtttactttcgtacggacctaagtaacttaaattaagtttaaactttaccgtacgggttcctcgggtaccggttaccggtaccgggttccgggacccgtaacgggggtaaccgtaaaagggtaacggtaaaactaaaccgaaaacggtacgttacgggtacggtacgtaacgtaccctaaacgtacttcgttacgtttaccttaccttacccg

SEQ ID NO: 396435 - DNA, 760 bp, Homo sapiens
  misc_feature: GZ8MTXP02JRP8M.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccggaggggggacnccgcccaccctctcctgcacacgccagtcagtctatcgctgacgttggtacgccgtaggtaccagacaagtaaactcgtcggaccacggtcctcccgaggtccttacccctacttaaccgttttaccggcgacctaactaccccgaaccggacggggtaccctaagggttcgggtccgtaccccgaaaggtacgtacggggttccgaggggtcggggtcggggtttaggtaaggtttaggggaccgttaagggtttacggtttttcctaccgtacctaactacttaccgaccgtacccgtaccccttaaaggaaggtaacggtaggaaagttacgttggtttacgttacgtttaattttacgtttccgacgtacccgtaaagttaacttaaattaacgtttaaacgttcggtcggtaccgtcggtaccgttaccgggtaccggttacgggaaccccggtaacggggaaaccgtaaggggaaacgtaaacgtaaaccggtaaaacgtacgtcggtacggaactacggaccctacgtatccgtttcgtactttacccg

SEQ ID NO: 396436 - DNA, 588 bp, Homo sapiens
  misc_feature: GZ8MTXP02JSXYT.21.27.C05.1.454.CMB.2.raw
  modified_base (359)..(359): a, c, t, g, unknown or other
  modified_base (401)..(401): a, c, t, g, unknown or other
  modified_base (410)..(410): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgacccctttcactcacctgtgacatcgtaccggggaaatgtcgctggcaacaatggttggaattggattaggcagtccccgtgagaggccttgagtggcttggaagacctatatacgtcccagtggtatgaagactatgcagnttctgtgagcgtcgtctcaccatccacccagacacgtacaanatcagtccncctccactatctctcgtccaccgtcccgtacgaccgtacggtactagtttttaagtttttcggacgtaccgtaaaagggtacggggtactaccgtaacgtactttaccgggggtactaaccgttaaccctccgtttcgtaacccgtccggttacggggacctacgggggtttaaaccg

SEQ ID NO: 396437 - DNA, 569 bp, Homo sapiens
  misc_feature: GZ8MTXP02HH1GW.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacagtcgtaccggggaaatgtcgctggacaacaatggtggaattggattaggcacgtccccgtgagacggccttgagtggcttggaacgtacctatactacgtccctagtcggtatagaagactatgacagtattcgtggtgagtcggttcgtcttcacctagtcccaacccagaccacgtaccaagaactcgacgtcctccccgtacaccctaatcgtctacgtccacctcccgaacgacacgtcttagtttagtttcgacgtacaaggacggtatccgtaactacgtcggtactactccgtcttcgacctcgtacgggaccgtaggtaacg

SEQ ID NO: 396438 - DNA, 592 bp, Homo sapiens
  misc_feature: GZ8MTXP02FKP84.21.27.C05.1.454.CMB.2.raw
  modified_base (346)..(346): a, c, t, g, unknown or other
  modified_base (351)..(351): a, c, t, g, unknown or other
  modified_base (357)..(357): a, c, t, g, unknown or other
  modified_base (400)..(400): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagtaccctttcactcacctgtgacatcgtaccggggaaaatgtcgctggacaacaatggtggaattggattaggcacgtcccgtgagaggcctgagtgcttggaagtcctattatacgtccagtgtatgaanactangcagtntctgtgagcgtcgctacacatccacccagacacgtacagaacncacgtcctccctacacctaatcgtctcgtaccaccgtcccgacgacaacggtcttacgttttagttttgacgtaacggaaggacgggtaactaccgtaacgtacgtttacgggtacttaaacccttaacccgttacccgtttacggtacccgttaccggttacgggggtaccctaacgggggtttaacccgg

SEQ ID NO: 396439 - DNA, 636 bp, Homo sapiens
  misc_feature: GZ8MTXP02HCLT7.21.27.C05.1.454.CMB.2.raw
  modified_base (290)..(290): a, c, t, g, unknown or other
  modified_base (301)..(301): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggccgccacctctcctgcacagccagtcagtctatcgctgactggtacgcctggtaccagcaagaatcgtggccaggcctcccaggcctcctntactttaccgngccacgtcccaccgacgggccctacgtcgggtacgtaccccaggtacctacgggttacgagggtcgggtacggggttaggttaaggtttggggacctaggttacgtttttcctctacctaacctacgtcgaacgtccgaccccttaagagtacgtagaaagtgtgttacgtacttaagttttactctacggacctaagtactaaattagtaaacttcgacgtctaggtcgtacgtcggttaccggacgtaacggtaccgaagggtaacgtaaaacgcgaaaaccggtagtcgttaacggcctacggacctaacgtcttacgttcggtaccttacg

SEQ ID NO: 396440 - DNA, 555 bp, Homo sapiens
  misc_feature: GZ8MTXP02FIR41.21.27.C05.1.454.CMB.2.raw
  modified_base (235)..(235): a, c, t, g, unknown or other
  modified_base (299)..(299): a, c, t, g, unknown or other
  modified_base (353)..(353): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgacggccctcgcagaccctttcactcacctgtnacatcgtaccggggaaatgtcgctggcaacaatggtggaattggattaggcagtccccgtgagngctgagtggcttggaagcctattatacgtccagtggtatgaagactatgcagtntctgtgagcgtctcgtacaccagtcctacccagacacgtaccaagaactcgacgtcctcctaccactatcgtctcgtaccactcccgacgacgcgtcctaagtttcttttagcgacgtaaggagacgtactaactacgttcggtacgtacctaaccgttccgttacgtaccgttccgtacggggaccgtacgggtttaaccg

SEQ ID NO: 396441 - DNA, 536 bp, Homo sapiens
  misc_feature: GZ8MTXP02FKKJF.21.27.C05.1.454.CMB.2.raw
  modified_base (348)..(348): a, c, t, g, unknown or other
  modified_base (358)..(358): a, c, t, g, unknown or other
  modified_base (362)..(362): a, c, t, g, unknown or other
  modified_base (466)..(466): a, c, t, g, unknown or other
  modified_base (495)..(495): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggtggaattggattaggcagtccccgtgagaggccttgagtggcttggaaggacctattatacgtccagtggtatgaanactatgcagnttcngtgagcggtcgtctcaccatccaccccagacacgtcaaagatcagtcctaccctccacctaatcgtactgtccactcccgacgacacggtctagtttattttgngacaaggagggactcactacgttcggtanacgtaacctcttagaccgtccgtcggggccagggttaaccg

SEQ ID NO: 396442 - DNA, 576 bp, Homo sapiens
  misc_feature: GZ8MTXP02HKZUL.21.27.C05.1.454.CMB.2.raw
  modified_base (203)..(203): a, c, t, g, unknown or other
  modified_base (300)..(300): a, c, t, g, unknown or other
  modified_base (370)..(370): a, c, t, g, unknown or other
  modified_base (390)..(390): a, c, t, g, unknown or other
  modified_base (402)..(402): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgngcatccaccgagggccacgtggtctcccagacaggttcagtggcggtgagtttgggctagtagttttccnctcacatcagccgaccctanagagtagaagtntgttgtacttagtttacttcgtagtactagtactaattattaactacgtcgtcgtcggtccgttacggtaccggttccggacccggtaacggggtaaccgtaagggtaacgaaacgtaacgtaaaacgtacgtggtacggtcgtacgacctacctacgtccttcgtttaccttc

SEQ ID NO: 396443 - DNA, 623 bp, Homo sapiens
  misc_feature: GZ8MTXP02F29W1.21.27.C05.1.454.CMB.2.raw
  modified_base (355)..(355): a, c, t, g, unknown or other
  modified_base (419)..(419): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtgtcctgtcacagatacaaactacagcagtctggtccaggactgggtgacggcctcgcacgtaccctttcactcactgtgacatcgtacgggaaatcgtcgctggacaacaatggtagaattggattaggcacgtccccgtgaggtacgccttgagtggcgttggaagtactattactacgtccaggtcgtatgaanactatgacagtatctgtagagtcgtcgtctcacctatacccacccagactacgtacaacgtacncgtacgtcctaccctacctactaatcgtacttctacgacctaccccgaacgacctacgggtacttaacgttttagtttacgtacggtacgtaaacgggtagggtactaacctaacgtacgtttaccggtcggtaaaacctttcccgttaccgttacgtaccggttacccggtacggggtacccgttaacgggggtttaacccgg

SEQ ID NO: 396444 - DNA, 626 bp, Homo sapiens
  misc_feature: GZ8MTXP02H3R6I.21.27.C05.1.454.CMB.2.raw
  modified_base (347)..(347): a, c, t, g, unknown or other
  modified_base (364)..(364): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggcctcgcacgacctttcactcacctgtgactatcgtaccggggaaatgtcgctgacaacaatggttggaattggattaggcacgtccccgtcgagaggtccttgagtggtctaggagaccttatataacgtccagtcgtangaagactatgacgagtnttctgtgagcgttcgtacgtcaccgatccacccgataccgacttacgaacgaactcacggtcctccaccctaactaactcgtactcgttaccaccgtacccgacgaccgtacggcttaacggttttaattttgacggtacaaacgggttacgggtaactaccgtaacgttacgtttaaccggtcggttaaccttaacccgttaccgtttaacggacccgtttccggtaccgggggtacccttaaaacgggggtttaacccgg

SEQ ID NO: 396445 - DNA, 633 bp, Homo sapiens
  misc_feature: GZ8MTXP02FPX5V.21.27.C05.1.454.CMB.2.raw
  modified_base (159)..(159): a, c, t, g, unknown or other
  modified_base (169)..(169): a, c, t, g, unknown or other
  modified_base (222)..(222): a, c, t, g, unknown or other
  modified_base (255)..(255): a, c, t, g, unknown or other
  modified_base (555)..(555): a, c, t, g, unknown or other
  modified_base (583)..(583): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtntcctgtcacngatcaaactcagcagtctggtccaggactggtgaggccctgcagtaccctttnactcacctgtgacatcgtaccggggaaatgtcntggacaacaatggtgaattggattagggctagtccccgtcgaggacgtccgtttggacgtggctttagggaaacgggtacccttaagttacgtaaccgtcccgtaaggttgggttactagaaacgtacgtaattcggacctaagtacttccgtggtgtaacgtcgggttacgtccttacaaaccctctacccaacccaggaacccacgttaccaagtaacttcgaacgtcctccctacgtaccctaaatcgtctcggtaccaacgttccccgagacccaggtcctaggttttacttttgnacgtagtaggactcacgtacgtttcggntaaacctcgttccgttaacgccgttccgtcggggaccaacggggtttacg

SEQ ID NO: 396446 - DNA, 547 bp, Homo sapiens
  misc_feature: GZ8MTXP02I85IR.21.27.C05.1.454.CMB.2.raw
  modified_base (358)..(358): a, c, t, g, unknown or other
  modified_base (411)..(411): a, c, t, g, unknown or other
  modified_base (425)..(425): a, c, t, g, unknown or other
  modified_base (474)..(474): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaatggtggaattggattaggcagtccccgtcgagaggcttgagtggcttggaaggacctattatacgtcccagtggtactgagactatgcagnttctgtgagcgtcgtctcaccatcaccctagacacgtacaagaatcaaggtcnccctacacctaatntctcgtcacctacccgacgacacggctagtttatttgtacgtcgaaagngggactcgaactagttcggtagaccttaaccgtccttagacctccgtacgggggtacctagggtttaacccgg

SEQ ID NO: 396447 - DNA, 622 bp, Homo sapiens
  misc_feature: GZ8MTXP02G3DCN.21.27.C05.1.454.CMB.2.raw
  modified_base (202)..(202): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtctccagcccaccctgtctgtgtctccgaggggganccgcccaccctctcctgcactagccagtcagtctatcgctgactggttacgcctggtaccagcaagtaaactcgtcggccaggcctacccgaggcctccctactacgtttaccgtgccactccctaaccgacgggcctacgtcggtcgtacccgagacgtacggttcgaggtggcggtggtagtttgggactagttagtttctcctcactatccgacgccgtccctaagacgtagtacgagtagtcgttggattacgtttactttcgtacgtcctagtactaaattactaacgttaccgtgtcctgtacgttcgacggttccggcgtaaccgggacgtaagggtacgtaaaactaccgtaaaacgccttaaggtcggtaactacggtccgtaaacgtacttacttaccgttactttaccc

SEQ ID NO: 396448 - DNA, 664 bp, Homo sapiens
  misc_feature: GZ8MTXP02GBX06.21.27.C05.1.454.CMB.2.raw
  modified_base (202)..(202): a, c, t, g, unknown or other
  modified_base (316)..(316): a, c, t, g, unknown or other
  modified_base (432)..(432): a, c, t, g, unknown or other
  modified_base (460)..(460): a, c, t, g, unknown or other
  modified_base (649)..(649): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtcagtctatcgctgacttgggtacgccgtggtaccagcaagtaaatcgtcggccacggcctcccgaggcctccgtctacgtttacccgnaccactccccgaccgacggggccctacgttcgggtccgtaccccaagggtaccgtagggtttaccgagggtcggggacgggttggtagtttacggggactaggttacgtttttccnctaccacagtcacgccgaccctaagagngaagagtagtgttagtacttagtttacttacgtcgaccctaagtaaccttaaattaacgtttaaacttaccggtacggtaccgttcggtcggttaccgggtaccggttaccgggaccccgtaaacggggaaccggtaaaggggtaacggtaaaactacggaaaacgtacgtggtacgcgtacgactacngtactacgttcttac

SEQ ID NO: 396449 - DNA, 635 bp, Homo sapiens
  misc_feature: GZ8MTXP02GOUMK.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactgggtgacggcccctcgcacgtaccctttcactcacctgtcgacatcgtaccggggaaatggtcgctggcaacaatggttggaattggattaggcacgtcccgtgagaggcctgagtggcgtggaaggactattatacgtccagtcggtatgaagactatgactagtattctggtgtagcgtcgtctcacatccacccagacacgtaccaagactcaggtcctaccgtacctacctaaagttcgtactactcctaaccgtacccgaaccgaccgtaaccgggtacttaacggtttttatttttacggacgtaccgtaaaaggggtacgggtacttaaccgaacgttacgtttaccggtacggtaaacctttaacccgttccgtttaacgtacccgttaccggtaccggggtaccggtaaacggggttttaaaccccg

SEQ ID NO: 396450 - DNA, 591 bp, Homo sapiens
  misc_feature: GZ8MTXP02G7GXM.21.27.C05.1.454.CMB.2.raw
  modified_base (159)..(159): a, c, t, g, unknown or other
  modified_base (347)..(347): a, c, t, g, unknown or other
  modified_base (451)..(451): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtntcctgtcacagatcaaactacagcagtctggtccaggactggtgacggccctcgcagtaccctttcactcacctgtcgacatccgtaccggggaaatgtcgctggcaacatggtgaatgattaggcagtcccgtgagagctgagtgctggaagtactatatacgccgtagtgtatagaatactatganagtattcgtgtgagcggtacgtctacgacactccacccaggaccacgtacaagactcgtacgcctcctacctactaaatcgtactcgtaccaccgtacccgaanaccgtaccggtacttaacgttttattttggaccgtagtaaaacgggacggtaaactcgtaacgttacgttaccggtacgtaacccttaacgttccttacggtacgtaccggtcggggtacccgtacggggttttaacccg

SEQ ID NO: 396451 - DNA, 613 bp, Homo sapiens
  misc_feature: GZ8MTXP02HV4VN.21.27.C05.1.454.CMB.2.raw
  modified_base (202)..(202): a, c, t, g, unknown or other
  modified_base (239)..(239): a, c, t, g, unknown or other
  modified_base (298)..(298): a, c, t, g, unknown or other
  modified_base (411)..(411): a, c, t, g, unknown or other
  modified_base (420)..(420): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggncgccaccctctcctgccacagccagtcagtctatcgntgactggtagcctggtaccagcagaaatctggccaggctccagctcctctatttaccgngcactcccaccgacgggccacgtggtcgtcccgagactacgggttcagggttcgggcggttggtagtttggggactaggttacgttttctcctacacatcacgtccgccctanagagtgaanacttgtgcttagtttatttctcggacctagtactaaattattaaacttcgtacggtccctgtccggttacgaaccgggtttccggacccggtaaccggggaaacctaaggggtaaacgaaaacgttaaacgaaaacggtaactagggtacggtaacgtacggacctaacgtacttcgttacgtttcttacccg

SEQ ID NO: 396452 - DNA, 604 bp, Homo sapiens
  misc_feature: GZ8MTXP02HS04K.21.27.C05.1.454.CMB.2.raw
  modified_base (204)..(204): a, c, t, g, unknown or other
  modified_base (261)..(261): a, c, t, g, unknown or other
  modified_base (311)..(311): a, c, t, g, unknown or other
  modified_base (422)..(422): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctctctgcacagccagtcagtctatcgctgacgtggttagcctggtaccngacagaaatcgtggccaggcctcccgaggcctcccttctactttacccgngaccactcccacccgaggggccctacgtggtcgtaccccgaggacgtacggttcgaggtcggggcgggttggtaggtttggggactaggttagttttcctctacaccatcncgccgaccctagagagtgaagtatgttgctttagtttactttctcggtacctagactaattaattagttacgcgtctcgtcgttacggtcgttcgggaccgacgggaccgtaagggtacggtaaacaacgaaaacgtacgttcggtacggtcgtgacgtacccagttcgtcgtttcctttac

SEQ ID NO: 396453 - DNA, 668 bp, Homo sapiens
  misc_feature: GZ8MTXP02J23KZ.21.27.C05.1.454.CMB.2.raw
  modified_base (204)..(204): a, c, t, g, unknown or other
  modified_base (222)..(222): a, c, t, g, unknown or other
  modified_base (249)..(249): a, c, t, g, unknown or other
  modified_base (435)..(435): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccctaccctctccgngacacacgcctagtcagtctagtcgtntgtacgttggtacgccgtacggaccagacaagtaactcgcggccgacggtccctaccgacgtccttcctactacgtttaccgcacctaccgtcccgaccgacggtcctacgtcggtccgtaccgagtacgtacggtcgagggtcgggtacggttaggtacggttacgggacgtgtttacgtttccncgtacctacgtactcgacgtacccgtacctaagtaggtaacgtagtaagtagttcgttacgtacgtttagtttacgttcgtacgtactaagtacttaaattaacttaacgttcgtcggtaccgtcggtaccggttaccggtaccggtaccggaccggtaaccgggaacgaaacggtaaacgaaactaacgaacgtacgtaggtacgcgtacgactacctagtcgtactctacg

SEQ ID NO: 396454 - DNA, 574 bp, Homo sapiens
  misc_feature: GZ8MTXP02GUIES.21.27.C05.1.454.CMB.2.raw
  modified_base (377)..(377): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcacgaccctttcactcacctgtgacatcgtaccggggaaatgtcgctggcaacaatggtgaattggattaggcagtccccgtgagaggtcctgagtgcttggagactattactacgtccagtgtatgaagctatgcagattctgtgagtcggtcgtctcgaccntaccacccagacaccgtacaaagactcgaacgtcctccctacacctaatcgtctcgtaccacctcccgaacgacgacggtacttgtttaacgtttgcgtacgtaaggaggtacctacgacgttacgtccggttagtacccgtaaccgttccgttacgtaccgttaccgggtcgggacccgtaacgggtttaacccgg

SEQ ID NO: 396455 - DNA, 552 bp, Homo sapiens
  misc_feature: GZ8MTXP02G3AQ1.21.27.C05.1.454.CMB.2.raw
  modified_base (326)..(326): a, c, t, g, unknown or other
  modified_base (357)..(357): a, c, t, g, unknown or other
  modified_base (474)..(474): a, c, t, g, unknown or other
  modified_base (495)..(495): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtgagaggccttgagtggcttggagacctattntacgtcccagtggtatgaagactatgcagtnttctgtgagcggtcgtctcaccatccaccccagtaccacgtaccaaagaatcaacggtcctccctaccaccttaatcgtctgttcactcccgacgacacggctacgtttattttcgntacgaagtagggatcgaactnttaccggtgtacctaaccgttaccttcgactccggtcgggaccaggggtttaacccg

SEQ ID NO: 396456 - DNA, 708 bp, Homo sapiens
  misc_feature: GZ8MTXP02IIJW9.21.27.C05.1.454.CMB.2.raw
  modified_base (541)..(541): a, c, t, g, unknown or other
tcagtcgtcgctcgcacgaccggtgctcgatttagacgcgatcgaagggtttgggggcagagcctgctgacttctggctgaccagggcagtcaccggagctccagacaaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaatgtcgctggcaacaagtggttgaatggattaggcctacgtccccgtcgaggacggtccttaggaggtggccgttgggaaacggtacccttaagttaacgtaccggtacccctaaggttcggtactaggaaacgtacctaagtagaccgtaagtagtttccgttaggtacggtacgtccggggttcgtcctaccgaaccctatacccaaacccccgaggaaccctaaaccgtacccgaaagtaactcgaacggttaccctcccgtacctaaaccttaaatcgtttaccncgttaccacccgtacccgacgaccgtacggtcgttaagtttttactttaggacgtaacgtaaagggacggtacttaaccgtaacgtacgtttaccggtcgtaaaccttcccgttaaccgttcgtacccgttaccggtacggggtacccgttaaggggtttaacccgg

SEQ ID NO: 396457 - DNA, 544 bp, Homo sapiens
  misc_feature: GZ8MTXP02HDK6T.21.27.C05.1.454.CMB.2.raw
  modified_base (359)..(359): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactgggtgaggccctcgcagaccctttcactcacctgtgacatctccggggaaatgtcgctggcaacaatggttggaattggattaggcagtccccgtcgagaggccttgagtggcttggaaggacctattatacgtcccagtggtatgaagctaatgcagnttctagtgagcgtcgtctcaccatcaccccacgacacgtacaacgaactacacggtctaccctcctaccctaatcgtactctacactcccgacgaccacgcagtttattttgtagtcagagggactcaacgacttcggtgtaccgtaacctcttacgactaccgtcgggaccgtacgggtaaccg

SEQ ID NO: 396458 - DNA, 752 bp, Homo sapiens
  misc_feature: GZ8MTXP02HDMXK.21.27.C05.1.454.CMB.2.raw
  modified_base (203)..(203): a, c, t, g, unknown or other
  modified_base (465)..(465): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacnccgccaccctctcctgcacacgccagtcagtctagtcgctgacgttggtacgccgtaggtaccagacaagtaactcgtacggaccgacggcctacccgacggtcccttaccctacttacgtttacccggcgacctaaccgtaccccgaaccggtaccgggccctacggttcgggtaccgtacccgaaggtacgtacgggttacgaggggtcgggtcgggttaggtacggtttacggggacgttacgggtttacgttttaccnccgtaccgacctacgtacccgacgtacccgtaacccgtaacgaggtaacggtagtaaagtagttcggtttacgtacgtttagttttacttcgtacgtacctaagtaacttaaattacgttaacgttaccgtcggtaccgttcggtaccggttaccggtaccgggttaccgggaacccggtaaaccggggtaaccgtaaaggggtaacgtaaaacgttaaccggaaaaccgtacgttacgggtacgtaaccgtacgaacctacgtacgttaccgttacgttacctacg

SEQ ID NO: 396459 - DNA, 681 bp, Homo sapiens
  misc_feature: GZ8MTXP02G97JV.21.27.C05.1.454.CMB.2.raw
  modified_base (202)..(202): a, c, t, g, unknown or other
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggacnccgccaccctctcctgcacagccagtcagtctatcgctgacgttggttacgccgtggtaccagacaagaactcgtggaccacggcctcccgaggcctcctctacgtttaccgtgcactcccacgacgggccacgtcggtcgtccagacgtacggttcgaggtcgggtacggttggtaggtttcgggacgtagttacgttttcctcctaccaactacgtccgacgcccgtaccctacgaggtacggtacgaagtagttggttacgtacgttagtttactttcgtacgtacctacggtacctaaagttacttaaacgttaccggtaccgttacggtccggttacggtaccggttaccgggtacccggaaccgggtaaccggtaaacgggtaacgggtaaaacgttaaacgaaaaccggtaaacgttacggtacgggtacgtcgtacgtaaccgtacgttacgtaccgtttactaccgtacg

SEQ ID NO: 396460 - DNA, 876 bp, Homo sapiens
  misc_feature: GZ8MTXP02GOEUT.21.27.C05.1.454.CMB.2.raw
  modified_base (201)..(201): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgaggggggcnccgcctcctcctcgcgacaacgccacgtacgtacgtcgttactcgtccgtacgtacgttacggtttaggtacccgtcggttaaccgacgacgaacgtaaacgtacgtcggaccgacggtaccgtccccgtaaccggtcctaccccgtttacctaaccgtttaaccggtttccgacgtaacctaccccgtaccccgaaccgggtaccccggaacccgttacggttccggttaccccgaaccggtaaccggtacggggtttactacggggtacggggtccggggtacgggtttaggtttacggggtacggtaacggtttacggggtttttaccttccgtacccgtaccctaaccgttacgaccgggtacccgtaccccctaagtaaaggtaaggtaggaaacggtaagtttggttttaccggtagttaaacggttttttaacttcgttaccggtacccaaaggtaacgtttaaaactttaaattaaaacgtttccgttacgggacccccttgggtacccgggttacccgtaaaccggggtttccggaacccggtttaaacccgggggaacgtaaaacggggtaggttaaaaccaacgttaaaaccgggaccgttaggtcgggacctacgtaacgtacccgtaatttccgacggtttacctaccgtactttcccccgg

SEQ ID NO: 396461 - DNA, 636 bp, Homo sapiens
  misc_feature: GZ8MTXP02ICYR9.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtgtcctgtcacagatacaaactacagcagtctggtccaggactgggtgacggccctcgcacgtaccctttcactcacctgtgactagtccgtaccggggaaatgtcgctggacaacagtggtgaatggattaggctacgtcccgtagagtaggcctaggagtggcgtaggaaggtacctattactacgtccagtaggtactagaacgactatgactagattcgtagtaggagcggtcgtctaccaccgatcccaacccagaaccacgtaccaaagactcgtaacggtccctccctaccgacttaactcgtcctagacctacccgtacccgacgaccgtacgtactttaagttttacgttttcgaacggttaccaaaggtacgggtaactaaccgtacgttacgtttacggtaaccgttacctaacccgtttccgtacggtacccttaccggtcgggtacccgtaaggggtttaacccg

SEQ ID NO: 396462 - DNA, 680 bp, Homo sapiens
  misc_feature: GZ8MTXP02G5XLM.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgagggggganccgccaccctctcctgcacagccagtcagtctatcgctgactggttagcctggtaccagcaagaaatcgtcggccacggcctccgacggcctcctctactttaccgtgcactcccaccgacggggcctacgtcggtcgtacccaggtacacggttcgaggtcgggcgggtagggtagtttaggggacgtagttacgttttccgtcctacctaacctatccacgcccgtacccctaagacggtaagtagtaaaagtgttggttagtacttagttttatttctacggtacctaagtaacctaaatttaacgttaaactttaccgtggttaccgttacggtaccggtaccggttaccgggtttcccgggaacccggtaaaccggggtaaacccggtaaagggtacggtaaaacgtaacgtaaaacgaacgtacggttacggaacgttcgaccggtacctacgtcgttacgtctttaccg

SEQ ID NO: 396463 - DNA, 602 bp, Homo sapiens
  misc_feature: GZ8MTXP02IKEWT.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctcccttcctcatcttcctgcccgtgctgggcctcccatggggtgtcctgtcacagatcaaactacagcagtctggtccaggactgggtgacggcccctcgcacgaccccttttcactcacctgtgactagtcgtaccggggaaatcgtcgctggacaacaatggtaggattggattaggcacgtcccgtgagagcctgagtggctggagtactatataccgtccagtggtactagaagtactatgacagtattcgtagtggacgtccggtcgtctacgacctatcccacccgagaacctaccgtaccaaagtactaccgtaggtccctccctacctaacccttaaagtcgtacctcggtaccacctacccgacgacgacgtcttagttttatttgacgtacgaaggaggactacgactacgttcggtactaaccgtaaccgttcgttacgaccgttccggtacgggtaccggacgggtttaaccg

SEQ ID NO: 396464 - DNA, 714 bp, Homo sapiens
  misc_feature: GZ8MTXP02F1Z5U.21.27.C05.1.454.CMB.2.raw
  modified_base (201)..(201): a, c, t, g, unknown or other
  modified_base (252)..(252): a, c, t, g, unknown or other
  modified_base (313)..(313): a, c, t, g, unknown or other
  modified_base (330)..(330): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggnccgcccaccctctcctgccaccgccagtcagtctatcgctgactggttacnccgtggtaccagacaagaaatcgtcggccaggcctcccgaggcctcctctacgtttaccgngtactacgtcccaccgngggaccctacgttcgggtcctacccgagaaccgtacggtttacccgagggttcggggacggtttacggtaggttttacggggaacttagggtttacgttttccaccgttacccaccgttaagtccgaccggtcccgtaccccttaaagaaggtaagttaggaaaacgttagttcggttacgtacgtttaagttttaactccgtcgtaaccgtaagtaaccttaaagttaacttaacggttacgtacccgggtcttacggggtcccgttacggtaaccggttccgggaaccgaacgggtaaccgtaaggtacgtaaaactaaccgaaaacgtcgtacggtcgtacgtaacgtcctaaccgtgtaccgttactcgttacttacccg

SEQ ID NO: 396465 - DNA, 581 bp, Homo sapiens
  misc_feature: GZ8MTXP02F98MR.21.27.C05.1.454.CMB.2.raw
  modified_base (445)..(445): a, c, t, g, unknown or other
  modified_base (523)..(523): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatcgtaccggggaaaatgtcgctggcaacaatggttggaattggattaggcagtccccgtgagaggccttgagtggctggaaggacctattatacgtccagtggtatgaagactatgcagtattctgtagagtcggtcgtctcaaccataccaccccagaacacgtaccaaagaatcacggtacctccctaccaacctaatcgtactntaccacctccccgacacgacggtactagttttattttggacacgaagtagggacttaccaactacgttaccgggttanacccttaaccgttcccgtaggtaccctccggttacggggaccctaggggtttaaaccg

SEQ ID NO: 396466 - DNA, 571 bp, Homo sapiens
  misc_feature: GZ8MTXP02F9IL9.21.27.C05.1.454.CMB.2.raw
  modified_base (203)..(203): a, c, t, g, unknown or other
  modified_base (304)..(304): a, c, t, g, unknown or other
  modified_base (387)..(387): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggtagcctggtaccagcagaaatctggccaggcctcccgaggcctcctctactttaccgngccactcccaccgacgggccacgtggtctcccagactacggttcaggtcgggcggtggtagtttggggactagtacgttttcnctcacatcacgcgtaccctagacgagtagaagcttgttgtactagtttattcgtcgtccagtactaaattattaattacgtcggtctcggtaccgtcgtaccggttccggaccgtacgggaccgtaagggtacgaaacgtacgaaaacgtacgtgttacgcgtcgacacgattctcgtcttacg

SEQ ID NO: 396467 - DNA, 857 bp, Homo sapiens
  misc_feature: GZ8MTXP02HYXYP.21.27.C05.1.454.CMB.2.raw
  modified_base (331)..(331): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtctccagccacctgtctgtgtctccggaggggggacccgccaccctctcctgccacacgccagtcagttctagtcgctgacgtggttacgcctaggtaccagacaagaaactcgtcggaccacgggtcctacccgacggtccttccctcttaacgttttacccgngtaccaactccccgaaccggacgggaccctacgttcggtccgtaccccgagtacgtacggttcgaacggtggggacggttgggtagtttcggggacgtaggttacgtttttccaccgttaccgtaacctacgtaccgacgtacccgtaccccgttaaacgacgggtacggtaacggtaaaagtacgttttacggttacggttacgtttaacggggtttttaaccttttacggttaccgtaacccgttaacggttaaaacctttaaaatttaaaaccggttttaaaacgtttaaccggtttacccgggtcccggtttacggtacccggggttttaacccgggtttaccccgggtttaccccgggggaaaaccccggtaaacccggggggtaaaacccggtttaaaacgggggttaaacggggtaaaaaccttaaaacccggtaaaacggttaccgtttacggggtacggtaacccggtacgtaacccgtaccttaaccggtttcctttaccggtttactttaccccg

SEQ ID NO: 396468 - DNA, 589 bp, Homo sapiens
  misc_feature: GZ8MTXP02ILUEL.21.27.C05.1.454.CMB.2.raw
  modified_base (238)..(238): a, c, t, g, unknown or other
  modified_base (351)..(351): a, c, t, g, unknown or other
  modified_base (356)..(356): a, c, t, g, unknown or other
  modified_base (362)..(362): a, c, t, g, unknown or other
  modified_base (367)..(367): a, c, t, g, unknown or other
  modified_base (369)..(369): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtctggtccaggactggtgaggccctgcagtaccctttcactcacctgtganatcgtaccggggaaatcgtcgctggcaacaagtggtaggaattggattaggctagtccccgtgagagccttgagtggctggaagtactattacgacgtccagtggtatagaanactangcagtntctgngngtacgtcgtctcgacctctccacccagtacacgtaccaaagaactcgacgtcctcccgtacaacctaatcgtctcgtaccaccgtcccgaacgaccgtacgtcttacgtttattttacgacgtactaaacgggtaggtacgtacacgttaacgttccgggtaactaccttaaccgttcgttacgtacccgtacggtccggggtaccggtagggttacccg

SEQ ID NO: 396469 - DNA, 701 bp, Homo sapiens
  misc_feature: GZ8MTXP02FUG5K.21.27.C05.1.454.CMB.2.raw
  modified_base (205)..(205): a, c, t, g, unknown or other
  modified_base (319)..(319): a, c, t, g, unknown or other
  modified_base (424)..(424): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtcctccagcccaccctgtctgtgtctccgagggggacnccgcccaccctctcctgccacagccagtcagtctatcgctgacttggtacgccgtaggtaccagcaaagaaactcgtcggccacggcctcccgagtcctcctctactttaccgngccactcccgaccgacgggccctacgtcggtccgtacccgaaggtacgtacggttcgaggtcgggtacggttggtagtttaggggacgtaggttacgtttttccncctacctaacgtactccgacgcccgtaccctagaggagtagtaaagagttgttacgttacgtttagttttacgtttcgtacgaccgtaacgtaacttaaatttaaagttaacgtttaccgtcggtccgtcgggttccgttaccgggtacccggttaccgggacccggtaaaaccggggtaaccgggtaaacgggttaaacggtaaaactaaacggtaaaaccggtacgtaggttacggcttacgacctaccgttatccggtttacgttctttacccg

SEQ ID NO: 396470 - DNA, 729 bp, Homo sapiens
  misc_feature: GZ8MTXP02GA9WE.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactgggtgacggccctcgcacgtaccctttcactcacctgtgacatcgtaccggggaaatgtcgctggacaacgaagtggtaggaattggattaggcacgtccccgtcgaggacggtccttggagtggtcgttagggaacggtacctattacgtaccgtcccaggtaggtacgtagaaagtactagtacgctaagtcttcgtacgtggagtccgggttcgtccgttaccaacccgtacgttaccccgacccccaaggaaccctaacccggttaaccccaaagtaaacgtaccgtaaccgggttacccccttaccccgtacccctaaccttaaacgttcgttaccgttaccgttaccctaccccgtacccccgaaccggtaacccgtacccgggttactttaacggttttactttttcgggacgtaccggtaaaggtacgggtactacgtaacgtacgtttaccggtacgttaccgttaacccgttccgttacggtaccttccggtacggggtaccgtaacgggtttaaccgg

SEQ ID NO: 396471 - DNA, 711 bp, Homo sapiens
  misc_feature: GZ8MTXP02JJSQD.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcacgtaccctttcactcacctgtagactatccgtacggggaaatgtcgctggcaacaagtggtagaatggagttacggctacgtcccgtgagacgtcttgagtgtcgtaggaagactatactacgtccagtggtactagagtattagtgacagtatttcgtaggtgtacggtcggttacgtaccgtcctaacccgtaacgttaccccgaacccccgtaacggtaccctaaaccgggtacccaaaacggtaaacgtacccgtaaccgggttaccccttaacccccgttaacccctaaacccgttaaacgttccggttaccgttacgtacccgtaaccccgttacccccggaaaccggtaacccgtaaccgggtactttaacggtttttacgttttacggacgttaacggaaaggtacggtactacgtaactacgttcggtaactacccttaaccgtcgttacgaccgttaccggtcggggtacgtaacgggtttaccg

SEQ ID NO: 396472 - DNA, 780 bp, Homo sapiens
  misc_feature: GZ8MTXP02GUTEN.21.27.C05.1.454.CMB.2.raw
  modified_base (201)..(201): a, c, t, g, unknown or other
  modified_base (238)..(238): a, c, t, g, unknown or other
  modified_base (319)..(319): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtctccagccacctgtctgtgtctccgagggggacnccgccaccctctcctgcacagccagtcagtctatcgntgacttggtacgcctaggtaccagacaagtaaatcgtggaccacggcctcccgaggtcctaccctccttacgtttacccgngtaccctacgtaccccgaaccgacgggccctacggttcggtcgtaccccaggaacctcgggttactacgggtcggggtaccgggttgggttaacggtttacggggaccgttaggtttacgtttttacccgtacccgtttaccgaacccttacgtacccgaaacgtcccgtacccccgttaagaacgggttaggtaacgtaaacggttagttacgggtttacgttaacccgtttaggtttttactttaccgtacggtaacccgtaaaggtaactttaaaacgtttacgtttaaaaccgttacggttcgggtaccgttacgggtcccgttaccgggttaaccgggttacccgggacccggtaaaccggggtaaccgtaaagggtaaacggtaaactaaccggtaaaaccggtaacgtcggttacggaaccttgaacccgtactacgttcgttacgttacttcc

SEQ ID NO: 396473 - DNA, 657 bp, Homo sapiens
  misc_feature: GZ8MTXP02FHJ8W.21.27.C05.1.454.CMB.2.raw
  modified_base (359)..(359): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgacggccctcgcagaccctttcactcacctgtgacatcgtaccggggaaatgtcgctggacaacaatggtggaattggattaggcagtccccgtgagaggccttgagtggcttggaaggacctattatacgtccagtggtatagagactatgcagtntctgtgagcggtcgtctcacactccacccagacaccgtacaagaactcgacggtccctacccgtacctaaaccctaatcggttactacgttaccaacccgtaccccgtaaacggtaacccaccgggttacttaacggtttttagtttttacggtaacgtaccgtaaaagggacggggtaactacccgtaaacgtaccgtttacgggtaccgttaacccgtttaaccccgttaccctttacggtaaacccggtttcccggtacgggggtaaccccggtaacgggggttttaaaccccgg

SEQ ID NO: 396474 - DNA, 602 bp, Homo sapiens
  misc_feature: GZ8MTXP02IYFZF.21.27.C05.1.454.CMB.2.raw
  modified_base (256)..(256): a, c, t, g, unknown or other
  modified_base (291)..(291): a, c, t, g, unknown or other
  modified_base (479)..(479): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgaggccctcgcacgccctttcactcacctgtgacatcgtaccgggaaatgtcgntgcaacatggtgaattggatagcacgcccgtgagngctgagtgcgtggagtactatactacgtccagtgtactagaagtactatgactagtattcgtgtggtagcggtcgtctcgacctagtcccaccccgagaccaccgtaccaaagtaactccgtaacgggtccctaccctacctacccgttaaatccggtctaccgtacctaccctacccgacggtaacncgggtacttacgttttatttaggcgtacgaacggtagggtactacacgttacgttacggtactacccgttaaccgttccgttacgtaccgtccggttacggggacccttaaggggtttaaccg

SEQ ID NO: 396475 - DNA, 652 bp, Homo sapiens
  misc_feature: GZ8MTXP02HO9I5.21.27.C05.1.454.CMB.2.raw
  modified_base (223)..(223): a, c, t, g, unknown or other
  modified_base (324)..(324): a, c, t, g, unknown or other
  modified_base (343)..(343): a, c, t, g, unknown or other
  modified_base (355)..(355): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtgtcctgtcacagatcaaactacagcagtctggtccaggactggtgaggccctggcagaccctttnactcacctgtgactatcgtaccggggaaatgtcgctggcaacatggtgaatggattaggcagtccccgtgagaggcctgagtggcgttggaagactattanacgtccagtggtatagaanactatgacagtnttcgtgtgagtcggtcgtactcacctatcccaacccaagaccacgtaccaaagaactacaaccggtccctaccctacctaaacccttaaagtcgtttaccgtacgttacccaacccgttacccccgaaacgtaacccgaaaccgggtacctttaaggtttttaacgtttttcgtaacggaccttaaaaggggacggggtactaccgtaacgtaacgttaccgggtacgtaacctaacccgttaccgttacggtaacccgttccggtacggggtacccgtaaaacggggtttacccgg

SEQ ID NO: 396476 - DNA, 647 bp, Homo sapiens
  misc_feature: GZ8MTXP02INGJV.21.27.C05.1.454.CMB.2.raw
  modified_base (204)..(204): a, c, t, g, unknown or other
  modified_base (214)..(214): a, c, t, g, unknown or other
  modified_base (240)..(240): a, c, t, g, unknown or other
  modified_base (306)..(306): a, c, t, g, unknown or other
  modified_base (402)..(402): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgccaccctntcatgcacagccagtcagtctatcgntgacttggttagcctggtaccagcagaatcgtggccaggcctcccaggcctcctctactttaccgngcatccccaccgacgggccacgtcggtccgtacccgagtacccgtagggttcagggtgggcggttaggtatttgggggactaggtacgtttttccnccgttacacctatcgagcccgtaccctaacgaggtaagtagaaagtagttgttacgacttagttttactttcgtacgtaccgtaagtacctaaagttaacttaaacgtttacgtcggtaccttcggtaccgttaccggtacggtttcccggacccggtacggggaaaccgtaaagggtacggaaaacgtaacgaaaacggtactaggtaacggacgtacggaccaacctacgttctacgtttacc

SEQ ID NO: 396477 - DNA, 682 bp, Homo sapiens
  misc_feature: GZ8MTXP02HN9R9.21.27.C05.1.454.CMB.2.raw
  modified_base (204)..(204): a, c, t, g, unknown or other
  modified_base (242)..(242): a, c, t, g, unknown or other
  modified_base (413)..(413): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgcccaccctctcctgccacagccagtcagtctatcgntgactggttagcctggtaccagcagaaatctggccaggcctcccgaggtcctcctctactttacccgtgcctaactcccgaaccgacggggtccacgttcgggtcgtccccaaggtacgtacgggttcgaggttgggcgggtggtacgtttcggggactagtagttttccncttaccgaccatccacgccgtaccccgtaagagtacgtagaaagttagttcgtttagcgttagttttaactttctcggacctaaggtacctaaagttaattaaagtttaccgtaggtaccttggtaccggtaccggttaacggttccgggaaccccggaacggggtaacccgtaaaggggtaacggtaaaacgttaccgaaaaaccggtacgttcgggtacggtaaccctaggaccctactacggttcctttacggtttcctttaaccg

SEQ ID NO: 396478 - DNA, 752 bp, Homo sapiens
  misc_feature: GZ8MTXP02FRSG2.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgcccaccctctcctgaccacacgccagtcagttctactcgctgtacgttggtacgtccgtacggtaccagacaagtaactcgtcggaccgacggcctaccgacgtccttccctacttacgtttaccgtcgacctacctacccgaaccgaccgggtacctacggtcggtccgaccgacggtacgtacggttacgaggtcgggtcgggttaggttacggtttacggggacgttacggtttacgttttacctacctacctaaccgtacgtaccgacgtacccgacccgtaacgaaggtaggtaagtaacgttagtttcgttacgtacgtttagttttacttccgtacgaacctacgtaacttaaagtttaaacgttaacgtttaccgtacggtccgtcgggttaccggtaccggttaccggttacccgggaacccggtaaaccggggtaaacggtaaaacgggttaaacgaaaacgttaaaccggtaaaacgtacgtacgggtacgtaacgtaccgaccgtaacttacgttacttaccgttaccttacg

SEQ ID NO: 396479 - DNA, 559 bp, Homo sapiens
  misc_feature: GZ8MTXP02F65YZ.21.27.C05.1.454.CMB.2.raw
  modified_base (202)..(202): a, c, t, g, unknown or other
  modified_base (216)..(216): a, c, t, g, unknown or other
  modified_base (222)..(222): a, c, t, g, unknown or other
  modified_base (249)..(249): a, c, t, g, unknown or other
  modified_base (269)..(269): a, c, t, g, unknown or other
  modified_base (298)..(298): a, c, t, g, unknown or other
  modified_base (307)..(307): a, c, t, g, unknown or other
  modified_base (365)..(365): a, c, t, g, unknown or other
  modified_base (378)..(378): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccacctctccngccacngccagtcagtctatcgctgactggtancctggtaccagcaagaatcnggccaggctcccgagcctctcatttccgncatccaccngggccagtggcgtcccagacaggtcaggtggcggttggatttggggctagtagtttcnctcacatcagccnccctagagagtgaaagtactgttgcttagtttattcctgccaagtctaaattacttaaattacgcggtctagtacggtcgtacggttccggaccgtacggggaccggaaaggttacggaaaactacgaaaaacggtacgtggttaacggctacgacctaaccgattccgtagttccttacg

SEQ ID NO: 396480 - DNA, 723 bp, Homo sapiens
  misc_feature: GZ8MTXP02HL9TF.21.27.C05.1.454.CMB.2.raw
  modified_base (204)..(204): a, c, t, g, unknown or other
  modified_base (252)..(252): a, c, t, g, unknown or other
  modified_base (273)..(273): a, c, t, g, unknown or other
  modified_base (299)..(299): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtcctccagcccaccctgtctgtgtctccgaggggganccgccaccctctcctgcacagccagtcagtctatcgctgactggttancctggtaccagcaagaaatcnggccaggcctccccaggtcctccctntactttaccgtgcactcccacgacgggccacgtcgggtctaccccgagtcaacgggttccagggttcggggcgggttagggtagttttacggggctaggtttacggtttttccctacgttcctaaacccgattacccgaacggttcccgacccccgttaacgaagggaagttaggaaaggtattgggttacgtaccgtttagttttaactttccgttacgacccgtaagttaactaaaactttaaagtttaaacgttacgtcggtcccgtttagggacgtttccggtaacggggttttaccgggacccgttaaaacgggggaaacccgtaaagggttaccgggaaaaacttaccgaaaaaccgtaacgttggtacggaaccgttaacgccgtaaacccgtatttcccggttaactccgtttaac

SEQ ID NO: 396481 - DNA, 620 bp, Homo sapiens
  misc_feature: GZ8MTXP02JM2OC.21.27.C05.1.454.CMB.2.raw
  modified_base (199)..(199): a, c, t, g, unknown or other
  modified_base (209)..(209): a, c, t, g, unknown or other
  modified_base (244)..(244): a, c, t, g, unknown or other
  modified_base (252)..(252): a, c, t, g, unknown or other
  modified_base (294)..(294): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtctccagccacctgtctgtgtctccgagggggncgccaccctntcctgcacagccagtcagtctatcgctgactgtanctggaccngcagaatctggccaggcctcccaggcctcctctatttaccgngcactccacgacgggccacgtgggtctccccagtacctacgggtttccaaggttcgggccggttagggtaagttttcggggacctaagggttcgttttcctcgtacctacccgaattccgaacgtcccgaccccttagaagtagttagaaaagtctgggtttacgacttaggttttactttcgcgacctagtactaaattagtaaaacttcgtggccttgaccgttcgacgttcggaccgtacgggaaccgtagggtacggaaaattaccgaaaacgtaaccgttgacggaactacggaccgtactacgtccttcggtactttccg

SEQ ID NO: 396482 - DNA, 727 bp, Homo sapiens
  misc_feature: GZ8MTXP02GC5WG.21.27.C05.1.454.CMB.2.raw
  modified_base (204)..(204): a, c, t, g, unknown or other
  modified_base (245)..(245): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccacctctcctgaccacacgcagtctagtctacgtcgntgtacgttggtacgtcgtcggtacagacaagtaacgtcgcggaccgacggcctacccgacggtcctacctacgttacgtttaccgtcgacctaccgtacccgaaccggacgggtccctacggttcggtaccgtaccgaacgtacgtaccggtacgtacgggtcgggtcgggttaggttacggtttacggggtacgttacggtttacgtttccgtcctacctaacgtcgtacgaccgtaccctaccgtaagtaaggtagtaagtaagttcgttagttacgtactttacgtttacttaccgtacgactaagtacttaaattaacgttaacgttccgtcggtaccgttcggtaccggttacggtaccggtaccgggaaccggtaaaccgggtaaacggtaaaggttaaacggaaaacgtaaacgaaaccggttaacgtggtacggtaacgtacgaaccgtacttacgttcgttacgttacttacg

SEQ ID NO: 396483 - DNA, 712 bp, Homo sapiens
  misc_feature: GZ8MTXP02HK9JE.21.27.C05.1.454.CMB.2.raw
  modified_base (200)..(200): a, c, t, g, unknown or other
  modified_base (301)..(301): a, c, t, g, unknown or other
  modified_base (536)..(536): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctcgagggggancgccacctctctgcacagccagtcagtctatcgctgactggtagcctggtaccagcagtaatctcggccaggcctacccgaggcctcctctactttaccgngctactccgaccgacgggccacgttcggtactcccaggtactcggttcaggtgggtcgggttaggtgtttacgggctaggttacgttttccaccgttacacctaatccgaaccggtccctaacccccttagaacggtagttagaaaagtgttagggtttacgaccgtttaaagtttttcgttttccgacggtaccctaaggttaaccttaaaattaacgtttaaacgtttaccgngggttacccgtaggtaccggttaccggtaccgggtttaccgggaacccggtaaccggggtaaacccgtaaagggggtaaccggtaaaacgtaaccggtaaaaaccggtaccgtttaagggtacggtaaccgttacggaccctaaccgtactttccgtaccggtttacctttacccg

SEQ ID NO: 396484 - DNA, 678 bp, Homo sapiens
  misc_feature: GZ8MTXP02GAY2T.21.27.C05.1.454.CMB.2.raw
  modified_base (462)..(462): a, c, t, g, unknown or other
tcagtcgtcgctcgcacgaccggtgctcgatttagacgcgatcgaagggtttgggggcagagcctgctgacttctggctgaccagggcagtcaccggagctccagacaatttctgtctccttcctcatcttcctgcccgtgctgggcctcccatggggtgtcctgtcacagatacaaactacagcagtctggtccaggactggtgacggccctcgccacgtaccctttcacctcacctgtcgacatcgtaccggggaaatcgtacgctggacaacaagtggttaggaagttggtattaggcacggtccccgtacgaggacggtccgttggaggtggtcgttagggaacggtaccttaagttacgttaccgttaccccgaggtaggttactaggaaagtacgtatacgactagtacttcgtggtggtacggtccggtcgtcgtccacctactcccaaacccgngaaccacgttaccaaagactacgacgtcctacccaccgtaaacctacgtcgtacctcgtaccctaccgtaccccgaacgtaccgtacgtacgtttaacgtttttacgttttacgcgtaaccgtaaaggtacgggtataccgaacttaggttccgtaacgtccttacccgtcttacgtaccttcggggtacggaccgttaaacgggggtctttaccg

SEQ ID NO: 396485 - DNA, 597 bp, Homo sapiens
  misc_feature: GZ8MTXP02FT6FZ.21.27.C05.1.454.CMB.2.raw
  modified_base (385)..(385): a, c, t, g, unknown or other
  modified_base (390)..(390): a, c, t, g, unknown or other
  modified_base (394)..(394): a, c, t, g, unknown or other
  modified_base (400)..(400): a, c, t, g, unknown or other
  modified_base (406)..(406): a, c, t, g, unknown or other
  modified_base (438)..(438): a, c, t, g, unknown or other
  modified_base (453)..(453): a, c, t, g, unknown or other
  modified_base (520)..(520): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctgcagtaccctttcactcaacctgtcgactagtccgtaccggggaaaatgtacgctggacaacaaatggttggaattggattaggcagtcccccgtagagaggccgttgacggtggccttagggaaaggtacctaagttactacgtcccaaggtgtactgaagactatgcagtntctgngagnggtctntcactnaccaccccagcacgtccaagaatcaagttccncctaccacctaaatntactgttccaacgcccgaacgacaccggtacttagtttagtttttgacgtcgaaaacgagggttacnctaaccgtaagtcccgggtttaacgtaccgttaaccgtacgttacgtaccgttccggtacgggaccgtacggttacg

SEQ ID NO: 396486 - DNA, 745 bp, Homo sapiens
  misc_feature: GZ8MTXP02H5B0O.21.27.C05.1.454.CMB.2.raw
  modified_base (202)..(202): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagcccacctgtctgtgtctccggaggggganccgcccaccctctcctgcacagccagtcagtctatcgctgacgttggttacgccgtcggtaccagacaagaaactcgtcggccaggccctccgacggtcctacctactacgtttaccgtcgactactacccgaaccggacggggaccctacgtgggtaccgtacccaaggtactacgggttcgagggttcgggcggggttaggttaggtttacggggactaaggtttacgtttttccaccttaccaaccgtatcccgaacgcccgtaaccccgtaagaaggtacggtagaaagttgttaggttcgacgtttagttttacttcgtacgaccgtaagtacttaaaattaagttaaacgtttccgtaggtacccgtacggtaccggggttacccgtaccggggttacccggaacccgggaaaccgggtaaaaccggtaaaggggtaaaacgtaaaaccggtaaaccgtaaaaacggtacgttacgggtacggtaacctacggaaacccgtaaccctaagtttcccgttacggtttcctttaacccg

SEQ ID NO: 396487 - DNA, 613 bp, Homo sapiens
  misc_feature: GZ8MTXP02HAOTJ.21.27.C05.1.454.CMB.2.raw
  modified_base (203)..(203): a, c, t, g, unknown or other
  modified_base (313)..(313): a, c, t, g, unknown or other
  modified_base (384)..(384): a, c, t, g, unknown or other
  modified_base (594)..(594): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccgagggggganccgccaccctctcctgccaccgccagtcagtctatcgctgacgttggtacgcctggtaccagacaagaaatcgtggccaggtcctccgaggtcctcctctacgttccgtncactcccacgacggccagtggtcaccgagacgtagtccgaggtgcggtagtagttggactggttactttcncttacactagtcacgccgtaccctaagagtaggtagaaagtgttagttcgtattagttttactcgttaggacctaagtactaaaattacgttaattacgtcggtcctagtcccggttagtacccggttaccgggaccgtaaccgggaacgtaagggtaaacggaaaacctaacgaaaacggtacgttagacgtacgcgaaccacgttacncgtttactctttaactccg

SEQ ID NO: 396488 - DNA, 677 bp, Homo sapiens
  misc_feature: GZ8MTXP02GBY0Q.21.27.C05.1.454.CMB.2.raw
  modified_base (201)..(201): a, c, t, g, unknown or other
  modified_base (289)..(289): a, c, t, g, unknown or other
  modified_base (301)..(301): a, c, t, g, unknown or other
  modified_base (402)..(402): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggtagcctggtaccagcaagaatctggccaggcctcccgagcctccnctactttaccgngcactcccaaccgaggggccctacgtcggtctaccccgagtactagggttccaggttggggacggtggtaacggtttggggactagggttacgtttttccncttaccaactagtaccacgccgtaccccctaagagtacggtagaaaggtacttggttagtaccgttaagtttttacgtttcgtacggtaaccctagtaacttaaaattaagtttaaacttacgtcggtacccttagggtaccgttccgggtaaccgtttccgggaccggtaaacccgggggactaaaaggggttcggaaaaacgtaccccgtaaaaggtaaccgttcgggttaacggcgttacgacccgtaactactccgtttacgtcctttacg

SEQ ID NO: 396489 - DNA, 648 bp, Homo sapiens
  misc_feature: GZ8MTXP02JK3TY.21.27.C05.1.454.CMB.2.raw
  modified_base (219)..(219): a, c, t, g, unknown or other
  modified_base (330)..(330): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtctccgaggggggacccgcccacctctccngccacacgccagtctagtctagtcgtctcgtacgttggtacgccgtcggaaccagacaagtaactcgcggccgacggccctaccgacgtcctcctacgttacgtttaccgngaccactaccccgaacgacgggtcctacggttcggtaccgtacccgaagtaccgtacggttacgagggtcgggtcgggttaggtaggttacgggacgttaggtttacgtttcctaccgtacaccgtatccgaccgtcccgaccctagtacgagtagaagtgttgtacgtacttagtttcttcacgtacagtactaaattataacgttcgtcggtctacggtcgtacgtacggtaccggacggtacggaacgtaaggtaaacgaaacgtaaacgtaacggtcgtggacgtcgacgaccgtactcgttcgtacttcctcg

SEQ ID NO: 396490 - DNA, 595 bp, Homo sapiens
  misc_feature: GZ8MTXP02GAEVM.21.27.C05.1.454.CMB.2.raw
  modified_base (385)..(385): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggaccgccaccctctcctgccacagccagtcagtctatcgctgactggtagctggtacagcagaaatctcggccaggcctccgaggcctcctctactttaccgtgactactccaccgacggcctacgtcgtcgtaccagacgagttcgagtgggcgggtggtagttaggggactagttcgttttcnctcgactatcacgccgaccctagagtagtgaagtattgtagtattagtttattcgtgaccagactaattacttaattaccgtcggtactcggtacgtacggtaccggttcggacccgtaacgggtaaccgtaagggttaacgaaaacttaccggaaaacgtaccgtaggtcgtaacgacggtacctacgtacttacgtacgttcttaacc

SEQ ID NO: 396491 - DNA, 642 bp, Homo sapiens
  misc_feature: GZ8MTXP02JHNXQ.21.27.C05.1.454.CMB.2.raw
  modified_base (159)..(159): a, c, t, g, unknown or other
  modified_base (301)..(301): a, c, t, g, unknown or other
  modified_base (407)..(407): a, c, t, g, unknown or other
  modified_base (434)..(434): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccatggggtntcctgtcacagatcaaactacagcagtctggtccaggactggtgacggccctcgcacgtaccctttcactcacctgtgacagtcgtaccggggaaatgtacgcgtggacaactaatggtagaattggataggcacgtcccgngagacggtctgagtgcgtaggaacgtacctattactacgtcctagtgtactagacgtactagtgacgaagtattcgtgtaggacgtcgggtctactacgaacctanacccgaacccacgacctaacgacaaanaactcgtacgtcctaccctaccgaaccttaaagtgttacctaggtaccaccgtacccgaataccgacggtactttaggttttaatttgaagtaccgtaaaggtacgggtaactacgaacttacgtttaccggacttaaccctaaccggttaccctttaacggacccgttccgtacgggggtaacccgtaacgggggttttaaacccgg

SEQ ID NO: 396492 - DNA, 676 bp, Homo sapiens
  misc_feature: GZ8MTXP02JZVYJ.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagataccaaactacagcagtctggtccaggactggtgacggccctcgcacgtaccctttcacctcacctgtgacatcgtaccggggaaatgtcgctggacaacaagtggttaggaattaggattaggctacgtccccggtagaggacggtccgttaggaggtggcgttagggaacgtaccttatagtacgtaccctaggtgtatagaagtactatgactagtgttcgtaggtggagtcgggtacgtccgtaccacccactacccgacccccaaggaccctaaccgtacccaaagtaaactaccgtaccggttaccctaccccttaccctaaccttaacgttcgtacttcgtaccctaccccgttaccccggaacgtaaccaccgggtactttaacggtttttattttcggacgtacgtaaaggtagggtactaccgtactacgtttacggtaccgtaccttaaccgtccgttacgccgttccggtacgggaccgacgggtttaccg

SEQ ID NO: 396493 - DNA, 740 bp, Homo sapiens
  misc_feature: GZ8MTXP02JU5PX.21.27.C05.1.454.CMB.2.raw
  modified_base (203)..(203): a, c, t, g, unknown or other
  modified_base (308)..(308): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagacagaaatcgcggccaggcctcccgaggtcctcctctactttaccgngccactccaccgacgggcctacgtcggtccgtaccccgaagtaccgtacggttcaggggtcgggtacggggttggtaggtttacggggactaggtttacggtttttcctaccgttaccgtacctacttccgacgtccccgtacccttaacgacggtaaggttagggaaagttacgttacggtttagtaccgtttaaagtttttactttcggtacgtacccgtaaaggtaccttaaaatttactttaaattacccggttacggtacccgttacggtccggtttaccgggttaccgggttacccgggacccggtaaaccgggggaaacccgtaaaggggttaaacgtaaaacggtacgtaaaaccgggtaacgttacgggtacggtccgtacggtacctaaccggttattaccggtttacgttacctttacccg

SEQ ID NO: 396494 - DNA, 759 bp, Homo sapiens
  misc_feature: GZ8MTXP02J3I0H.21.27.C05.1.454.CMB.2.raw
  modified_base (161)..(161): a, c, t, g, unknown or other
  modified_base (232)..(232): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccgatggggtntcctgtcacagatcaaactcagcagtctggtccaggactgggtagacggtccctcggacacgtaccctttnacctcaccgtgtcactagtcgtaccggggaaatcgtcgctggacaacgtagtggtagaattggattacggctacggtccccgtgacggacggtcgttggacggttgggacgttagggaacggtaccttagttaacgtaccgtacccgtaggttaggtaataggaagtacgtaatcggactagtagttcgttaaggtgtacggtccgttacgtactacccgaacctaccgtaacccgtaacccccgtaaagaacccgtacccgtaacccgtaaaaggtaaccttacccggtaaaccggttcccctaaccccttaaccccgtaaaccttaaaccgttcggtcccttacggtacccgttaaccccggtccccgaaccggtaaccgttaccggtacgtttaacggtttttagttttacgacggtaacgttaaacggggacggtactaacgtaaccgttcgtaacccgggttcttaaaccctccgttcgtacggtacccgttacggccggggttaccgtaacggtttcccgg

SEQ ID NO: 396495 - DNA, 819 bp, Homo sapiens
  misc_feature: GZ8MTXP02IYWEH.21.27.C05.1.454.CMB.2.raw
  modified_base (203)..(203): a, c, t, g, unknown or other
  modified_base (329)..(329): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtctccagcccaccctgtctgtgtctccggaggggganccgccaccctctcctgcacagccagtcagtctatcgctgacgttggtacgccgtggtaccaggacaagaaactccgtggaccctacggcctaccccgaggccttaccctcttaactttacccggtnaccctacgtaccccaaccgacgggtccctacggtcggtccgtaccccaggtaaccgtcgggtttccgagggttcggggtcggttaggttacggtttaggggaccgtagggtttaccgttttcctacccgtaccctaacgtacgtccgaaccggtcccgtaacccccgtaagtaacgggtaagttaacggtaaaagtgtttagggtttactaccgttttaattttcttttaccggacgtaaccccggtaaataccgttaaaactttaaagtttaaacgttacccggttcggtcccggttaagggttccccggttaccgggttaacccggtttcccggggaaaccccggtaaaaccggggaaccggtaaaacggggtaaacggggtaaaaccttaaaccgggtaaaaccgttaacggttcgggtaacggtaaccgtaccggtaacccttaaacccggttactttccggtttaccgtttaccgtttaaccccg

SEQ ID NO: 396496 - DNA, 630 bp, Homo sapiens
  misc_feature: GZ8MTXP02H4T8W.21.27.C05.1.454.CMB.2.raw
  modified_base (201)..(201): a, c, t, g, unknown or other
  modified_base (270)..(270): a, c, t, g, unknown or other
  modified_base (468)..(468): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccgagggggnccgccaccctctcctgcacagccagtcagtctatcgctgacgtggttagcctggtaccagcaagaatcncggccaggcctcccgaggcctcctctactttaccgtgactactcccaccgacgggcctacgtgggtccgtcccgaagaccgtaggtttccgagggtcggggtcggggtagggttagtttacggggacgtaggttacgtttttcctactccaacctatccgacgcccgacccttaacgaggtagtagaagtatggttanacttagttttattcgtacggtccagtactaaattatattacgtgaccttggacggttaccgtacggttccggacccggtacggggaacccgtaagggtaacgtaaacgtaacgaaaacgacgttcggacggtcgtcggacaccggtatcgttcgttcttacg

SEQ ID NO: 396497 - DNA, 781 bp, Homo sapiens
  misc_feature: GZ8MTXP02FL791.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggacnccgccaccctctcctgccacagccagtcagtctatcgctgactggtacgcgtggtaccagcaagaaatcgtggaccaggcctacccgaggtcctccgtctaactttaccggcgactactacccgaccgacggggccctacgttcgggtcctacccgagtaccgtagggttccaggggtcgggtacgggtaggtaggtttcggggacgtaggttacgtttttcaccgtactaacctataccgaacgcccgtacccctaagaacggtaacggtagtaaagtacgttacggtttacgtcgtttaaagttttctttaccgtcggtaccgtaaaggtacctaaaatttaaacgtttaaacttaccggttacggtaacccgttcgggtacccgttaaccgggttacccgggggtttacccgggaacccggtaaaaccgggggtaaaacccggtaaagggggttaaaccgggtaaaaacgttaaccggtaaaaaccgggttaaacggttcggggtaccggtaacgttaaccgggtacccgtaaaccttaacggtttccgtagggttttacccctttaaacccgg

SEQ ID NO: 396498 - DNA, 525 bp, Homo sapiens
  misc_feature: GZ8MTXP02FIKRU.21.27.C05.1.454.CMB.2.raw
  modified_base (267)..(267): a, c, t, g, unknown or other
  modified_base (287)..(287): a, c, t, g, unknown or other
  modified_base (296)..(296): a, c, t, g, unknown or other
  modified_base (319)..(319): a, c, t, g, unknown or other
  modified_base (356)..(356): a, c, t, g, unknown or other
  modified_base (368)..(368): a, c, t, g, unknown or other
  modified_base (390)..(390): a, c, t, g, unknown or other
  modified_base (400)..(400): a, c, t, g, unknown or other
  modified_base (420)..(420): a, c, t, g, unknown or other
  modified_base (443)..(443): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccagggggagcgccaccctctcctgcacagccagtcagtctatcgctgactggtagcctggtaccagcagaaatcnggccaggctccaggctcctnatttaccgngcatccaccgagggcccatggtnccccagacaggttcagtggcggttggatttggggacngtagtttttccnctacacatcacgccgaccctanagagtagaanattgtgacttagtttcttcngacctagacaattaataattcgnggtctgcgtacgacggtcgaccgacgggacaaaggagaaactacaaaacgtacgtgacggctcgacacctatcgtcttctac

SEQ ID NO: 396499 - DNA, 642 bp, Homo sapiens
  misc_feature: GZ8MTXP02F5RR5.21.27.C05.1.454.CMB.2.raw
  modified_base (200)..(200): a, c, t, g, unknown or other
  modified_base (272)..(272): a, c, t, g, unknown or other
  modified_base (436)..(436): a, c, t, g, unknown or other
tcagtcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccgagggggganccgccaccctctcctgccacagccagtcagtctatcgctgactgggttacgcctggtaccagcagaaatcgnggccaggcctcccgaggtcctcctctactttaccgtgcactcccaccgacgggcccacgtggtcgtcccagacgtaggttccaggtgggcggtggtagtttggggactgttacgttttctctaccaacctatccacgcccgtaccctacgagtagtagaaagtnttgttagacgttagttttacttctcgaccagtactaaattaattaacgtttacgtcggtcctcggtccggttccggtaccggttccgggacccgaaccgggggtaaaccgtaaaaggggtaacggtaaaacgttaaccgaaaaaccggtaacgttcggtacggtacgtaacgacctaaccgtacttcgttcgttaccttacctacg

SEQ ID NO: 396500 - DNA, 738 bp, Homo sapiens
  misc_feature: GZ8MTXP02IOPBU.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaaggccccagcgcagcttctcttcctcctgcttctctggctcccagacacactggagtgattgtgatgacgcagtctcagccacctgtctgtcgtctccggaggggggacnccgcctaccctctcctgaccacacgtcctagtctagtctacgtcgtctgtacgttggttacgtccgtaggtaccagacaagtaactcgacggaccgacggtcctacccgacggtccttacctacttacgtttaccgcgtacctactacccgaccggaccgggtcctacgttcggtaccgtaccgagtacgtacggttcgaggtcgggtacggtaggtacggttacggggtacgttaggtttacgttttccgtaccgtaccgtaacgtacgtaccgtacgtacccgtacccgtaagaacgggtagtaaggaaagttagtttaggttacgtacgtttacgtttacgttacgtacgtacgtaacgttaacttaaagttacttaaacgttcgtaccggtacttacggtcgttacggtaccggttaccgggaccggtaaccgggtaacggtaaaggtaacggtaaaacgtaaccgtaaaacgtaacgttggtacggtaacgtacgacctaactacgttaccgtttacgttacctttacg

SEQ ID NO: 396501 - DNA, 614 bp, Homo sapiens
  misc_feature: GZ8MTXP02IOVZM.21.27.C05.1.454.CMB.2.raw
  modified_base (203)..(203): a, c, t, g, unknown or other
  modified_base (305)..(305): a, c, t, g, unknown or other
  modified_base (397)..(397): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccgaggggggancgccaccctctcctgcacagccagtcagtctatcgctgactggttagcctggtaccagcaagaaatctggccaggcctcccgaggcctcctctatttaccgngcactccaaccgacgggccacgtggtcgtacccaggactaggttccaggtgggtcggggtggtacgtttggggactaggttacgtttttccncttccactacttccgacgccgcccctaagaggacgttaggaaagtacttggttgtacttaggtttactttctacgtcctaagtacctaaattattaaacttacgttcggaccttggtccgttacgtaccggttcggacccgtaacggggtaccgaaagggtacgaaaacttacgaaaacgtaaacgtggtacgcgtacgcacctatctacgtcttac

SEQ ID NO: 396502 - DNA, 700 bp, Homo sapiens
  misc_feature: GZ8MTXP02HLT9X.21.27.C05.1.454.CMB.2.raw
  modified_base (125)..(125): a, c, t, g, unknown or other
  modified_base (158)..(158): a, c, t, g, unknown or other
  modified_base (222)..(222): a, c, t, g, unknown or other
  modified_base (238)..(238): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctnatcttcctgcccgtgctgggcctccatggggtntcctgtcacagatcaaactacagcagtctggtccaggactggtgaggccctgcagtaccctttnacttcacctgtagacngtcgtaccggggaaaatggtacgcgtggacaaacgatggttacggaattggagttaggctaggtccccgtcgagacggtccttaggagtggcgttaggaaacggtaccttagttagtacgtacccgtaggtacggtaatagaagtacgtagtagactagtacttcgtgtacgtaggtcggttcggtaccttacgaacctacgtacccaaccccgtaacggtacccaaccgttacccgaaaacgtaaacgttacgaacgggttacccctacccgtaaccctaacccgttaaacgttccgttaaccgtcgggtttacccacccgttacccggaaccgtaaaccgtaccggtaccgttagttttaagtttacgtacgtaaccgaaaggaccgggtattacgtaacgtacgttacggtacgtactaaccttctacggtctaccgtcgggaccgtaacggtttaccg

SEQ ID NO: 396503 - DNA, 655 bp, Homo sapiens
  misc_feature: GZ8MTXP02FJ8XK.21.27.C05.1.454.CMB.2.raw
  modified_base (302)..(302): a, c, t, g, unknown or other
  modified_base (382)..(382): a, c, t, g, unknown or other
  modified_base (395)..(395): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggaccgccacctctcctgcacagccagtcagtctatcgctgactggtagcctggtaccagcaagaaatctggccaggcctcccgaggctcctctatttaccgngcactccaccgacgggccacgtggtcgtacccagactaggttcaggtggcggtaggtacgtttgggactagtagttttcnctcacatcacgcnccctacagtacgtagaagattggttgacgttagttttactttcgtaggtaccaagtactaaaagtttaaacttaaactttaaccgtcgggtacccgtttcggacccggtttaccgggtaaccgggtttcccggggaacccggtaaaccgggggtaacccgttaaaagggggtaacggtaaaaacgtaccggaaaaaaccgttaaccgtgggtaacgggtccttacggacctaacccgttattcgttacgttcctttaccg

SEQ ID NO: 396504 - DNA, 548 bp, Homo sapiens
  misc_feature: GZ8MTXP02FLW1O.21.27.C05.1.454.CMB.2.raw
  modified_base (418)..(418): a, c, t, g, unknown or other
  modified_base (447)..(447): a, c, t, g, unknown or other
  modified_base (494)..(494): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaaatggtcgctggacaacaaatggttggaattggattaggcagtccccgtgagaggtcctgagtggcttggaaggacctattatacgtcccagtggtatgaagactagtgcagattcgtgtgagcggttacgtctcaccatccaccccagacacgtcaagatcaggtcncctccactaatcgtctgttcactcccganacgacgctagtttatttgcgacaagagggactcgactacgttacggntaccgttaaccttccgtacgtacgtccgtcggggtaccgacggggtttaaccgg

SEQ ID NO: 396505 - DNA, 728 bp, Homo sapiens
  misc_feature: GZ8MTXP02JSWMI.21.27.C05.1.454.CMB.2.raw
  modified_base (160)..(160): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgacggccctgcacgtaccctttcacctcacctgtcgactagtcgtacggggtaaatcgtacgcgtcggactaacgtagtggtaggtaacttggtaagttaggctaccggtccccgtacggaggtacggtccgttaggacgtggtacgttagggaacgtacttagttacgtaaccgtccgtaggttaggtaacgtagaaacgtactagtacggacgtaagtagttcgtagggtacgtacgtcggttcgtaccttaccgaaccctacgtacccccgtaacccgaacgtaacccgtaaccgttaaccaaacgggtaacttacccgtaccggttaccctccccgttaaaaccgaccttaaacgtcgttaccgtagtcccctaaccgtacccgacgaccgtacgtcgtttaagttttagtttcgacgtaacgtaaggtacggtactaccgtactacggttccgtacttaacccgtaaccgttaccgttacgacgttcccgggtacgggtaccggtaacgggtttacccgg

SEQ ID NO: 396506 - DNA, 628 bp, Homo sapiens
  misc_feature: GZ8MTXP02JLXXI.21.27.C05.1.454.CMB.2.raw
  modified_base (202)..(202): a, c, t, g, unknown or other
  modified_base (304)..(304): a, c, t, g, unknown or other
  modified_base (392)..(392): a, c, t, g, unknown or other
  modified_base (415)..(415): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggacncgccaccctctcctgcacagccagtcagtctatcgctgactggtagcctggtaccagcaagaatcgtgccaggcctaccgaggtcctcctctactttaccgngcctactcccaaccgacggggcccacgtggtaccgtcccaggactggtcaggtcggcggtggtagttgggactaggtttacgttttcncctacaccgtatccgacgtcccncccgttaagaggtagtagaaacgtgttacggttgtaccttaagtttctttaccgtgtacccgtaagtacctaaattaagttaacgttaacgtcggtacctggtaccggttccggtaccggttcggacccgtacggggaacgtaagggtacgtaaaactacgtaaacgtaacgttggacggtcgtacgacctaactcgtcgtacgttcttaccg

SEQ ID NO: 396507 - DNA, 635 bp, Homo sapiens
  misc_feature: GZ8MTXP02JN85M.21.27.C05.1.454.CMB.2.raw
  modified_base (201)..(201): a, c, t, g, unknown or other
  modified_base (212)..(212): a, c, t, g, unknown or other
  modified_base (221)..(221): a, c, t, g, unknown or other
  modified_base (314)..(314): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggganccgccaccctntcctgcacngccagtcagtctatcgctgactggttagcctggtaccagcaagaaactcgtcggccaggcctcccgaggtcctccctctaacgtttacccggngtaccacgtcccgtacccggacgggtccctaaccgttgggtcctcccgaagtaccgaggtttccgaggtcggacggggttggtaggtttgggacgtaggttacgtttttccgcctacgtaccctatccgaacgcccgaccctaacgagtacgttagaaatcgtgttcgattagtttactttcgacgtcctagtaccaaattacgttaacgttacgtcgaccgttagcggttccgtaacggttccgaccgtaccggaacggtaggtaagaaacgtacgaaacgacgtcggtagaacgcgacacgtacgtcctacgttctccg

SEQ ID NO: 396508 - DNA, 635 bp, Homo sapiens
  misc_feature: GZ8MTXP02GUR7O.21.27.C05.1.454.CMB.2.raw
  modified_base (304)..(304): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggtctggtgacggccctcgcacgtaccctttcactcacctgtgactatcgtaccggggaaatgtacgctggacaacaagtggtggaatgataggcacgtccccgtgagngccttgagtgcgtggaagtacctatatacgtccagtgtatcgaagtctatgctagattcaggtgtacgtcgggtacgtaccgtccaaccgattaccccgaaccctacgaaccaccggtaccaaacgtataccgtagtaccctcctaaccctactaaagtcgttaccttagtaccgtacccgttaccccggaaacgtacccgtaacggtaccgtttaagtttacgtttttacgacggtacttaaaacgggacgggtactacgtaacgtcgttacggtacgtacctaaccttcgtacctacgttccgacggggtccgtaacgggtttaaccgg

SEQ ID NO: 396509 - DNA, 700 bp, Homo sapiens
  misc_feature: GZ8MTXP02FTWE2.21.27.C05.1.454.CMB.2.raw
  modified_base (206)..(206): a, c, t, g, unknown or other
  modified_base (258)..(258): a, c, t, g, unknown or other
  modified_base (280)..(280): a, c, t, g, unknown or other
  modified_base (318)..(318): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccggaggggggacnccgcccaccctctcctgccacacgccagtcagtctatcgctgacttggtacncctggtaccagcaagtaatcgnggccaggcctcccgaggccttccctatacgtttaccgngccactcccgaaccgacggggccctacggtcggtcgtacccagtacgtacggttaccgagggtcggggtcgggttaggtaggtttcggggactaggttacgtttttcacctaccgaactagtaccgacgtcccgtacccctacgaaggtaggtaagtaaagtagtttggttagtaccgtttaagttttacgtttccgtaccggacctaaggtaactaaactttaattaaactttaccggtcggtccgttggtccggttaccggtaccgggttcccgggaacccggaacgggtaaccggtaaaggggtaaacgtaaaacgtaaaccgaaaacggtaacgtggtacgggcttacgaccacgtactttcgtacgttaccttaccg

SEQ ID NO: 396510 - DNA, 812 bp, Homo sapiens
  misc_feature: GZ8MTXP02HIPCY.21.27.C05.1.454.CMB.2.raw
  modified_base (202)..(202): a, c, t, g, unknown or other
  modified_base (220)..(220): a, c, t, g, unknown or other
  modified_base (249)..(249): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgctagtctccagccacctgtctgtgtcgtcgagggggancgccacctctcctgcacngccagtcagtctatcgctgtacgtggtanccgtggtaccagcaagaaactcgtaggccacggcctacccgacggtccttccgtaccttaacgttttacccggcgtacctacgtaccccgaacccggtacggggtacccctaacggttcggggtaccgttacccccgaaaggtaccgtaaccggggtttccgacggggttacggggtaccggggttaggttaacggttttacggggacgtttaacggtttacggtttttcctaccgtacctaacctaacgttaccgaaccgtcccgtaacccttaaacgaaggtaacggttaacgtaaagttcgtttacggttacgttaaccgtttaaaggtttttacctttaccggtaccggtaaacctaacggttaaactaaagttaaactttaaacgttaccgtcggtccgtaacgggtcccggttaccgttacccgggttacccggaccccggtaaaccggggtaaccgtaaaaggggtaaccgtaaaaacgttacccgaaaaacggttaacgtcggttacggaaccgtacgaacccgtaacctacttccgttacgtttcctttaaccg

SEQ ID NO: 396511 - DNA, 717 bp, Homo sapiens
  misc_feature: GZ8MTXP02GCL8X.21.27.C05.1.454.CMB.2.raw
  modified_base (200)..(200): a, c, t, g, unknown or other
  modified_base (305)..(305): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgcacagccagtcagtctatcgctgactggttacgctggtaccagcaagaaatcgtggccaggcctccccgaggcctcctctactttaccgngcactcccaccgacgggcccacgtggtcgtacccagaccgaggttccaggtcgggcggttggtagtttcggggactaggttacgttttctacgtaccacctatcgacgcccgtaccctaagaggtacgtagaaagtacttggttagtactttagttttactttcgttacggaccctaaggtaaccttaaaagtttaactttaaaacggtttaaccgttcgggtacccttgggtaccgggtttaccggtaccgggtttacccggggaacccggtaaacgggggtaaaacccgtaaagggggtttaaaccgggaaaaacttaaacccggaaaaaccggttaaaccgttggggtacggtaccgttcggaacccgtaacccttagttccgtttacgttcccttttacgttaacccg

SEQ ID NO: 396512 - DNA, 626 bp, Homo sapiens
  misc_feature: GZ8MTXP02F2COE.21.27.C05.1.454.CMB.2.raw
  modified_base (321)..(321): a, c, t, g, unknown or other
  modified_base (349)..(349): a, c, t, g, unknown or other
  modified_base (354)..(354): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctgcagtaccctttcactcacctgtgacatctaccggggaaatgtcgctggcaacaatggtggaattggattaggcagtcccgtgagagctgagtgcttggagacctattanacgccagtgtactgaagatatgacagtntacgngtgagcgtcgtctcaccactcccacgacactaccgaacaatacgtacgaccggtcctacccgtaaccactaacgttcgtcgtacgtacctacccgacccgtaacgaccgtacgtacgtttagttttacgtttacgcgtaaacgtaacgggtaacggtactaaccgtaacgtttacggttaacgggtcctttaaacccgtaacccgtttacgttacccggtaccgttaccggggtttaccggggaacccggtttacggggttttaaaccccgg

SEQ ID NO: 396513 - DNA, 721 bp, Homo sapiens
  misc_feature: GZ8MTXP02GY3EF.21.27.C05.1.454.CMB.2.raw
  modified_base (203)..(203): a, c, t, g, unknown or other
  modified_base (216)..(216): a, c, t, g, unknown or other
  modified_base (322)..(322): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggacnccgccacctctcngcacgacgcagtcagtctagtcgctagtacgttggtacgtccgtacggtacagacaagtaactcgtcggccgacggtcctccgagtcctcctactacgtttaccgnacctactacccgaccgacgggtccctacggtcggtaccgtacccgaagtacgttacggtcgtagggtgggtcgggttaggttacggttacggggacttaggtttacgtttcctacctacctaacctacgtaccgaccgtcccgtacccgtaagaaggtaggtagtaagtagttgttacgtacgtttacgtttacttcgtacgtactaagtaacttaaattaacgttaacgttccgtacggtacgttacggtccggttaccggtaccgggtaccgggaacccggtaaaccggggtaaacggtaaacgggtaaacgtaaaaccgtaaccgtaaaacggttaccgttcggtacggtaaccgtaccgtacctaccgtacgttaccgttaccgtttaccttacg

SEQ ID NO: 396514 - DNA, 781 bp, Homo sapiens
  misc_feature: GZ8MTXP02FUCDX.21.27.C05.1.454.CMB.2.raw
  modified_base (199)..(199): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctccagacaccactggagtgattgtgatgacgcagtctccagccacctgtctgtgtcgtccgaggggganccgccaccctctcctgcacagccagtcagtctatcgtctgacgttggttacgccgtaggtaccagacaagtaaatcgtcggccacggcctcccgaggccttccctctaacgttttaccgcgactacctacccaccggagggtaccccacgttcgggttaccgtaccccgaaggtaccgtaacgggttcccgaggggtcggggtacggggtttaggggttaacggttttacggggaaccttaggggtttacgtttttccgtaccttacccgaaccctagttaccgaaccggtccccgtaccccgttaacgaagggtaacggttaacggaaagttacgttggtttacgtaccgttttaaggtttttacttcgttacggacccttaaaggaccttaaaatttaacttaaacgttaccgtaggtcccgttaggtcccggttacggtaacccgggttccggaaaccccgggtaaacgggggtaaaccgtaaaagggggttaacggaaaacttaaccggaaaaacggtccgttacggagtcccgaaggtacccaaacgttcgttacttcggttaccttacgttacccg

SEQ ID NO: 396515 - DNA, 778 bp, Homo sapiens
  misc_feature: GZ8MTXP02FZG7B.21.27.C05.1.454.CMB.2.raw
  modified_base (206)..(206): a, c, t, g, unknown or other
  modified_base (327)..(327): a, c, t, g, unknown or other
tcagtcgtcgctcgcacgaccggtgctcgatttagacgcgatcgaagggtttggggggtagggaactgctcagttaggacccagacggagccatggaagccccagcgcagcttctcttcctcctgcttctctggctcccagacaccactggagtgattgtgatgacgcagtctccagccaccctgtctgtgtctccgagggggacncgcccaccctctcctgccacacgccagtcagtctactcgctgtactggttagccgtaggtaccagacaagtaaatcgtacggccaggccctcccgacggccttcctcgtaacttttcccgngcctactcccgaccgacgggtccctacgttcggtaccgtaccccaaaggtaccgtacgggtttccgtaagggtcggggtaccggggtttagggtaacggttttcggggaacgttagggtttaaccggttttttcctacccttacccaaacccttagtacccggtaacccgggtccccgtaacccccccgtttaaaggaaccggggtaacgttaaaggtaaacggttagttcgggtttagtacgtttaaacggtttttactttaccgtaccggacctaaacggtaacttaaaatttaagttaaactttaccggtcggtaaccgttcgtaccggttaccggttacgggtacccggtaaccgaccggggtaaaacgtacgggtaacgtaaaaccgacggaaaaccgtaagtcgggtagaaccgttcgaaccacttaactcgtcttacctttacc

SEQ ID NO: 396516 - DNA, 878 bp, Homo sapiens
  misc_feature: GZ8MTXP02H526Z.21.27.C05.1.454.CMB.2.raw
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccggagggggaccgccaccctctcctcgcacacgccagtcagtctatcgctgacttggtagccgtggtaccagcaagaaactcgtggaccgacggcctaccgacggtcctccctctacgttttaccggcgtaccactaccccgaccggacgggccctacgtcggtacgtaccccgaaggtaccgtacgggtttacgacggggttcgggtacggggtttaggtacggtttttacggggacgttaacggggtttttacggttttttaccctacccgttaccgtaaccccttaagttaccccaacccggggttaccccggtaccccttaacccgggaaaaggggttaaaccggttaacggggtaaaaacggtttaggtttacgggtttttacggtaaaccggtttttaggttttttaaaccgttttccggttaccggttaaacccgttaaaggttaaaccgtttaaaaatttaaaccggtttaaaacgtttacccggttacgggttacccggttttacgggacccgggtttaacccgggtaccggggttttaccccggggaacccggttaaaaccgggggaacccttaaaagggggtacgtaaaaactaacccgggtaaaaacggtaaccgttggtacgggaaccttacggaaaccgttacctaagtttccggttactttacgttacccg

SEQ ID NO: 396517 - DNA, 587 bp, Homo sapiens
  misc_feature: GZ8MTXP02J2GSA.21.27.C05.1.454.CMB.2.raw
  modified_base (353)..(353): a, c, t, g, unknown or other
  modified_base (363)..(363): a, c, t, g, unknown or other
  modified_base (384)..(384): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctaccggggaaatgtcgctggcaacaatggtggaattggattaggcagtccccgtcgagaggcctgagtggcttggagtacctatactcgtccagtgtatgagactatgcagtnttcgtgtagngcgtcgtactccgacctaccnccacccgacaaccgtcacgaactctacgacgttccctacctacctactagtcgtctacgtacctaccccgaccgaaccgtacggacgttacgtttagtttacgtttagcgacgtaaggaggtactacgacgttaccgtacggtaccttaaaccgtctacgttaccgttaccgcggtttaccggaccggtaacggtttaaccgg

SEQ ID NO: 396518 - DNA, 747 bp, Homo sapiens
  misc_feature: GZ8MTXP02FU5R3.21.27.C05.1.454.CMB.2.raw
  modified_base (160)..(160): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctcccagtggggtntcctgtcacagatacaaactacagcagtctggtccaggactggtgacggccctcgcacgtaccctttcactcactgtgacataccgtacggggaaatgtcgctgcaacatggtagatgatagcgacgtccccgtagagaggtcctagaggtgtcgttaggaacggtacctattacgtacgtcccaggtcgtagtagaagactagtcgataacgtattcgtaggtagtaacggtccgggttacgtaccgttacctaaccctacttacccccgaaccccgaacgtaaccgaacccgttaacgaaaccgttaaactaccgtaccggttacccctacccctaaccctaaaccccgttaaattaccgttaccgttaccgttacccgtaaaccccgttacccccgggaaaccgtaacccgtaaccgggttacgttttaaaccggtttttaacgtttttacgggttacgaaccggtaaaacggtaaggggtacctaacgttaacgttacgtttacccggtacgttaacccgttaacccttcccgttaacgttacccgtccggttacgggggtacccgtaacggggtttaacccg

SEQ ID NO: 396519 - DNA, 890 bp, Homo sapiens
  misc_feature: GZ8MTXP02HTOD5.21.27.C05.1.454.CMB.2.raw
  modified_base (202)..(202): a, c, t, g, unknown or other
  modified_base (208)..(208): a, c, t, g, unknown or other
  modified_base (216)..(216): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggatgattgtgatgacgcagtctccagccacctgtctgtgtctccggaggggggacnccgccncctctccngacacacgctagtcagtctactcgcgtgtacgttggtacgccgtacggacagacaagtaactcgacggaccgacggtcctaccgacggtccttccgttacgttacgtttaccgacgtacctaaccgtacccggaaccggtaccgggtacctacggtaccgggtacccgtacccgtaacggtaccggttaccgggttacgggtacggggttcggggtacggggtttagggttacggtttacggggtacgtttaacgggtttttaccgttttaccgtacccgttaacccgtaccgtacgttaacccggtaaccgtaccccgtaaacccggttaaaggtacggtaacggttaacggtaaaggtttcggtttacggtttacggtttaaccgttttacgtttttacctttaccggtacgttaaaccgtaaacgtttaaactttaaaacgtttaacgtttaaacgtttaccggtccgggttaccggttaccgggttacccgggttacccgggttaacccgggttacccggggaaacccggtaaaacgggggtaaaaccggttaaagggggttaaaccggtaaaaaccgtaaaaccggtaaaaccgggttacgtttcgggtaccgtaaccgttacggaaaccctttaccgtacgtttacccgttacgttttacccttaccg

SEQ ID NO: 396520 - DNA, 801 bp, Homo sapiens
  misc_feature: GZ8MTXP02IKYM8.21.27.C05.1.454.CMB.2.raw
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccatggagtgattgtgatgacgcagtctccagccacctgtctgtgtctccggagggggacccgccacctctcctgcacgacgcagtcagtctagtcgctgtacgttggtacgccgtacggtaccagacgtaaagtactcgtacggaccgacggtccctacccggtacgtcccttccttacgttacgtttaccgcgtacctaccgtacccgaaccggtacgggtacctacggttcggtaccgaccgaaggtacgtcggtacgtagggtcgggtacgggttaggtaggtttacgggacgttacggtttactttcctacctaaccgtaccgtactaccggaccgtaccctacccgtaagaggtaagtaaggtaacttaggttcggttacgtacgttttagttttacgttaccgtacgtaaccgtaaagttaaacttaaaagtttacgttaaacgttccggtccggttaccggttccgggttacccggttaacccgggttaccggggtaaccccgggtaaacccggtaaaaccgggggtaaaaccgttaaacgggggttaaaaccgaaaaacccgttaaaccggtaaaaccggttacgttcgggtaaaccggtccgtaacgtaccgtaaacccgttcgttaccggtttcctttaacccgtaccg

SEQ ID NO: 396521 - DNA, 603 bp, Homo sapiens
  misc_feature: GZ8MTXP02FMBG4.21.27.C05.1.454.CMB.2.raw
  modified_base (363)..(363): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacggccctcgcagtaccctttcactcacctgtcgacatcgtaccggggaaatgtcgctggcaacaatggttggaattggataggcacgtccccgtcgagaggccttgagtggcgttggaaggacctattatacgtccagtgtatagagactatgcagtntcgtgtgagcgtcgtctacgacacgtccacccacgaacaccgtacaacgaactaccgagtcctcccctacctaacctaaacgtctccgttacgtcctaccttaccccgaccgaccgaccggtacttacgttttaagttttgtcgtacgaaggtacgggtactacgtacgtacgttacggtcgtaaccttaaccgttccgttacgtaccgtcggtcgggaccggtacgggtttaaacccgg

SEQ ID NO: 396522 - DNA, 590 bp, Homo sapiens
  misc_feature: GZ8MTXP02FQITX.21.27.C05.1.454.CMB.2.raw
  modified_base (218)..(218): a, c, t, g, unknown or other
  modified_base (242)..(242): a, c, t, g, unknown or other
  modified_base (370)..(370): a, c, t, g, unknown or other
  modified_base (446)..(446): a, c, t, g, unknown or other
  modified_base (460)..(460): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccggaggggggacccgcccacctctccnacacacgccagtctagtctatcgntagtacgttggtacgtccgtacggacagacaagaactcgacggaccgacgcctccgacgtcctcctactacgttccgcacactaccgaccgacggcctacggtcgtcgtaccgagtacgtacggtcgnggtgggtggtaggtaggttaggacgtgttactttctacctaccactctcgaccgcctacctagagtagtagtagtnttgtagtattattnttctgacataataattattacgtcgtcgtcgtcgtacggtccgtacggtaccggaccgaacgggtaacgtaaggtaaacgaaactaacgaacgtacgtgtacgtcgtacgactactgttcgtcttactcg

SEQ ID NO: 396523 - DNA, 644 bp, Homo sapiens
  misc_feature: GZ8MTXP02FVQR5.21.27.C05.1.454.CMB.2.raw
  modified_base (200)..(200): a, c, t, g, unknown or other
  modified_base (310)..(310): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctcgaggggganccgccaccctctcctgcacacgccagtcagtctatcgctgacgttggtacgccgtggtaccagcaagaaatctggcctacggcctcccgaggcctcctctactttaccgngcactcccaccgacgggccacgtggtctccagactacggttcgaggtggtcggtaggtacgtttgggactagttcgttttctctaccactatcgacgcccgtaccctaagagacgttaagaagtgttgttgtactttagtttactttcgtacggacctaagtactaaaatttacgttaaacttccggtggtccctggtaccgttcggtaaccgggttccggacccggtaacgggtaaccgtaaagggttaaccggaaaacttaaccggaaaaccgtaagttcgggacggtccgttaggaacccgtaactactttcgtacggttacctttaaccg

SEQ ID NO: 396524 - DNA, 739 bp, Homo sapiens
  misc_feature: GZ8MTXP02JAL1A.21.27.C05.1.454.CMB.2.raw
  modified_base (200)..(200): a, c, t, g, unknown or other
  modified_base (490)..(490): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtctccagccacctgtctgtgtctccgagggggcncgccacctctcctgcacagcagtcagtctatcgctgacttggtacgccgtaggtaccagacagaaatcgtacggccacggccttacccgacggtcccttcctactacgtttacccggtcacctacgtccccgaaccgacggggtacctacggttacgggtccgtacccgaaaggtaccgtacgggtttaccgagggttcgggtacgggttaggtaggtttacggggacgtagtttaacggtttttccaccgtacctaaccgtagtaccgacgtcccgtaaccccgttaanaacggtaacggttagaaagtaccgtttaggtacgtacgttagtttacttcgtacgtacctaagtacttaaattacttaaacgttcggtacgtacccgtaggtaccggttcggtacgggttacccggaccggtaaccggggtaaacgtaaacgggtaacggtaaaaccttaaacggtaaaaccgttaacggttcggtacggtaaccttacggaccgtacctagtttaccgttcggtttaactttccccgg

SEQ ID NO: 396525 - DNA, 650 bp, Homo sapiens
  misc_feature: GZ8MTXP02FJO7F.21.27.C05.1.454.CMB.2.raw
  modified_base (311)..(311): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtcgtccgagggggacccgcccaccctctcctgccacacgccagtcagtctatcgctgactggtagccgtgtaccagcaagtaatcgtggaccaggcctccgagcctccgtctactttaccgnctactcccacgacgggtccacgttggtcacccgtagtacgtacggttacgaggtggtcggtaggtagtttcggggactaggttcgttttcaccgtacgtacacgttcacgtcccgaccctagaagtacgtagaaactgttcgtagtacttagtttacttcgacgtaccagtactaaattaacttagttaccgtgtaccttaggtaccgtaccggtacgtaccgacccggtaacggtaaaccgggaggtaaacggtaaaacctaaccggtaaaacggttaccgtgggtaaccgtcggttaaccgaccgaacggttacttccgttacgttcctttaacccg

SEQ ID NO: 396526 - DNA, 704 bp, Homo sapiens
  misc_feature: GZ8MTXP02GZC12.21.27.C05.1.454.CMB.2.raw
  modified_base (205)..(205): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcgtccgaggggggacnccgcctacctctcctgaccacgacgctagtctagtctacgtcgtcgtaggtacgttggtacgtccgtacggtaacagtacgaagtaactcgcggaccgacggcctaccgacgtccttcctacgtacgtttaccgcacctacgtaccccgaaccggtaccgggtacctaccggttacggtccgtaccgaacggtacgtaccggttacgacgggtcgggtacgggttacggttaggttacgggacttacggttacttttactaccgtaccacgtacgtaccgaccgtacccgtacccgtaagacgtagtaacgagtacgttacgtacgtacttaagttttcttacgtacgacgtaacttaaactaatttaacgtaacgttacgcgtacgtcggtaccgtacggtacgtccggaaccggtaacggtaacgtaagggtaaacgaaacgtaaacgaaacgtacgtacggacgaacgacgtacgtactacgttcgtacttactac

SEQ ID NO: 396527 - DNA, 700 bp, Homo sapiens
  misc_feature: GZ8MTXP02JL4M9.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgacggccctcgcacgtaccctttcactcacctgtcgacagtccgtaccggggaaaatcggtacgcgtggacaaacgtaagttgggttacggaaagttgggaattacgggctaaccggttccccccggtaggacggtaacggtcccgttggaacggttgggacgtttagggaaacgggtacccttaagttaacgtaccggtcccgtaaggttcggtaagtagaaagtactaagtgactagtatttcgtggtagacgtcggtacgtctacaccactacccacccgacgaccacgtaccaagaactcgacgtcctaccctaccgtacctaagtcgtactcgtaccaccgtacccgacgacctacggtacttagttttacgtttacgacgtacgtaaaggtacgggtactacctaacgttaccgttacggtacttacccgtaaccgttccgttacggtaacccgtccggtacggggtaacccggtagggtttaaacccgg

SEQ ID NO: 396528 - DNA, 665 bp, Homo sapiens
  misc_feature: GZ8MTXP02GAJR3.21.27.C05.1.454.CMB.2.raw
  modified_base (202)..(202): a, c, t, g, unknown or other
  modified_base (313)..(313): a, c, t, g, unknown or other
  modified_base (637)..(637): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcacagccagtccagtctatcgctgacttggtagccgtggtaccagcaagtaaactcgtggccaggcctcccaggccttcctctacttttaccggntaccactaccccaaccgtacgggccctaacgttcggtccgtacccgaacgtacgtacggttccgtaagggtcgggtacggggtggtacgtttaggggaccgtaggtttaacggtttttctccttaccaacctagtactacgccgtaccccctagtaaggaggttaagaaacgtgtttagttcgacgtttagttttactttcgtcgactaagtactaaattaagtttaacttaccgtgtaccgttagtcggttacgacggtttccgggaacgaccggggtaaccgtaagggtaaacgtaaactacggtaaaactacggtgtacgngtacgactaccgattctacgttcttacc

SEQ ID NO: 396529 - DNA, 668 bp, Homo sapiens
  misc_feature: GZ8MTXP02JWSAF.21.27.C05.1.454.CMB.2.raw
  modified_base (205)..(205): a, c, t, g, unknown or other
  modified_base (255)..(255): a, c, t, g, unknown or other
  modified_base (310)..(310): a, c, t, g, unknown or other
  modified_base (648)..(648): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtcctccgagggggacnccgccacccctctcctgcacagccagtcagtctagtcgctgactggtacnccgtggaccagcaagaatcgtggccaggtcctccgagccttcctctactttccgnacactacccaccggacgggccctacgtcgggtcgtaccccgaaggtaccgtcggttacgaggggtcggggtacgggttagggtaacggttttggggaacctttagggttaacggttttttcccaccgttaacccgtaaccgtacgttacccgaacggtcccgtacccccgtaagtaaacgggtaggttagaaagtagttgttacggtacttagttttacttcgtacgcctaagtataaattattaattcgtacggtcgtagtcgtacggttaccgtaccggccgacggtaaccggaggtacgaaacgtaaccgaaacgtaactggtacgtcgcgaacnctatccgttacgtctttacc

SEQ ID NO: 396530 - DNA, 841 bp, Homo sapiens
  misc_feature: GZ8MTXP02F2BSM.21.27.C05.1.454.CMB.2.raw
  modified_base (201)..(201): a, c, t, g, unknown or other
  modified_base (221)..(221): a, c, t, g, unknown or other
  modified_base (325)..(325): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccacctgtctgtgtcgtccggaggggganccgccaccctctcctgcacngccagtcagtctatcgctgacgttggttacgcccgtaggtaccagacaagaaactcgtcggaccaggtccctacccgaggtccttcctactacgttttacccgngacctacgtcccgaaccggacggggaccctacggttcgggtacctaccccgaaggtaaccgttacgggttaccgaaggggttcggggtacggggttaggggttaacggttttacgggggaacttacggggtttaccgttttttcccgacctttaacccgaacccttaacgttaccggaacccggtacccccgtaacccccgtttaaacggaaggtaacgggttaacgggtaaaacgttcggtttaggtttaacgtacgttttaaacgggtttttaccttacggttaccgtaacccgtaaagttaaccgttaaaatttaaccgtttaaaacgtttccggtaccggttaccgttcggtacccggtttaaccggggtaccggttacccgggaccgggtaaaccgggtaaacgggtaaacggggttaaacgtaaaacgtaaccgtaaaacggtaccgttagggtacggtaccttaacggaccctaccgttacggttccttacgttaccttacgttccccg

SEQ ID NO: 396531 - DNA, 812 bp, Homo sapiens
  misc_feature: GZ8MTXP02G5Y9M.21.27.C05.1.454.CMB.2.raw
  modified_base (205)..(205): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggacnccgcccaccctctcctgccacacgcctagtcctagtctagtcgtctgtacgtggttacgccgtcggtaccagcaagtaaactcgtacggaccgacggcctcccgaggtccttcctacttacgtttaccgcactacgtccaccggaccgggcctacgtcggtaccgtcccgaaggtacgtacggttcgaggtcggggtcggttaggttaggtttacggggacgtacggtttcggttttacctccgtaaccgtaacctacgtaccgacggtcccgtaacccgtaacggaacggttaacggtaagtaaagttacgtttacggtttacgtaacgtttaagttttacgtttaccgtacggtaaccgtaagtaacgttaaaagtttaaactttaacggtttaaccggttccgggtacccgttacgggtacccgggtttaccgggtaacccgggtttcccggggaaaacccggggtaacccgggggtaaaccggttaaaacggggttaaaccggtaaaaccgtaaaccgtaaaaaccgggtacggttacgggtaaccggtaaccgttacgaacccgtacgttaacgtttccggtttacgttaacccgtttaccg

SEQ ID NO: 396532 - DNA, 861 bp, Homo sapiens
  misc_feature: GZ8MTXP02HXF3W.21.27.C05.1.454.CMB.2.raw
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccggaggggggacccgccacctctcctcgccaccgccagtcagtctactcgctgtacgttggtacgcgtacggaccagacaagtaactcgacggccgacggtcctccgacgtcctacctacttacgtttaccgacacctacctacccgaccggacggaccctacggttcggtaccgtaccgaagtacggtaggtaccgtaggggttcgggtacgggttagggttaacgggtttacgggaacgtttacgggtttacgtttttacctaccgtacccgtaaccgtacgtaccgtaacccggtacccgtaaacccgtaaacgtaacggtaacgggttaaaggtaaacgttacgttacgggtttacgttacggtttttaacgtttttacgtttaccgttaccgtaaccgtaaagttaaactttaaaagtttaaacgtttaacggttaccgtacgggttcccggttaaccgggttcccgggttacccgggttacccgggttacccggggtaaacccgggtaaaaccgggggtaaaaccgggtaaaacgggggttaaaaccggtaaaaaccgtaaaacccgggtaaaacggtaccggttacggggtaccggtaccgttaaccgtaaccgtaaccgttaccgtttaccgtttacccgtttaccgtttaccgttacccg

SEQ ID NO: 396533 - DNA, 735 bp, Homo sapiens
  misc_feature: GZ8MTXP02F0LV8.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggactggtgacggccctcgcacgtaccctttcactcacctgtgacagtcgtaccggggaaatcggtacgctggacaaacgaagttgggtaggtaagttaggtaattacggacctacggtccccggtacgacggtacggtccgttggaggtgggtcgttaggaaacggtaccttagttacgtaccgtccgtaggtggtatagaacgtactagtagactagtattcgtaggtagtacgtcggttacgtactacctaaccgacttacccgaaccccgtaacgacctaacccgtaaccgaaagtaaacgtacccgtacggtacccctacccttaacccgtaaacctaacgtttaccgttacgtaccgtacccgtacccgtaacccccggaaccggtaacccgtaccggtttacgtttaacggtttttacgttttacggtacgtaacgtaaagggtacggtactacgttaacgttacgttacggtactaaccctccgttacttacgtaccgtccggtacgggtaccggtacggtttaacccgg

SEQ ID NO: 396534 - DNA, 794 bp, Homo sapiens
  misc_feature: GZ8MTXP02HLWUI.21.27.C05.1.454.CMB.2.raw
  modified_base (204)..(204): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtctccggagggggacnccgcccaccctctcctgccacacgccagtcagtctatcgctgacgttggttacgccgtaggtaccagacaagaaactcgtcggaccaggcctcccgaggtccttccctctaacgtttaccgcgaccactcccgaaccgacgggcctacgtcggtcgtacccgagacgtacggttccgagggtcgggtcggggttagggtacggtttacggggacgttaggtttacggtttttcctaccttaccgaaccctacgttccgaaccggtacccgaacccccgttaaagaaggggtaaggttaagggtaaacgttagttacgtttaggtacgtttaagttttaacgttttcgaccggtactaaacgtaacttaaaagtttaaacgttaaatttaccggtaccgggttacccgttcgggtacccgggtttaccgggttacccgggtttaaccggggaccccggtaaaaccgggggttaaaacccggtaaagggggttaaaccggtaaaaacgttaacccggaaaaacggttacggttaacggtacggtaacgtacggaccgtactaccgtttaccgttacttttacccgtttaccc

SEQ ID NO: 396535 - DNA, 766 bp, Homo sapiens
  misc_feature: GZ8MTXP02I95Q9.21.27.C05.1.454.CMB.2.raw
  modified_base (205)..(205): a, c, t, g, unknown or other
  modified_base (327)..(327): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtcgtcgtccggagggggacnccgccacccctctcctgccacagccagtcagtctatcgctgtacgttggtacgcctggtaccagacaagaactcgtacggcccagggccctccggacgtccttccttactacgtttacccgngacctaacctccccgaacggaccgggtacccacggttcgggacctccccgaaagtccgttagggtaccgaggggtcggtacggggttgtaaacggtttcggggaacgttcggttttacgtttccgtaccgtaccaccgtacgtaccgaccgtacccgtaccctaaaggagtacggttaaaggaaagttcgttcgggtttaactacgttttaacgtttttacgtttccaccgggtttaacccaacgtttaaattaaaacgtttaactttaaacccgtttacggtccggtaacccggttggtttaaccggttacccgggtacggtttccccgggaaaccggtaaccggggtaaaaccgaaaggggtaaaaccgaaaccttacgaaaaccgttacgtcgtaggaactacccgactacggttactcgttaccgttacttaccg

SEQ ID NO: 396536 - DNA, 706 bp, Homo sapiens
  misc_feature: GZ8MTXP02FPGXU.21.27.C05.1.454.CMB.2.raw
  modified_base (202)..(202): a, c, t, g, unknown or other
  modified_base (250)..(250): a, c, t, g, unknown or other
  modified_base (436)..(436): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggganccgccaccctctcctgcacagccagtcagtctatcgctgactggtacncctggtaccagcaagaactcgtggccaggccctaccgaggtcctcctactacgtttaccgcgcctactcccgaaccgtacggggccctaacggtcggtaccgtcccgaaggtactacggggttacagggtcgggtcgggttaggtacgtttaggggacttaggttcgttttccaccttccgaactntacgacgtccgaccccttagacgtacggtaagagtagttgttacgctttaaggtttactttcgacgtaccgtaagtactaaatttaaacttaacgttaccgttggacccgttggtacccggttacggttacccggggttaccgggaaccccggtaacggggtaaaccgtaaacgggggttaaacgtaaaaccgttaacggaaaaccgttaacggtcgggtacggtaacctacggaacctacccgtttataccggttcctttaccttaccg

SEQ ID NO: 396537 - DNA, 907 bp, Homo sapiens
  misc_feature: GZ8MTXP02I76HB.21.27.C05.1.454.CMB.2.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggactggtgacggccctcgctacgtaccctttcactcacctgtacgactagtaccggtaccggggaaatcggtcgcgtacggacaaacgtaagtggttaggtaagttggaagttacgggacctaccggtaccccggtacgaacggtacgggtcccttaggaacggttcggtacggttagggaaaacgggtacctttaagtttaacgtaacccggttaccctaagggtttaggtaacctagggaaaacgtacctaaggttacgacgtaacgttatttccgttagggttaggtaaccgggttccggttaccggtaccctacccgtaaacccctaccgttaacccccgaacccccgtaacgaacccgtaacccgtaaacccgtaaaacggtaaacctacccggtaacggttccccctaacccccgttaaacccttaaaccccgtttaaacgttcccgggtttaccctaccggttaacccgtaacccccgttaacccccggaaccggttaacccggtaacccgggttaaacgttttacggtttttaagttttaccggggtaacgtaaacccggttaaaaggggttaacgggtaccttaaacggaaccgtttaaccggttacgggtaacccttaacccgttaacccgtttcccttaaccgggtacccgttacccggggtacggggttaaccccggtaaggggtttttaaccccgg

SEQ ID NO: 396538 - DNA, 674 bp, Homo sapiens
  misc_feature: GZ8MTXP02FHH7N.21.27.C05.1.454.CMB.2.raw
  modified_base (188)..(188): a, c, t, g, unknown or other
  modified_base (202)..(202): a, c, t, g, unknown or other
  modified_base (210)..(210): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccacctgtctgtgtcncgagggggccgccncctctctnacacacgccagtcagtctacgcgctagtacgttggtacgccgtacggacagacaagaactcgtcggaccgacggcccgtacccgacgtccttccttacttacgtttaccggcgacctacctacccgaccggacgggaccctacggtcggttccgtaccgaggtaccgttaggtaccgtagggtcggggtcgggtaggttaggttagggacgtgttaccgtttcctccgtaccaacctcgtaccgacgtcccgtaacccgtacggaagtaggtaagtaagtagtgttacgtacgtttacgttttacttccgtacgacctaagtactaaattaacttaacgttcgtcggtcgtacggtccggtacggtaccgggtaccggaccggtaacggtaacgtaaggtaacgaaacgtaacgaaacgtacgtacggcgtactaacgactacctacttcgtacgttctacgtc

SEQ ID NO: 396539 - DNA, 617 bp, Homo sapiens
  misc_feature: GZ8MTXP02G6P97.21.27.C05.1.454.CMB.2.raw
  modified_base (201)..(201): a, c, t, g, unknown or other
  modified_base (292)..(292): a, c, t, g, unknown or other
  modified_base (387)..(387): a, c, t, g, unknown or other
  modified_base (397)..(397): a, c, t, g, unknown or other
  modified_base (411)..(411): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccaccctgtctgtgtctccgagggggancgccaccctctcctgcacagccagtcagtctatcgctgactggttagcctggtaccagcaagaaatcgtggccaggctccccaggctcctntatttaccgtgcatccaccagggccactggtcgtcccagacacggttcaggtggcggtggagtttgggctagtacgtttctctcgacatccgaanccgaccctanagaggtagaaagtnttggttcgacttaggttttaatttccgtagacccgtagtaactaaattaacttaaagttacccgtgggtccctgggtacccgttacggttaaccggtttccgggaacccgtaaccggggaaaccgaaagggttaacgggaaaacttacgaaaaacgttaccggaggtaggaaccgtcgaacctacgtattccgttcgttacttacg

SEQ ID NO: 396540 - DNA, 688 bp, Homo sapiens
  misc_feature: GZ8MTXP02JXOVG.21.27.C05.1.454.CMB.2.raw
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggagccgccaccctctcctgcaccgccagtcagtctatcgctgacttggttagcctggtacccagcagaaactcgtggccaggcctacccgaggcctcctcatttacccgtgccactcccaccgacgggaccctacgtcggtcgtaccccgagtacgtaggttcccgaggtcggggacggtgggtagtttacggggaactagggttacgtttttctaccgttaccgaacctaactcgaccgcccgtaccccctaagacgtaaggtaggaaagtacttggtagtacttaagtttacttcgtcgaccaagtacctaaattaattaacgtttacgcgggtaaccttcggacggttaccgtaccgggttacccggaccggtaaccggggtaaccctaaagggggtacgtaaaacgttaaccgaaaaccgtacgtttaggggacgtaccttaaggaccctaacgacgtttacgccgtttacctactttaaccccg

SEQ ID NO: 396541 - DNA, 523 bp, Homo sapiens
  misc_feature: GZ8MTXP02H5HH0.21.27.C05.1.454.CMB.2.raw
  modified_base (201)..(201): a, c, t, g, unknown or other
  modified_base (220)..(220): a, c, t, g, unknown or other
  modified_base (355)..(355): a, c, t, g, unknown or other
  modified_base (416)..(416): a, c, t, g, unknown or other
  modified_base (427)..(427): a, c, t, g, unknown or other
  modified_base (433)..(433): a, c, t, g, unknown or other
  modified_base (444)..(444): a, c, t, g, unknown or other
  modified_base (447)..(447): a, c, t, g, unknown or other
  modified_base (487)..(487): a, c, t, g, unknown or other
  modified_base (503)..(503): a, c, t, g, unknown or other
tcagtcgtcgctcgcacgaccggtgctcgatttagacgcgatcgaagggtttggggcagagcctgctgacttctggctgaccagggcagtcaccggagctccagacaatgtctgtctccttcctcatcttcctgcccgtgctgggcctccatgggtgtcctgtcacagatcaaactacagcagtctggtccaggactggtnaggcctcgcagaccctttnactcactgtgacatctccggggaaaatgtcgctggcaacaatggttggaattggattaggcagtccccgtcgagagccttgagtggcttggaaggacctattacacgtcccagtggtactgaagtactatgcagnttactgtgagcggtcgtactcaccagtccaccctagaccacgtaccaagaactcgaagtcncctacactaancgtctntcactcccganacncggactacgtttattgtagcagtaggactcacattcggtnactaacctctactacncgtacgggcctaaggtaccg

SEQ ID NO: 396542 - DNA, 651 bp, Homo sapiens
  misc_feature: GZ8MTXP02GD8GA.21.27.C05.1.454.CMB.2.raw
  modified_base (203)..(203): a, c, t, g, unknown or other
  modified_base (252)..(252): a, c, t, g, unknown or other
  modified_base (273)..(273): a, c, t, g, unknown or other
  modified_base (304)..(304): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggganccgcccaccctctcctgcacagccagtcagtctatcgctgacttggtancctggtaccagcaagaatcgngccaggcctccgagctcctctactttaccgngccactcccaccgacgggccacgttcggtccaccccgagtaccgtacggttacgaggtgggcgggttaggtacggtttaggggacctaggttacgtttttccgtaccttaccgaccgtaactccgaacggtccctacccctaagacgtagtagaaagtgttgtacgtcgttaagttttcttcgcgtacctaggtataaagttaattaacgtcgtacggtccttagtccggtacgtaccgggttccggacccggaaaaccggggtaccaaaggggttacgaaaaccgtaccgtaaaacgtacgttcggtcgaacgtcgacctaacgtgttcctcgttaccctttaccg

SEQ ID NO: 396543 - DNA, 690 bp, Homo sapiens
  misc_feature: GZ8MTXP02FXP0V.21.27.C05.1.454.CMB.2.raw
  modified_base (160)..(160): a, c, t, g, unknown or other
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtntcctgtcacagatcaaactacagcagtctggtccaggactggtgacggccctcgcagtacccttcactcacctgtcgactatcgtaccggggaaatgtacgctggacacaatggtaggattggattaggacacgtccccgtgagaggcctgagtggcgttaggaacggtacctagttactaccgtcctaaggtggtagtacgaagtactaagtgaccagtattctggttgaacgtcgggttacggtacttcaaccacgttacccgaaacccgacgaacctaaccgttaacccgaaacgtaaaacggtcctaacgggttacccttccctaccctaaccttaaactcgggttactactaccgtaaccgttcccccggaaacgtacccgtaaccggttccctttaacggttttatttttacgggtacgtaaaccgtaaggtaaacggggtaactaccgtaactacggtttacgcgttaacctaaccggttctaacgttcgtacccgtacggggaccttaacggggttaaccgg

SEQ ID NO: 396544 - DNA, 610 bp, Homo sapiens
  misc_feature: GZ8MTXP02H75N4.21.27.C05.1.454.CMB.2.raw
  modified_base (164)..(164): a, c, t, g, unknown or other
  modified_base (185)..(185): a, c, t, g, unknown or other
  modified_base (201)..(201): a, c, t, g, unknown or other
  modified_base (234)..(234): a, c, t, g, unknown or other
  modified_base (258)..(258): a, c, t, g, unknown or other
  modified_base (309)..(309): a, c, t, g, unknown or other
  modified_base (422)..(422): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgnagtctcagccacctgtctgtntctccggagggggacncgccaccctctcctgcacagccagtcagtctancgctgctggttacgcctggtaccngacaagaaactcgtggccaggcctccaggtcctcctacttaactttccggngactacgtacccaacgacggggtaccaggttcgggctaccccaagggctacggtcgaggttcgggaggtggtaagttcggggactagggtttacttttccacgtaccaaactntacccacgccgacctagaggagagaagtgtgttagtacgtttagtttacttcgtcgactagtactaaatactaagttacgtcgtacgtagtcgtacgtaccggtcggaaccgtaacggacgtaggaaacgtaaacgtaaccgaaacgtacgtaggtacgtcgacactactacgttactcgttacttcg

SEQ ID NO: 396545 - DNA, 780 bp, Homo sapiens
  misc_feature: GZ8MTXP02FMB6H.21.27.C05.1.454.CMB.2.raw
  modified_base (200)..(200): a, c, t, g, unknown or other
  modified_base (253)..(253): a, c, t, g, unknown or other
  modified_base (330)..(330): a, c, t, g, unknown or other
  modified_base (577)..(577): a, c, t, g, unknown or other
tcagtcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccggagggggnccgccaccctctccctgcacagccagtccagtctatcgctagactgggttacncgttaggtaccaggtcaaggtaaatcgtcgggacctacggaccctcccgaggtcctaccgtactaccgttttaccgngtacctacctcccgaccgtcggggaccctgtccgggttacgaccccaaggaccgtaggttccgaggtcggggtacggttggtagtttcggggaacttgggttacgtttttcctcgtaccctaaccgtatccgaaacgtcccgtacccttagaacggtgtaaacggagtagttcggtttacggtaactttaagtttttcgtcttaccgggaactacggtaataaaagtttaattaaacggttttaccncgggttcccgtttacggggacccgtttaaccggggtaccccgggtttacgggaacccccggaacgggggtaaacccggtaaaaggggtaaaccgggtttaaaactaaaacccccgggaacgtaacccgggttcgttaccccggggtaaacgtaacccgtaaccttaccgttacgtttacctaccgtttaccttacgttacccg

SEQ ID NO: 396546 - DNA, 646 bp, Homo sapiens
  misc_feature: GZ8MTXP02GM51B.21.27.C05.1.454.CMB.2.raw
  modified_base (204)..(204): a, c, t, g, unknown or other
  modified_base (385)..(385): a, c, t, g, unknown or other
  modified_base (422)..(422): a, c, t, g, unknown or other
  modified_base (438)..(438): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtactccgaggggggancggccacctctcctgccaccgccagtcagtctatcgctgactggttagcctaggtaccagcagaaactctggccaggctcccgaggcctccgtcattttacctgcactccaccgaggcctacgtggtctcccagacgtaggttcccaggtggcggtaggtatttagggactagtcgtttcncgtcacgtatcacgcgaccctagacgtgtagaaagtntcgttagctaagtttntcgtagacccgtaagtacctaaattactaaaacgttcgtacgggtacctaggtaccggtacgtacggttaccgacccgaacgggggtaaacctaacgggttaaacgggaaaaccttaaccgtaaaaaccggacgtttacggtaccgggtacgttaacggaacccctaacgttaaaccggttacttcggttacctttacgttaaacccg

SEQ ID NO: 396547 - DNA, 682 bp, Homo sapiens
  misc_feature: GZ8MTXP02I2BFO.21.27.C05.1.454.CMB.2.raw
  modified_base (324)..(324): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctccccagacaccactggagtgattgtgatgacgcagtctccagcccacctgtctgtgtctccgaggggggacccgccaccctctcctgcacacgccagtcagtctacgtcgctgtacgtggttacgccgtcggtaccagacaagtaatccgtcggaccgacgcctaccgacgcctcctctacgtttaccgcncacgtcccaccgacgggccctagtcggtccgtaccaggtacctcggttccgaggtcgggtcggttaggtacgttagggcgtagtttcgttttcctctaccacctatccgacgccgtaccctaagagtagtagtaagtagttgttacgtacgttagtttctttccgacggactaacgtacttaaattaacgttaaaccgttcgtacggtccgtacggtaccggtccgttaccgggtccggtaacccggtaacccggtaaacggtaaaggtaacggtaaaaccgtaacccgaaaacggtaccgttaacgggtcgtaaccgtcgaccctaaccgttacgttaccgttacgtttaccgttac

SEQ ID NO: 396548 - DNA, 797 bp, Homo sapiens
  misc_feature: GZ8MTXP02FRBQ5.21.27.C05.1.454.CMB.2.raw
  modified_base (205)..(205): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtcctccggaggggggacnccgcccacccgtctcctgccacgacgccgatcagttctactcgctggacgttggtacgccgtggtaccgagtaccaagtaaactcgtcggaccgacggtaccccgtccccgacggtccttaccccttaccttaacgtttacccgtacggacctaccttaccccgaccgaccgggacctacggttccggttccgaccgaacggtacacggtttcacgggtgggcgggtgggttacgttaggggaccgttaggtttaccggtttctacccttacgaacccgtccgtagtaccgcccgttaacccgtaagtacgggtaacggtaagtaaaggtacgtttgtttaacgacggttttacttttaaacggttttcacggtacccgtaagttaacctaaatttaaacttaacgtttacggtaccgtacgttacgtaccgggttacccgtaaccgggttaccgggaccgggtaaaacccgggggaacggtaacgggggttaaaccggaaaaccttaaaccgggtaaaccggtaaacggtcccggtaggtaacccgtacggacctaacccgttggttccccgttagttaccccgtttaccg

SEQ ID NO: 396549 - DNA, 794 bp, Homo sapiens
  misc_feature: GZ8MTXP02JF0EC.21.27.C05.1.454.CMB.2.raw
  modified_base (202)..(202): a, c, t, g, unknown or other
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtctccgagggggnccgccaccctctcctgcacagccagtcagtctatcgctgacgttggtacgtcctgggtacccaggacaagtaaactcgtacggccacggcctaccccgaggtcccttacctcttaacgtttaccgtcgcctaacgtccccaacccggacggggtacccctaacggttccgtacgtaccccaggtacgtaaccgtcggtaggtacgggtcggttgggttaacggtttagggaccttaggtttacggtttttacctccgttacctaacccgtagtccgtaaccgcccgttaaacccccgttaaggaacggtaacggtttaagggaaaacgttacgtttagggttcgtaaacgttttacggtttaaactttccgtacgtaccgtaaacgtaacctttaaacgttaaactttaaacgtccgttcggtacccggttggtaacccgggttcgtacccgggttacccgggtacccggtaaacgggggtaaccgtaaaagggggtacccgtaaaaacgttaacccggaaaacgtaccggttaacggtccggtaacctacggaacccttacggtacttccgttaacgtttccttaacccgg

SEQ ID NO: 396550 - DNA, 470 bp, Homo sapiens
  misc_feature: GZ8MTXP01CN65O.13.23.C01.1.454.CMB.2.raw
  modified_base (342)..(342): a, c, t, g, unknown or other
  modified_base (372)..(372): a, c, t, g, unknown or other
  modified_base (381)..(381): a, c, t, g, unknown or other
  modified_base (460)..(470): a, c, t, g, unknown or other
tcagtcacgtactacacgaccggtgctcgatttagtacacgtgattagggattgggtgcgacaggctcctggacaagggcttgattggatgggatggatcgacatcaacactgggaacccaacgtatgcccagggcttcacaggacggtttgtcttctccttggacacctctgtcagcacggcgtatgtacagatcagcagcctaaaggctgagacactgccatttatactgtgtgagagtattctttccttgactacggtacttctgtcctgactacgtgggccagggaaccctggtcagcgtctcctcagcctccaccaaggcccatccggtctcccccngccgcctcgctccaggacgcaaccctccgngacgccacncgccggcccctggggctgcccgtggtacaaggtctacttcctagtacgtgactgagcgggctggggcaaggcgcagtgnnnnnnnnnnn

SEQ ID NO: 396551 - DNA, 603 bp, Homo sapiens
  misc_feature: GZ8MTXP01AQ4B2.13.23.C01.1.454.CMB.2.raw
  modified_base (576)..(576): a, c, t, g, unknown or other
tcagtcacgtactacacgaccggtgctcgatttagtacacgtgattagggattggggtccttaaattcaggttccagctcacatggaaaatactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctcatctgcagtgtctctggtggctccttcagcagtggtagtttctactggagctggacttcccggcacggccccggccggggaagggacctgggaggtgggatttggggctttagtccaaagttcggccgaaggtcggggggccaaacccgaggcctaaccgaaaccccctccctacgaacgacggcccgcgtccaactacgtttcaagtacgacgaaccgtaccaaagaacccagcctactccctagaacggctgtagttcctgtcgacccgcgacacgaccacgggcccgtagtaacttacgttgtcgcggcgtcgagggttggacgtcggngggccagggaccacggtcgaaccgtcc

SEQ ID NO: 396552 - DNA, 419 bp, Homo sapiens
  misc_feature: GZ8MTXP01AEPJA.13.23.C01.1.454.CMB.2.raw
  modified_base (408)..(419): a, c, t, g, unknown or other
tcagtcacgtactacacgaccggtgctcgatttagtacacgtgattagggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctcaccaagggcccatcggtctccccctggccgccctgctccaggagcacctcgagacgcacgagccggccctggggcctggcctggtcaaggtactacttccagtacgtgactgagcgggctggcaggcgcatagnnnnnnnnnnnn

SEQ ID NO: 396553 - DNA, 587 bp, Homo sapiens
  misc_feature: GZ8MTXP01DLTDX.13.23.C01.1.454.CMB.2.raw
  modified_base (327)..(327): a, c, t, g, unknown or other
tcagtcacgtactacacgaccggtgctcgatttagtacacgtgattagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactcgtgaaggccgattcaccgtctccagggacaactccaaagaacaccttatatctgcagatgaaacagccctgagaggtgacgactcggctgtatacttctgtgcgaanaaacatgatgtttggagtggatgtgttacttctaccatacggaatgggacgtcggtgggccgtaacgggaccgcggtcaccgtctcctcacgccctaccaccaacgggccctacgtccggggtcccttcccccgtcggccctacccctccctcccgaacgacgccaccgtcgtcgggggcaacgacgccggcccgttcgggctcgacccgttcggttacgaacggtaccttaacgttccgtagttacgtcgcgtaacggg

SEQ ID NO: 396554 - DNA, 568 bp, Homo sapiens
  misc_feature: GZ8MTXP01E1OP1.13.23.C01.1.454.CMB.2.raw
  modified_base (328)..(328): a, c, t, g, unknown or other
  modified_base (411)..(411): a, c, t, g, unknown or other
  modified_base (498)..(498): a, c, t, g, unknown or other
tcagtcacgtactacacgaccggtgctcgatttagtacacgtgattagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccaggacaactccaagacaccttatatctgcagatgaacagcctgagaggtgacgactcggctgtatacttctgtgcgacaaacntgatgtttggagtggatgtagtacttctacactacgggaatcgggacgtcgtggggaccgaagggccgcggtcaccgtctccncgacgcctaccaccgaacgggcccacgtccggggtccttccccgtcggcccaccctccgtccaagacgcctaccgtcgtcgggggcncgcgcggcccgttgggcgtcgccgttgttcgaaggtactaacgttccgtagttacgtcgttcgtaacggg

SEQ ID NO: 396555 - DNA, 668 bp, Homo sapiens
  misc_feature: GZ8MTXP01BRDGY.13.23.C01.1.454.CMB.2.raw
  modified_base (245)..(245): a, c, t, g, unknown or other
  modified_base (271)..(271): a, c, t, g, unknown or other
tcagtcacgtactacacgaccggtgctcgatttagtacacgtgattagggattggggtccttaaattcaggttccagctcacatggaaaaatactttctgagagtcctggacctcctgtgcaagaacatgaaacatctgtggttcttcctcctcctggtggcagctcccagatgggtcctgtcccaggtgcagctgcaggagtcgggcccaggactgggtgaggccttcacagaccctgtccctnatctgcagtgtctcgtggtgctcctnagcagtggtagtttctacgtggagcgtggactccggcgaccggccccggacggggaagggcgtgggaggtgggtagttcgggtacttagtacgaacgtcggaccgtagggtcgggggccaaacccgacgtccctaacccaaccccctcccgtacgaacgacgcccgcgtacccacctattacgagtacgaccaaccgtaccaaacgaacccgagtccctacctacccgtaggaacgtcttaggtacgttcgtcggtccgacccggccgacgacgaccgaccggtccgttgtaacttacgttggtacgccggacggaacgttacgggttcggttacggttcgggacggggaacccgaacggggtaccccgttaccgggtaaccgttaacccgttcccg

SEQ ID NO: 396556 - DNA, 382 bp, Homo sapiens
  misc_feature: GZ8MTXP02I7NFK.13.23.C01.1.454.CMB.2.raw
  modified_base (378)..(382): a, c, t, g, unknown or other
tcagtcacgtactacacgaccggtgctcgatttagtacacgtgattagggattgggcttatcaatgccagtggggcaccagctacaaccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttcccctggcgccctgctccaggagcacctccgagagcacagcggccctgggctgcctggtcaaggactactcctagtacgtgacctgagcgggctggcaaggcgcatagnnnnn

SEQ ID NO: 396557 - DNA, 379 bp, Homo sapiens
  misc_feature: GZ8MTXP02HH1HB.13.23.C01.1.454.CMB.2.raw
  modified_base (377)..(379): a, c, t, g, unknown or other
tcagtcacgtactacacgaccggtgctcgatttagtacacgtgattagggattgggcttatcaatgccagtggggcaccagctacaaccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccacaaggcccatcggtctcccctggcgccctgctccaggagcacctccgagagcacagcggccctgggctgcctggtcaaggactacttcctagtacgtgacctgagcgggctggcaagggcgcatagnnn

SEQ ID NO: 396558 - DNA, 382 bp, Homo sapiens
  misc_feature: GZ8MTXP02GY8HV.13.23.C01.1.454.CMB.2.raw
  modified_base (274)..(274): a, c, t, g, unknown or other
  modified_base (377)..(382): a, c, t, g, unknown or other
tcagtcacgtactacacgaccggtgctcgatttagtacacgtgattagggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaaggcccatcggtctccccnggcgcctgctccaggagcacctcgagagcacagccgaccctgggctgcctggtcaaggctactcctagtacgtgacctgagcgggctggcaagggcgcatagnnnnnn

SEQ ID NO: 396559 - DNA, 499 bp, Homo sapiens
  misc_feature: GZ8MTXP02H0HZQ.13.23.C01.1.454.CMB.2.raw
  modified_base (189)..(189): a, c, t, g, unknown or other
tcagtcacgtactacacgaccggtgctcgatttagtacacgtgattagggattgggggcagaagtctctctcagtcaggacacagcatggacatgagggtccctgctcagctcctgggactcctgctgctctggctcccagataccagatgtgacatccagatgacccagtctccatcctccctgtctncatctcttggagacagagtcaccgtcacttgccgggcagtcacgacattaacactattagcctggtatcagcagaagccagggagagtccctaaattatagatctctgctgcgtccgccttgcaacgtcgggggtcccagtctcggttcagtggcggttggatctaggacagtaaattcactctcaccatccacaacctgcaccctgaagatgttagaagttattaactgtacagacctatagtggtgccgctcatttcggcggaggaccaaggtcgcagataacgaaacgaacgtcgaggctagcaacc

SEQ ID NO: 396560 - DNA, 465 bp, Homo sapiens
  misc_feature: GZ8MTXP02FGP2N.13.23.C01.1.454.CMB.2.raw
  modified_base (455)..(465): a, c, t, g, unknown or other
tcagtcacgtactacacgaccggtgctcgatttagtacacgtgattagggattgggtgcgacaggctcctggacaagggcttgagtggatgggatggatcgacatcaacactgggaacccaacgtatgcccagggcttcacaggacggtttgtcttctccttggacacctctgtcagcacggcgtatgtacagatcagcagcctaaaggctgaggacactgccatttatactgtgtgagagatttcttccttgactacggtacttctgtcctgactactggggccagggaacccctggtcagcgtctcctcagcctccaccaagggccccatccggtcttcccccctggccgcccctgcctcccaggagcaccctccgagacgcacagccgcctgggctgccctggtcaaggctacttccagtacgtgactgagcgggctggcaaggcgcatagnnnnnnnnnnn

SEQ ID NO: 396561 - DNA, 483 bp, Homo sapiens
  misc_feature: GZ8MTXP02HARK8.13.23.C01.1.454.CMB.2.raw
  modified_base (452)..(452): a, c, t, g, unknown or other
  modified_base (468)..(483): a, c, t, g, unknown or other
tcagtcacgtactacacgaccggtgctcgatttagtacacgtgattagggattgggtgcgacaggctcctggacaagggcttgagtggatgggatggatcgacatcaacactgggaacccaacgtatgcccagggcttcacaggacggtttgtcttctccttggacacctctgtcagcacggcgtatgtacagatcagcagcctaaaggctgaggacactgccatttattactgtgtgagagtattctttcctgactacggtacttctgtccttgactactggggccaggaacccctggtcagcgtctcctcagcctccaccaagggccccatccggtccttcccccgtggccgcccctcgcctccccaggacgccaccctccgagagccacacgccgggcccctggggcctcgcctggtcaaaggctacttccagtacgtgactgagcggntggcaaggcgcatagnnnnnnnnnnnnnnnn

SEQ ID NO: 396562 - DNA, 396 bp, Homo sapiens
  misc_feature: GZ8MTXP02FLR2H.13.23.C01.1.454.CMB.2.raw
  modified_base (271)..(271): a, c, t, g, unknown or other
  modified_base (275)..(275): a, c, t, g, unknown or other
  modified_base (288)..(288): a, c, t, g, unknown or other
  modified_base (305)..(305): a, c, t, g, unknown or other
  modified_base (364)..(364): a, c, t, g, unknown or other
  modified_base (372)..(396): a, c, t, g, unknown or other
tcagtcacgtactacacgaccggtgctcgatttagtacacgtgattagggattgggcttatcaatgccagtgggggcaccagctacaacccctccctcaagagccgcgtcaccatttcagtagacacgtccaagaacccagctctccctgaagctgagttctgtgaccgccgcagacacggccgtgtattactgtgcgcgacaggtggacgtctggggccaagggccacggtcaccgtctctcagcctcacaaggcccatcggtctccccnggcnccctgctccaggngcacctcgagagccacngcggccctgggctgcctgcaaggctactcagtcgtgacctgagcgggctggcaagggcncagtacgnnnnnnnnnnnnnnnnnnnnnnnnn

SEQ ID NO: 396563 - DNA, 485 bp, Homo sapiens
  misc_feature: GZ8MTXP01EF6TP.19.22.B11.1.454.CMB.2.raw
  modified_base (346)..(346): a, c, t, g, unknown or other
  modified_base (403)..(403): a, c, t, g, unknown or other
  modified_base (465)..(465): a, c, t, g, unknown or other
  modified_base (470)..(470): a, c, t, g, unknown or other
  modified_base (472)..(472): a, c, t, g, unknown or other
  modified_base (477)..(477): a, c, t, g, unknown or other
  modified_base (479)..(479): a, c, t, g, unknown or other
  modified_base (483)..(483): a, c, t, g, unknown or other
  modified_base (485)..(485): a, c, t, g, unknown or other
tcagtactctcgtgcacgaccggtgctcgatttagacgacagctcagggcagcaagatggtgttgcagacccaggtcttcatttctctgttgctctggatctctggtgtcttcgggacatcgtgatgacccagtctccagactccctggctgtgtctctgggcgagagggccaccatcaactgcaagtccagccagaatatttatacaactccaataataagaactacttagcttggtccagcagaaaccaggacagcctctaagatgctctttatggcatctgcccgggaatccggggtcctgaccgatttcagtggcagcggtctgggacagatttcactctcnccatcagcggcctgcagggctgaagatgtggcagtttattactgtcagcaattttanaggtactcctgacgttcgccaaggccaagtggaaatcaaacgaatgtgctgcacattcgttnttctntntctcncnctcngn

SEQ ID NO: 396564 - DNA, 511 bp, Homo sapiens
  misc_feature: GZ8MTXP01BJSQ2.19.22.B11.1.454.CMB.2.raw
  modified_base (394)..(394): a, c, t, g, unknown or other
  modified_base (404)..(404): a, c, t, g, unknown or other
  modified_base (414)..(414): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttatacaactccaataataagaactacttagcttggttccagcagaaaccaggacagcctctaagatgctctttatggcatctgcccggaatccgggtcctgaccgattcagtggcagcgggtctgggacagatttcactctcaaccatcagcggcctgcaggctgaagatgtgctagtttatactgcagntaaattttanacgtactcgngacgttcgaccgaagggacaaggtagtaaatacgaaacgatggtgcgtcgcgactacttcgttcgttctctctcttcctccttactcgttcgtaacg

SEQ ID NO: 396565 - DNA, 589 bp, Homo sapiens
  misc_feature: GZ8MTXP01BHEP2.19.22.B11.1.454.CMB.2.raw
  modified_base (207)..(207): a, c, t, g, unknown or other
  modified_base (224)..(224): a, c, t, g, unknown or other
  modified_base (253)..(253): a, c, t, g, unknown or other
  modified_base (349)..(349): a, c, t, g, unknown or other
  modified_base (373)..(373): a, c, t, g, unknown or other
  modified_base (392)..(392): a, c, t, g, unknown or other
  modified_base (417)..(417): a, c, t, g, unknown or other
tcagtactctcgtgcacgaccggtgctcgatttagacgacagctcaggggcagcaagatggtgttgcagacccaggtcttcatttctctgttgctctggatctctggtgtcttcgggacatcgtgatgacccagtctccagacctccctggctgtgtctctgggcgagagggccaccatcaactgcaagtccagccagaatatttanacaactccaataataanaactacttagcttggtccagcagaaaccnggacagcctctaagatgcttctttatggcatctgcccgggaatccgggtcctgaccgattcagtggcagcgggtctggggacagatttcactctcnccatcagcggcctgcaggctgaanagtgtaggctaaggttttnttacgtgtcaagtctaaatttttanagggttaccttccccgttgggaccgtttccggacccgaaaggggtacccaaaggggttcgaaaagttccgaaaaacggaacgttggtagggttccttacgaccgtaaccaacttcggttcttccctttaacgacttccctttccccggacccttaattcccttggaaacccg

SEQ ID NO: 396566 - DNA, 504 bp, Homo sapiens
  misc_feature: GZ8MTXP01DML4E.19.22.B11.1.454.CMB.2.raw
  modified_base (207)..(207): a, c, t, g, unknown or other
  modified_base (352)..(352): a, c, t, g, unknown or other
  modified_base (462)..(462): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagaactacttagcttggttccagcagaaaccaggacagcctcaagatgctctttatgggcatctgcccggaatccggggtccctgaccgatttcagtggcaggcggtctcgggacagtatttcactctcncatcagcggcctgcaggctgaagatgtggctagtttatactgtcagctaatttataggtactcccgtggacgttcgccgaagggaccaaaggtgaaatcgaaacgcttgnggctgcaccattcttgttcttcatccttcccgcatcttgaac

SEQ ID NO: 396567 - DNA, 512 bp, Homo sapiens
  misc_feature: GZ8MTXP01DLRU7.19.22.B11.1.454.CMB.2.raw
  modified_base (208)..(208): a, c, t, g, unknown or other
  modified_base (349)..(349): a, c, t, g, unknown or other
  modified_base (488)..(488): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaataataaagaactacttagcttggtccagcagaaaccaggacagcctcaagatgctctttatggcatctgcccggaatcccgggtcctgaccgattcagtggcaggcggtctgggacagtatttcactctcnccatcagcgcctgcaggctgaagatgtggctagtttatactgtacagcttaaatttatacggtactcccgtggacgttcgaccgaacgggacaagggtgaaatacaaacgaactgtggctgcacctattcgttgttctnactcttcccgccttatccttgaac

SEQ ID NO: 396568 - DNA, 587 bp, Homo sapiens
  misc_feature: GZ8MTXP01D9Q3N.19.22.B11.1.454.CMB.2.raw
  modified_base (208)..(208): a, c, t, g, unknown or other
  modified_base (355)..(355): a, c, t, g, unknown or other
  modified_base (417)..(417): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaataataagaactactagtcttggtccagcagaaaccaggacagcctactaagatgctctttatggcatcgtgcccggaatcccgggtcctgaccgattcgagtgcaggcgggtctcggggacagtatttcactactcnccatcagcggccagttcaggctagaagatgtcgatagtttatactgtacagtactaaatttntacgttactccgtggtacgttcggaccgtaacgggaaccgtaaagggtacgtaaataacgaaaacgtaacgtaaggtcggacgttagaccgaaccgtaacttcttacggttccctttcctaacgtttccctttaccccggacccttacttaacccgttcggtaaacccgg

SEQ ID NO: 396569 - DNA, 524 bp, Homo sapiens
  misc_feature: GZ8MTXP01BHQMZ.19.22.B11.1.454.CMB.2.raw
  modified_base (208)..(208): a, c, t, g, unknown or other
  modified_base (410)..(410): a, c, t, g, unknown or other
  modified_base (481)..(481): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaataataagaactacttagcttggttccagcagaaaccaggacagcctctaagatgctctttatgggcatctgcccgggaatccgggtccctgaccgattcagtgcaggcgggtctgggacagtatttcactctcaacatcgagcgcctgcaggctgaagatgtggctagtttatactgtcagtctaattttanaggttactcccgttgggacgttcggaccgaaaggggaccaaagggtaggaaatacaaacgaacttgacggntgcaccctattcttgttcttcactccttcccgccatcttgaac

SEQ ID NO: 396570 - DNA, 530 bp, Homo sapiens
  misc_feature: GZ8MTXP01D1L86.19.22.B11.1.454.CMB.2.raw
  modified_base (209)..(209): a, c, t, g, unknown or other
  modified_base (350)..(350): a, c, t, g, unknown or other
  modified_base (352)..(352): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggcccaccatcaactgcaagtccagccagaatattttanacaactccaaataataagaactacttagcttggtccagcagaaaccaggacagcctactaagatgctctttatggcatctgcccggaatccggggtcctgaccgattcagtggcagcgggtctgggacagtatttcactcncnccatcagcgcctgcaggctagaagatgtggctaagtttatactgtcagtctaaattttatagggttactcccgtggtaccgttcgaaccgtaagggaccgtaaaggtacggaaatacgaaacgtaactggtggactgacacctattccttgttcttcactccttcccgcatcttgaac

SEQ ID NO: 396571 - DNA, 555 bp, Homo sapiens
  misc_feature: GZ8MTXP01A9K82.19.22.B11.1.454.CMB.2.raw
  modified_base (208)..(208): a, c, t, g, unknown or other
  modified_base (358)..(358): a, c, t, g, unknown or other
  modified_base (524)..(524): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctcgtgggcgagagggccaccatcaactgcaagtccagccagaatatttanacaactcaataataagaactacttagcttggtccagcagaaccaggacagcctctaagatgcttctttagtggcatctcggcccgggaatcccggggtcctgaccgtattcgagtggcaggcgggtctgggactagtatttcactctacnccatcagccgctgcaggctagaagatgtggacttagtttatacgtgtaccagtacttaatttatacgggtactcccgtaggaccgttcggaacccgaagggacctaaaggtacgaaaatcgaaaaccgaagtgtcggctgaccaacgtacttcgttcttcttaacncttaacccttcccgacttactcgttcgaacg

SEQ ID NO: 396572 - DNA, 613 bp, Homo sapiens
  misc_feature: GZ8MTXP01DONJP.19.22.B11.1.454.CMB.2.raw
  modified_base (209)..(209): a, c, t, g, unknown or other
  modified_base (356)..(356): a, c, t, g, unknown or other
  modified_base (385)..(385): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagacctccctggctgtgtctcgtgggcgagagggccaccatcaactgcaagtccagccagaatatttanacaactccaataataagaactacttagcttggtccagcagaaaccaggacagcctactaagatgctctttatggcatctgccccgggagtcccggggtcctgaccgtattcgagtggcaggcggtctgggacagattcactcctacnccatccgagccgcctgcgaggctagaagngtgtggacttagtttattacgtgtacagtacttaaattttacacggttacctcccgttagggtaccggttccggacccgtaaagggtaacccgtaaaggggttacgaaaacgtaccgtaaaacggtaaccgttgggtcggaccgttacggacctaaacctcgttaccttcgggttacctttccaactttcccgttccccgacttacgttccgttaacgggtaaacccg

SEQ ID NO: 396573 - DNA, 634 bp, Homo sapiens
  misc_feature: GZ8MTXP01A8I68.19.22.B11.1.454.CMB.2.raw
  modified_base (208)..(208): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctcgtgggcgagagggccaccatcaactgcaagtccagccagaatatttanacaactaccaataataagaactacttagcttggtccagcagaaaccaggacagcctactaagatgcttctttatggcatcgtcggccccgggaatcccggggtcctggaccgtattcgaggtggcaggtcgggtcgtcgggactagtactttcactctcaaccatcgagccggctgcaggctagaagatggtaggtactaaggttttatacgtgtacaagtacttaaattttacgtacggttaccttcccggttagggtaaccggtttcgggaacccgaaaggggtaacccgtaaaaggggttacggaaaacttaccgaaaacgtaacgttgggtacgttacgtcgttacccgaacccgtattccttgttaccctttaacaccgtttccccttccccggaccttaacgtcccgttaacgaaaccgg

SEQ ID NO: 396574 - DNA, 535 bp, Homo sapiens
  misc_feature: GZ8MTXP01B1MXM.19.22.B11.1.454.CMB.2.raw
  modified_base (207)..(207): a, c, t, g, unknown or other
  modified_base (350)..(350): a, c, t, g, unknown or other
  modified_base (352)..(352): a, c, t, g, unknown or other
  modified_base (520)..(520): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagaactacttagcttggtccagcagaaaccaggacagcctactaagatgcttctttatggcatctgcccgggaatcccggggtcctgaccgattcagtggcaggcgggtctgggacagatttcactcncnccatcagcgcctgcaggctgaagatggtgctagtttattactgtcagtactaattttatacggtacttcccgtggtaccgttcggaccgaagggaccaaaggggtacgtaaatacaaacgaactggacggttctagccaccgtattcgttgttcttcactccgttccnccttatcttgaaccg

SEQ ID NO: 396575 - DNA, 597 bp, Homo sapiens
  misc_feature: GZ8MTXP01D7BQW.19.22.B11.1.454.CMB.2.raw
  modified_base (207)..(207): a, c, t, g, unknown or other
  modified_base (343)..(343): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagaactacttagcttggtccagcagaaaccaggacagcctctaagatgctctttatggcatctgcccggaatccgggtcctgacgattcagtgcagcggtctgggacagtattcactctcncatcagcgctgcaggctagaagatgtggctaagtttattacgtgtacagtactaaatttttagtaacgggttacccttccccggttaggtaacccggtttaccgggaacccgaaacggggaacccgtaaaaggggtagggtaaaacttacgaaaaaccgaagttcggttagggcttacggacgaattcttaacgttccttacggttcctttaccaacgtttccccgtccccgttacctaaccgttctaaccggg

SEQ ID NO: 396576 - DNA, 622 bp, Homo sapiens
  misc_feature: GZ8MTXP01BAQVQ.19.22.B11.1.454.CMB.2.raw
  modified_base (208)..(208): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctcgtgggcgagagggccaccatcaactgcaagtccagccagaatatttanacaactaccaataataagaactacttagcttggtccagcaagaaaccaggacagcctactaagatgcttctttagtggcatcgtcggcccggaacgtcccgggggtccctggaccgtattcgaggtggcgaggcggggtctcggggactagtactttcacttctaccaaccatcgacgccgctgcgtaggctaggaagtagtggtgtacttaagtttacttacgtgtacagtacttaaattttacgtacggttaccttcccgttaggtaccggttccggaacccgaaagggtaaccgtaaagggtagtaaaacttacgaaaaccgtagttggtacgggctacgaccaacccgtattccgttcgttcctttccactttccccgtttccccgacttacttcccgttcgtaaacccg

SEQ ID NO: 396577 - DNA, 599 bp, Homo sapiens
  misc_feature: GZ8MTXP01EVAAL.19.22.B11.1.454.CMB.2.raw
  modified_base (210)..(210): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagacctccctggctgtgtctcgtgggcgagagggccaccatcaactgcaagtccagccagaattatttanacaactcaaataataagaactacttagcttggtccagcaagaaaccaggacagcctacaagatgcttctttagtggctatcgtcggacccgggtaagtccccgggggtcctggacccgtatttcgaggtggcaggcgggtctgggacagtacttcactctcaaccatcgacgccggtcctggcagggctaggaagtagtggtggcttaagtttacttacgtggtactagtacttaaattttcgacggttacctcccggtaggtaccgttcggaaccgaagggaccgtaaaggtaggaaactaccgaaacgtaactggacgttcgtacgactaccctagttcgttcttaccttaactcttcccgttccccattacttcgttaacgaaccg

SEQ ID NO: 396578 - DNA, 548 bp, Homo sapiens
  misc_feature: GZ8MTXP01ANG6Z.19.22.B11.1.454.CMB.2.raw
  modified_base (207)..(207): a, c, t, g, unknown or other
  modified_base (363)..(363): a, c, t, g, unknown or other
  modified_base (365)..(365): a, c, t, g, unknown or other
  modified_base (421)..(421): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagaactacttagcttggtccagcaagaaaccaggacagcctactaagatgcttctttagtggcatcgtcgccccgggaatcccgggggtcctggaccgtattcgaggtggcaggcgggtctcgggacagatttcactctcncntcagccggctgcaggctgaagatgtggctagtttatactgtcagtctaaattttanaggtactccgtggtaccgttcggaccgaagggaccaaagggtagaaactacgaaaacgacgtgtacggcgtacgccgaacctagttcttcgttcttcacttccctcccgccttatccgttcgaaccg

SEQ ID NO: 396579 - DNA, 640 bp, Homo sapiens
  misc_feature: GZ8MTXP01DEAKP.19.22.B11.1.454.CMB.2.raw
  modified_base (207)..(207): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactaccaataataagaactacttagcttggtccagcagaaaccaggacagcctactaagatgcttcttttagtggcatcgtgcccgggaatccggggtcctgaccgtattcgagtggcacggcggtctgggacagtatttcactctcaaccatcagcggcctgcaggctagaagtacgtgtggtactaagttttatacgttgtacgagtaccttaaaatttttacgtaacgggtttaacccttcccggttcgggtaaaccggtttaccggacccggaaaaggggtaccctaaaaggggttaagggtaaaaactaccgaaaaacccggtaacgttaaggtcgggaccttacggacccaaacccttcgttacgttcgttacctttaacctacctttcccgtaccccgaccttacttaaccgttaacgaaccg

SEQ ID NO: 396580 - DNA, 590 bp, Homo sapiens
  misc_feature: GZ8MTXP01DHRD1.19.22.B11.1.454.CMB.2.raw
  modified_base (207)..(207): a, c, t, g, unknown or other
  modified_base (349)..(349): a, c, t, g, unknown or other
  modified_base (355)..(355): a, c, t, g, unknown or other
  modified_base (427)..(427): a, c, t, g, unknown or other
  modified_base (533)..(533): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactaccaataataagaactacttagcttggtccagcaagaaaccaggacagcctactaagatgcttcttttagtggctatccgtcggaccccgggtaagtcccgggggtccctgaccgtattcgagtggcaggcggtcncggacngattcactctcaaccatcgagcgcctgcagctgagatgtgctagtttatactgtactagtactaagttttanacggttacttccccgtaggtaaccggttccgaccggaaacgggaccgtaaagggtaggtaaaactaaccgaaaacgtaacgtggtacgttctacgaccaacccgtnttaccgttcgttaccttaacactttcccgtccccgtacttactccttaacgtaaccg

SEQ ID NO: 396581 - DNA, 702 bp, Homo sapiens
  misc_feature: GZ8MTXP01AF8D7.19.22.B11.1.454.CMB.2.raw
  modified_base (208)..(208): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctcgtgggcgagagggccaccatcaactgcaagtccagccagaatatttanacaactccaataataagaactattagcttggtccagcagaaaccaggacagcctactaagatgcttcttttagtggacatcgtcggaccccggggtaagtccccgggggtccctggaccgtatttccgaggtcggacgacggtcggggtctcggggacctaggtactttccacttcctccaacctatccgagggcccggtccgtgccgtagggcgtagaaagtagttgggtaggtacttaaggttttacttacgtaggtacctaagtaccttaaattttttagtaaccgggttacccgttacccggtacggggttaacccggtttaccggggaacccgaaacggggtaacccgtaaaaggggttaacggtaaaacgttaacgaaaacccggtagtaacggtcgggacgttacggaccgtaaccgttaacgttcgttacgttcctttaaccacgtttcccctttccccgaccttacttccgttaacggaaacccg

SEQ ID NO: 396582 - DNA, 701 bp, Homo sapiens
  misc_feature: GZ8MTXP01AS10Y.19.22.B11.1.454.CMB.2.raw
  modified_base (212)..(212): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagacctccctggctgtgtctcgtgggcgagagggccaccatcaactgcaagtccagccaagtaattatttanacaactaccaaataataagaactacttagcttggtaccaagtaagaaacccaggacacgccctacctaagattgctttcttttagtgggctagtccgtcggaccccggggtaacgtccccgggggtcccctaggaccccgtatttccgaaggtcggcgtaggtcggggtcgtggggaaccctaggtactttacaacctcctaaccaacccaagtccgacggccgggtccctgaccgagggtactaggaaagtagttgggtacgtacttaaggttttaactacgttgtactagttacttaaattttacgtaccgttaccgttcccggttagggtaccgttaccgggaccgaaacggggaccgtaagggtaaggtaaactaacggaaaaccgtaacgtgggtcggtcgttacgaccttaccgtacttcgttcgttcctttccaacccgttccccttccccgcctacggttccctaacggaaccgtaacggg

SEQ ID NO: 396583 - DNA, 529 bp, Homo sapiens
  misc_feature: GZ8MTXP01DBPZJ.19.22.B11.1.454.CMB.2.raw
  modified_base (207)..(207): a, c, t, g, unknown or other
  modified_base (357)..(357): a, c, t, g, unknown or other
  modified_base (384)..(384): a, c, t, g, unknown or other
  modified_base (408)..(408): a, c, t, g, unknown or other
  modified_base (485)..(485): a, c, t, g, unknown or other
  modified_base (498)..(498): a, c, t, g, unknown or other
  modified_base (516)..(516): a, c, t, g, unknown or other
  modified_base (524)..(524): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaaataataagaactacttagcttggttccagcagaaaccaggacagcctactaagatgcttctttagtggcatctgcccggaatccgggggtccctgaccgtattcagtggcaggcgggtctgggactagatttcactctcnccagtcagcgcctgcaggctagaagtngtgtacagtttatacgtgtcagtnttaatttatagttaccctccgtaggtacgttccggaccgaaggaccaaggtacgaaataccaaaggtaactggtggntgctaccattcgnttactcatccgttacccncttatcgngtaac

SEQ ID NO: 396584 - DNA, 609 bp, Homo sapiens
  misc_feature: GZ8MTXP01BZJDX.19.22.B11.1.454.CMB.2.raw
  modified_base (210)..(210): a, c, t, g, unknown or other
  modified_base (577)..(577): a, c, t, g, unknown or other
  modified_base (592)..(592): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggcccaccatcaactgcaagtccagccaagaattatttanacaactaccaaataataagaactacttagcttggtccagcaagaaaccaggacagcctactaagatgtcttcttttagtggcatcgtcggcccgggaagtcccggggtcctgaccgtattcgaggtggcaggcgggtcgtcggggactagtactttccactcctacaaccataccgacggtccggcccgtggacgagggtctaggaagtagtggtaggtcttaaggttttatacgtgtacagtacttaattttatacgggttaccttcccgtagggtaccgttcggaaccgaacggggacctaaagggtacggtaaactacgaaacggtactggtacggctacgactacgtattcgttcgttccttntacttcccgttcccncttactcgaagtaaccg

SEQ ID NO: 396585 - DNA, 699 bp, Homo sapiens
  misc_feature: GZ8MTXP01A3EMH.19.22.B11.1.454.CMB.2.raw
  modified_base (220)..(220): a, c, t, g, unknown or other
  modified_base (290)..(290): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagacctccctggctgtgtctcgtgggcgagacgggcccaccatacaactgacaacgtccagaccaagtaattattttaanaacaactaccaaataaataagaactacttagcttggtaccagacaagaaaccaggacacgcctactaagntgtcttactttagtggctagtccgtcggaccccgggaacgtccccgggggtaccctggaccgtatttcgaggtcggacgacggtcggggtacgtacgggactagttactttaccgacctacctaccaaccactccgacggccggtccctagggcgtacggtcgtaaggaaagtcgtggttacggtactttaagtttattccgtgtacgaagtactttaaatttacgtacggtacccgttccggttaggaccggttacgggaccgtaaacggggtaccgaaaggggttacgtaaaacgtaccgaaaacggtaggtcggttcgaccgttacggaccgtaacttaacgttcgttactttccttaaccctactttccccttcccggacttacgttccgttaacggtaaacccg

SEQ ID NO: 396586 - DNA, 715 bp, Homo sapiens
  misc_feature: GZ8MTXP01DFW61.19.22.B11.1.454.CMB.2.raw
  modified_base (213)..(213): a, c, t, g, unknown or other
  modified_base (264)..(264): a, c, t, g, unknown or other
  modified_base (278)..(278): a, c, t, g, unknown or other
  modified_base (280)..(280): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagacctccctggctgtgtctcgtgggcgagacgggccaccatcaactgcaagtccagaccagtaattatttanacaactaccaaataataaagtaactacttagcttggtccagacaagaaacngacagcctacaagntntcttctttagtggctatcgtacggcccggtaacgtcccgggtaccctaggtacccgtatttcgacggttcggaccgtacgggtcgggtacgttacggggaacctaggttactttaccaccttaccgttaccaacgtactaccggacggtccggtcctaggacgacggtacgtaggaagtagtcgggtagtaccgtttaagtttaacgtttagtacgtacgtaacgtaacgtttaaactttacgttaacgttaccccgttacccggttacgggtaaccggtttccggaaacccgggtaaacgggtaaccggtaaaggggtttaaccggaaacgttaaacgaaaccgtaaggtcggtaacgttcgtaacgacgtaaccgtacgtttcttcgttaccctccgtacttcccgttaccgcttacgtcgttaaccgtaacg

SEQ ID NO: 396587 - DNA, 696 bp, Homo sapiens
  misc_feature: GZ8MTXP01C3BXJ.19.22.B11.1.454.CMB.2.raw
  modified_base (211)..(211): a, c, t, g, unknown or other
  modified_base (260)..(260): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctcgtgggcgagagggcccaccatcaactgcaagtccagccagaattattttanacaactccaaataataaagacttacttagcttggtaccagcagaaaccnggacagcctactaagatgcttacttttagtgggcaattccgtacggccccggggaaacgttccccgggggtccctaggacccgtatttcgaggtggtcgagggcggggtctagggggacctaggttcttttacccaccttccctaccaaccgtaatcccgacgggccccgggtcttcggacgtacggcctaggaaagtcgtcgggtcgtactaagttttacttactacggtaccaagtacttaattttacgtacggttacccgttccgtacgggtaaccgtttccggaacccgtaaagggtaccgtaaagggtacggtaaaactaccgaaacgtaaccgtgggtacggaccttacggacaaacccgttcttcggtttcgttaccgttttccaacgtttcccctttccccggacccttaatccgttaacgtaaccgg

SEQ ID NO: 396588 - DNA, 676 bp, Homo sapiens
  misc_feature: GZ8MTXP01DWJ9X.19.22.B11.1.454.CMB.2.raw
  modified_base (211)..(211): a, c, t, g, unknown or other
  modified_base (420)..(420): a, c, t, g, unknown or other
  modified_base (455)..(455): a, c, t, g, unknown or other
  modified_base (648)..(648): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctcgtgggcgagagggcccaccatcaactgcaagtccagccagtaattatttanactaactacaaataataagaactacttagcttaggtacccaagtaagaaaccaggacacgcctactaaagattcgtacttcttttaagtcgggactacgtccgtcgggaccccggtaacggttccccggggtccctagtaccgtatttccgaggttcggcgacggtcgggtcgtacggggacctaggtactttcacctctaacccaccngtccacgggcccgctgacgtagggtactagaagtnttggtaggtacttaaggtttactacgtgactagactttaaagtttacgtaccgttaccgcccgtttaagggaccggttaccggaaccgaaagggtaccgtaaaggtaacgtaaacgaaccgtaaacgtccgtggtaacgtcttcgaacccttctacgttacttcgttccttactaacctccggtttaaccccnctacgttaccgtaacggttaaccgtaag

SEQ ID NO: 396589 - DNA, 812 bp, Homo sapiens
  misc_feature: GZ8MTXP01DK4ET.19.22.B11.1.454.CMB.2.raw
  modified_base (210)..(210): a, c, t, g, unknown or other
tcagtactctcgtgcacgaccggtgctcgatttagacgacagctcagggggcagcaagatggtgttgcagacccaggtcttcatttctctgttgctctggatctctggtgtcttcggggacatcgtgatgacccagtctccagactccctggctgtgtctcgtgggcgagagggccaccatcaactgcaagtccagccagaattatttanacaactacaaataataagaactacttagcttggtccagacaacgaaaccaggaacacgacctacctaaagatgtctttacttttagtcgggactagtccgtcggaccccgggggtaaccgttccccgggggtacccctcggacccgtatttaccgaggtcgggcacgggtcgggggtctacgggggaactaggttaacttttccaacttccctaccaaccctaagtcccgaaccgggtccggccccttgggacgtaaaccgggtgttaaagggaaagttgggtcggttagggtaacctttaaaggttttttacttacgtacggttaacctaacggttaaacttttaaaagttttttaccggttaacccgggttacccgtttaccccggggttaacggggtaaccccgggtttcccgggaaaacccgtaaggggggaaaccccgtaaagggttaaggaaaaaacgtttaacccgaaaaacggttaaacggttcgggtcggttaccgaccaacccggtaaacctactttccggttcgttacctttaacccaaccttttccccggtaaccccccgtattaaccggttccttaacgggaaaccccg

SEQ ID NO: 396590 - DNA, 569 bp, Homo sapiens
  misc_feature: GZ8MTXP01AHG0L.19.22.B11.1.454.CMB.2.raw
  modified_base (207)..(207): a, c, t, g, unknown or other
  modified_base (373)..(373): a, c, t, g, unknown or other
  modified_base (390)..(390): a, c, t, g, unknown or other
  modified_base (528)..(528): a, c, t, g, unknown or other
  modified_base (545)..(545): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactaccaataataagaactacttagcttggttccagacagaaaccaggacagccctacctaagatgcttctttatgggcatcgtcggcccggggtaacgtcccggggtccctggaccgtattcgagtgcgaggcggggtctcgggactagatttcactactcnccatcacgcgccctagngacgggtctagaacgtatggtgacgttagtttacttactgtacagtacttaatttatacggttacctccgtaggtacgttccggacgaagggtaccaaggtacggaatacgaaacgacgttgacggttctgactaccnttcgttgttacctaacnctcttccccgcttatcaaggaacc

SEQ ID NO: 396591 - DNA, 600 bp, Homo sapiens
  misc_feature: GZ8MTXP01CW1U9.19.22.B11.1.454.CMB.2.raw
  modified_base (271)..(271): a, c, t, g, unknown or other
  modified_base (376)..(376): a, c, t, g, unknown or other
  modified_base (583)..(583): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttatacaactccaataataagaactacttagcttggttccagacagaaaccaggacagcctactaagntgcttctttatggcatcgtcgaccccggggaatccccggggtccctggacccgtatttcgaggttggcgacggcgggtctacggggacagtactttcactctacnccatcgagcggcctgcaggctagaaagtatggtaggactagttttactactgtacagtcttaaatttttacgacgggttactcccggttaggacccgttacggaccgaaaggggtaccgtaaagggtgtaaaactccgaaaacggtacctggtcgggctacggactaacccgtagttacttcgttcttcaacgttcccttaccccgnttattccgaacgtaacg

SEQ ID NO: 396592 - DNA, 514 bp, Homo sapiens
  misc_feature: GZ8MTXP02JSLF7.19.22.B11.1.454.CMB.2.raw
  modified_base (353)..(353): a, c, t, g, unknown or other
  modified_base (376)..(376): a, c, t, g, unknown or other
  modified_base (380)..(380): a, c, t, g, unknown or other
  modified_base (409)..(409): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgctctttatgggcatctgcccggaatccggggtccctgaccgattcagtggcagcgggtctggggacagatttcactctcnccatcagcgcctgcaggctgaanatgnggcagtttatactgtcagtcaaattttanagttactccctggacgtttcggaccaagggacccaagggtgaaatcgaaaacgaactggtgctcgcgaccatcctagtcttcgactcttcccgacactcctgaac

SEQ ID NO: 396593 - DNA, 502 bp, Homo sapiens
  misc_feature: GZ8MTXP02F9I9H.19.22.B11.1.454.CMB.2.raw
  modified_base (207)..(207): a, c, t, g, unknown or other
  modified_base (347)..(347): a, c, t, g, unknown or other
  modified_base (372)..(372): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagaactacttagcttggtccagcagaaaccaggacagcctctaagatgctctttatggcatctgcccggaatccggggtcctgaccgattcagtggcagcgggtctgggacagatttcactctcnccatcagcgcctgcaggctgaaagntgtggctagtttattactgtcagtctaaattttatagtactcccgtggacgttcggaccaagggaccaaggtaggaaatacgaaaacgaactgtacgctgcacatctgtcttcatctccgcactctagac

SEQ ID NO: 396594 - DNA, 506 bp, Homo sapiens
  misc_feature: GZ8MTXP02HN6N9.19.22.B11.1.454.CMB.2.raw
  modified_base (208)..(208): a, c, t, g, unknown or other
  modified_base (356)..(356): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaaataataagaactacttagcttggttccagcagaaaccaggacagcctcctaagatgctcttttatggcatctgcccgggaatcccggggtccctgaccgattcagtggcagcgggtctggggacagatttcactctcnccatcagcgcctgcaggctgaagatgtggctagtttattactgtcagctaatttatagtactccgtggacgttcgcgaagggaccaaggtagaaatacgaaaacgactgtaggctgcacatctgtcttcatccttcccgctactctgacg

SEQ ID NO: 396595 - DNA, 533 bp, Homo sapiens
  misc_feature: GZ8MTXP02H8YXC.19.22.B11.1.454.CMB.2.raw
  modified_base (208)..(208): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaatccaataataagaactactagcttggttccagcagaaaccaggacagcctcctaagatgctctttattgggcatctgcccggaatccggggtcctgaccgattcagtggcagcgggtctgggacagatttcactctcaccatcagcgcctgcagctgaagatgtggcagtttatactgtctagctaaattttatagtacttccctggacgttcggacctaaagggacctaaagggtggtaaaactcgaaaaacgtaaactggtagggactcggacaaccaatccttgtcctttcgattccttcccgactactcctagaacc

SEQ ID NO: 396596 - DNA, 502 bp, Homo sapiens
  misc_feature: GZ8MTXP02F2HB5.19.22.B11.1.454.CMB.2.raw
  modified_base (207)..(207): a, c, t, g, unknown or other
  modified_base (326)..(326): a, c, t, g, unknown or other
  modified_base (388)..(388): a, c, t, g, unknown or other
  modified_base (390)..(390): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactcaataataagaactacttagcttggttccagcagaaaccaggacagcctctaagatgctctttatggcatctgcccggaatccggggtcctgaccgattcagtgcagcggtcnggacagatttcactctcaccatcacgcgcctgcaggctgaagatgaggcagttattatgtananatattatatactcgtgtacgtacgacgacggacgaagtaagaaataacgaaacgaacgtagtagacgtcgacacactactctactctactacctccacctactactacgacg

SEQ ID NO: 396597 - DNA, 520 bp, Homo sapiens
  misc_feature: GZ8MTXP02GRBEP.19.22.B11.1.454.CMB.2.raw
  modified_base (208)..(208): a, c, t, g, unknown or other
  modified_base (352)..(352): a, c, t, g, unknown or other
  modified_base (410)..(410): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaataataagaactacttagcttggttccagcagaaaccaggacagcctcctaagatgcttctttatggcatctgcccggaatccggggtcctgaccgattcagtggcagcgggtctggggacagatttcactctcnccatcagcgcctgcaggctagaagatgtggctagtttatactgtcagctaaattttanagtactccgtggacgttcgaccaaagggaccaagggtacgaaaatacgaaaacggaactggtcggactcgacaaccatcctgtcttcatccttcccgactatctagaacg

SEQ ID NO: 396598 - DNA, 523 bp, Homo sapiens
  misc_feature: GZ8MTXP02GM52F.19.22.B11.1.454.CMB.2.raw
  modified_base (373)..(373): a, c, t, g, unknown or other
  modified_base (385)..(385): a, c, t, g, unknown or other
  modified_base (510)..(510): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttatacaactccaaataataagaactacttagcttggttccagcaagaaaccaggacagcctacctaagatgcttcttttatggcatctgcccgggaatcccggggtcctgaccgattcgagtggcaggcgggtctggggacagatttcactctcaccatcagcgctgcnggctgaagatgnggctagtttattactgtcagctaaatttatagtacttcctggtacgttcggaccgtaagggaccaagggtagaaatacgaaaacgactggtacgctagcaccattctcgtcttcactccttcccnctactctagaacc

SEQ ID NO: 396599 - DNA, 487 bp, Homo sapiens
  misc_feature: GZ8MTXP02J3UF4.19.22.B11.1.454.CMB.2.raw
  modified_base (208)..(208): a, c, t, g, unknown or other
  modified_base (333)..(333): a, c, t, g, unknown or other
  modified_base (346)..(346): a, c, t, g, unknown or other
  modified_base (370)..(370): a, c, t, g, unknown or other
  modified_base (374)..(374): a, c, t, g, unknown or other
  modified_base (404)..(404): a, c, t, g, unknown or other
  modified_base (455)..(455): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaataataagactacttagcttggttccagcagaaaccaggacagcctacctaagatgctctttatggcatctgcccggaatccggggtcctgccgattcagtgcagcggtctggacngatttcactctcnccatcagcgcctgcaggctgaagntcgnggctaggtttatactgtcagctaattttangtactcccgtgacgttgcaggacaggtggatatcgagacgaacttggcgcncgacacatctgtctctctcctcccgctactcg

SEQ ID NO: 396600 - DNA, 589 bp, Homo sapiens
  misc_feature: GZ8MTXP02JXDHV.19.22.B11.1.454.CMB.2.raw
  modified_base (207)..(207): a, c, t, g, unknown or other
  modified_base (374)..(374): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagaactacttagcttggttccagcagaaaccaggacagcctcctaagatgcttctttatggcatctgcccggaatccggggtcctgaccgattcagtgcagcggtctgggacagtatttcactctcaccatcagcgctgcagctgaagatgngctagtttatactgtcagtactaatttatagtactccgtaggacgttacggaccgaaacgggtaaccgtaaagggttaggaaaacgttaccgaaaaacgtaaacgttacggtagggtccgtacggacccgaaacccgtacttaaccgttacggttccttaaccgtaacgttacccttttcccccggacccctaactttcctacggtaaaacccgg

SEQ ID NO: 396601 - DNA, 539 bp, Homo sapiens
  misc_feature: GZ8MTXP02GVY1N.19.22.B11.1.454.CMB.2.raw
  modified_base (388)..(388): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttatgcaactccaataataagaactactagcttggtccagcagaaaccaggacagcctacctaagatgcttcttttatgggcatcgtggaccccgggaatccggggtccctggaccgtattcgagtgcaggtcgggtcctggggacagtactttcactctcacatcagccgctgcagctagagangtggactagtttatactgtacagtacttaattttaatacgttacctccgttacgggtacgttaccggacgaaacgggaccgaaagggtagaaatacgaaaacgtacgtgtggctgacacctatctgtctctactcctccgcctactctacg

SEQ ID NO: 396602 - DNA, 520 bp, Homo sapiens
  misc_feature: GZ8MTXP02G1PPA.19.22.B11.1.454.CMB.2.raw
  modified_base (208)..(208): a, c, t, g, unknown or other
  modified_base (409)..(409): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaataataagaactacttagcttggttccagcagaaaccaggacagcctcctaagatgctctttatggcatctgcccggaatccggggtcctgaccgattcagtggcagcgggtctgggacagatttcactctcaccatcagcgcctgcagggctgaagatgtggctagtttatactgtcagtctaaattttanagtactcccgtggtaccgtttcggacccaagggacccaaagggtggaaatcgaaaacgaactgttaggctcgacacgatctagtcttcactccttccgctactctacgaac

SEQ ID NO: 396603 - DNA, 553 bp, Homo sapiens
  misc_feature: GZ8MTXP02H2SZA.19.22.B11.1.454.CMB.2.raw
  modified_base (207)..(207): a, c, t, g, unknown or other
  modified_base (254)..(254): a, c, t, g, unknown or other
  modified_base (318)..(318): a, c, t, g, unknown or other
  modified_base (388)..(388): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaaataataagaactacttagcttggtccagcagaaaccnggacagcctacaagatgcttctttatggcatcgtcgcccggaagtccggggtccctgacccgtnttcgagtggacaggtcgggtctcgggacagtacttcactctcacatcacgcgcctgcagggctagaagtntggtggactagtttatacgtgtacagtactaatttatacgtacttccgtaggtacgttcggacgaaacgggtacgtaaggtagaaacgtacgaaaacgaacgtggtacggctacgaccacctactccgtgtcttaacgacttcctcccgactactcgtacgaacg

SEQ ID NO: 396604 - DNA, 560 bp, Homo sapiens
  misc_feature: GZ8MTXP02JSDMN.19.22.B11.1.454.CMB.2.raw
  modified_base (207)..(207): a, c, t, g, unknown or other
  modified_base (330)..(330): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagaactacttagcttggtccagcagaaaccaggacagcctcaagatgctctttatggcatctggcccggaatccggggtcctgaccgattcgagtggcaggcgggtcnggggacagtatttcactctcaccatcagcggcctgcaggctagaagatggtggctagtttatacgtgtcagtacttaatttatacgttactcccgtaggtaccggttacggaccgaaaggggaccgtaaagggtacggaaaacttacgaaaacgtacttacggtacggcgtacgaccactactccttgttaccttaacgacttccgttacccgcctactcctacgaaccg

SEQ ID NO: 396605 - DNA, 508 bp, Homo sapiens
  misc_feature: GZ8MTXP02HK1C5.19.22.B11.1.454.CMB.2.raw
  modified_base (207)..(207): a, c, t, g, unknown or other
  modified_base (328)..(328): a, c, t, g, unknown or other
  modified_base (470)..(470): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaaataataagaactacttagcttggtccagcaagaaaccaggacagcctctaagatgcttctttatggcatctgcccggaatccggggtcctgaccgattcagtgcagcggtngggacagatttcactctcaccatcagcgcctgcaggctgaagatgtggctagtttatactgtacagtactaaatttatagtaccttcccgtggtacgttcggaccgaaagggaccaaaggtggaaaatacaaaacgactagnggctgacacatctgtctcatctcccgacactctacgac

SEQ ID NO: 396606 - DNA, 569 bp, Homo sapiens
  misc_feature: GZ8MTXP02FMDL0.19.22.B11.1.454.CMB.2.raw
  modified_base (328)..(328): a, c, t, g, unknown or other
  modified_base (348)..(348): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttatacaactccaataataagaactacttagcttggttccagcagaaaccaggacagcctcctaagatgctctttatggcatctgcccggaatccggggtcctgaccgatcagtggcagcgggtntgggacagatttcactctcnccatcagcgcctgcaggctgaagatgtggctagtttattactgtcagctaaatttatagtactccgtggtaacgttcggacctaagggaccaaagggtacggaaataccgaaaacgaacgtaggtacggctacggacctaaccgtaacttccgtacggttccctttaaccgtaactttaccctttccccccggacctaaacgttccctacggtaaaacccg

SEQ ID NO: 396607 - DNA, 543 bp, Homo sapiens
  misc_feature: GZ8MTXP02GNGMF.19.22.B11.1.454.CMB.2.raw
  modified_base (207)..(207): a, c, t, g, unknown or other
  modified_base (350)..(350): a, c, t, g, unknown or other
  modified_base (375)..(375): a, c, t, g, unknown or other
  modified_base (411)..(411): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaaataataagaactacttagcttggtccagcagaaaccaggacagcctcctaagatgctctttatggcatctgcccggaatccggggtcctgaccgattcgagtggcagcgggtctgggacagatttcactctcnccatcagcgcctgcaggctgaaagntgtggctagtttatactgtacagtactaaattttanagtactccgtagggtacgttcggaccaaagggaccaaagggttaggaaaacttcgaaaacgactaggtacggactacggacacctagtctacgttcttccgaacttccgttcccgacctatcctaggaaccg

SEQ ID NO: 396608 - DNA, 558 bp, Homo sapiens
  misc_feature: GZ8MTXP02HZ85Y.19.22.B11.1.454.CMB.2.raw
  modified_base (208)..(208): a, c, t, g, unknown or other
  modified_base (334)..(334): a, c, t, g, unknown or other
  modified_base (351)..(351): a, c, t, g, unknown or other
  modified_base (511)..(511): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaaataataagaactactagcttggtccagcagaaaccaggacagcctacctaagatgcttcttttatggcatctggcccggaatccgggtccctgaccgattcagtggcaggcggtcngggacagtattcactcncaccatcagccgcctgcgagctagaagatgtggcttagtttattacgtgtacagtactaattttatacgttaccttccgtaggtaccgttacggaccgaaagggaccgtaagggtagaaacttacgaaaacgtaacgtggacgtactcgacctacctacncgttacgtcttaaccgacttcccgtcccgactacgttctacgaaccg

SEQ ID NO: 396609 - DNA, 596 bp, Homo sapiens
  misc_feature: GZ8MTXP02IRGZ8.19.22.B11.1.454.CMB.2.raw
  modified_base (207)..(207): a, c, t, g, unknown or other
  modified_base (328)..(328): a, c, t, g, unknown or other
  modified_base (349)..(349): a, c, t, g, unknown or other
  modified_base (374)..(374): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagaactacttagcttggtccagcagaaaccaggacagcctcctaagatgctctttatggcatctgcccggaatcccggggtcctgaccgattcagtggcagcggtntggggacagatttcactctcnccatcagcgcctgcagctgagatgngctaatttatactgtacagtactaattttatacgttaccttccgtaggtaccggttacggacccgaaacggggtaacctaaaggggttaacgggaaaacttaaccgaaaaccgaaaaccgttggtacggggtcttacggacccaaaccgtaacttaccgttgttaccttaaccgttaacgttacccctttccccggaccctacgttaccttacggaaacccg

SEQ ID NO: 396610 - DNA, 554 bp, Homo sapiens
  misc_feature: GZ8MTXP02IRHQL.19.22.B11.1.454.CMB.2.raw
  modified_base (208)..(208): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactcaataataagaactacttagcttggttccagcagaaaccaggacagcctactaagatgctctttatggcatctcgcccggaatcccggggtcctgaccgattcagtggcagcggtctgggacagtatttcactctcaccatcacgcgcctgcaggctagaaacgatggtggactagttttatacgtgtacagtctaaattttatagtaccttccgtggtacgttccggaccgtaaagggtaccaaagggttacggaaaacttacgaaaacgtaacttggacggtactcggacacctattctacgtcttaacacttccttacccgactacgtctacgaccg

SEQ ID NO: 396611 - DNA, 508 bp, Homo sapiens
  misc_feature: GZ8MTXP02JJ085.19.22.B11.1.454.CMB.2.raw
  modified_base (208)..(208): a, c, t, g, unknown or other
  modified_base (348)..(348): a, c, t, g, unknown or other
  modified_base (405)..(405): a, c, t, g, unknown or other
  modified_base (473)..(473): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaataataagaactacttagcttggttccagcagaaaccaggacagcctctaagatgctctttatggcatctgcccggaatccggggtcctgaccgattcagtggcagcggtctgggacagatttcactctcnccatcagcgcctgcaggctgaagatgtgctagtttatactgtcagtctaaattttanagtactcccgtggacgttcggaccaagggaccaaggtcgaaatcaaaacgactggtcggctgcaaccntacctgtcttcattccttcccgcactcgtagaacc

SEQ ID NO: 396612 - DNA, 548 bp, Homo sapiens
  misc_feature: GZ8MTXP02GZFFN.19.22.B11.1.454.CMB.2.raw
  modified_base (356)..(356): a, c, t, g, unknown or other
  modified_base (388)..(388): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttatacaactccaaataataagaactacttagcttggttccagcaagaaccaggacagcctcctaagatgctctttatggcatctgcccggaatcccggggtcctgaccgtattcagtggcaggcggggtctggggacagtatttcgacttcncacctatcacgccgacctgccaggctgaaagntggtggactagtttactacttggtactaggtactaaattttatagttacctccgtggtacgttcggaccgaagggaccaaggtaggaaatacgaaaacgactgtcggactagacactatcgtagttctctactccttccccgactactcgtacgtaaccg

SEQ ID NO: 396613 - DNA, 506 bp, Homo sapiens
  misc_feature: GZ8MTXP02HLEB8.19.22.B11.1.454.CMB.2.raw
  modified_base (207)..(207): a, c, t, g, unknown or other
  modified_base (376)..(376): a, c, t, g, unknown or other
  modified_base (407)..(407): a, c, t, g, unknown or other
  modified_base (462)..(462): a, c, t, g, unknown or other
  modified_base (494)..(494): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactcaaataataagaactacttagcttggtcagcaagaaaccaggacagcctacctaagatgctctttatggcatctgcccggaatccggggtcctgaccgattcagtggcagcggtctgggacagtatttcactctcaccatcagcgcctgcaggctgaagatgnggctagtttatactgcagtactaaagtttanagtactccgtagacgttcgaccgaaaggaccaaggtgaaatacgaaaacgaatgnggctcgacaccatctgtcttcactccttcccnctactctagacg

SEQ ID NO: 396614 - DNA, 540 bp, Homo sapiens
  misc_feature: GZ8MTXP02GVLEF.19.22.B11.1.454.CMB.2.raw
  modified_base (207)..(207): a, c, t, g, unknown or other
  modified_base (336)..(336): a, c, t, g, unknown or other
  modified_base (359)..(359): a, c, t, g, unknown or other
  modified_base (388)..(388): a, c, t, g, unknown or other
  modified_base (391)..(391): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagactacttagcttgtccagcagaaaccaggacagcctactaagatgcttctttatgggcatctggccccggaagtcccggggtccctgaccgtattcgagtggcagcgggtcnggggacagtatttcactcctacnccatcagccgcctgcaggctgaaagatgnggntaagtttattactagtacagacttaaatttagtagtacttaccgtaggtaccgttcgacgaacggaccgaaggtagaaagtaacaaacgaactagtacgcgacacacactactcgtacttcactccttcccacctagtacctacgaacc

SEQ ID NO: 396615 - DNA, 544 bp, Homo sapiens
  misc_feature: GZ8MTXP02IW980.19.22.B11.1.454.CMB.2.raw
  modified_base (209)..(209): a, c, t, g, unknown or other
  modified_base (355)..(355): a, c, t, g, unknown or other
  modified_base (370)..(370): a, c, t, g, unknown or other
  modified_base (378)..(378): a, c, t, g, unknown or other
  modified_base (381)..(381): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaattattttanacaactcaaataataagaactacttagcttggttccagcaagaaaccaggacagcctacctaagatgctctttatggcatctgcccggaatcccgggtcctgaccgtattcagtggcaggcgggtctgggacagtattcactctcnccatcagccgctgcngctgaagntgngctagtttactactgtcagacttaattttatagtaccttccgtgtacgttcgacgaagggaccaaggtacgaaatacgaaaacgtaactggtacgtcgtacgacctacgtactccgtgttaccttccgacttcccttcccgacctacttccgtacggaaaccg

SEQ ID NO: 396616 - DNA, 546 bp, Homo sapiens
  misc_feature: GZ8MTXP02FJUGI.19.22.B11.1.454.CMB.2.raw
  modified_base (207)..(207): a, c, t, g, unknown or other
  modified_base (373)..(373): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaaataataagaactacttagcttggttccagcagaaaccaggacagcctccaagatgcttctttatggcatctgcccggatccggggtcctgaccgattcagtggcagcggtctgggacagatttcactctcaccatcagcgcctgcaggctgaaagntgtggctagttattactgtcagtctaaatttataacgtacctccgtggtacgttcggaccgtaaagggacctaagggtaggaaatacgaaaacgtaacgtggtacggctacggacctaaccacgttctcgttctaacgtacttcccgttccccgacctactccgtgaaacccg

SEQ ID NO: 396617 - DNA, 648 bp, Homo sapiens
  misc_feature: GZ8MTXP02ICF5X.19.22.B11.1.454.CMB.2.raw
  modified_base (212)..(212): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagacctccctggctgtgtctcgtgggcgagagggccaccatcaactgacaagtccagccaagaattatttanacaactaccaaataataagaactatagcttgtccagacagaaaccaggacagcctactaagatgcttactttagtggacatcgtcggaccccggtaagtcccggggtccctagaccgtattcgagtcggcaggcggtcgtacggggactagtactttcacttcctcaccatcgacgcccggacctggacctagggctaggaaagtgtggtacggacttaagttttactactgtacgtagtaacttaaagtttttagacgttaccttacccggtagggtaccggttaccggaccggaaaaggggaacctaaaggggtaacgaaaactaccgaaaaacgtaacgtggtacggtacctacggacctaacctaagttccttaacgttccttaacctaacgttccccgtttacccgaccttactaccgttacggaaacccg

SEQ ID NO: 396618 - DNA, 619 bp, Homo sapiens
  misc_feature: GZ8MTXP02JOMLI.19.22.B11.1.454.CMB.2.raw
  modified_base (369)..(369): a, c, t, g, unknown or other
  modified_base (549)..(549): a, c, t, g, unknown or other
  modified_base (591)..(591): a, c, t, g, unknown or other
tcagtactctcgtgcacgaccggtgctcgatttagacgacagctcaggggcagcaagatggtgttgcagacccaggtcttcatttctctgttgctctggatcttggtgtcttcggggacatcgtgattacccagtctccagactccctggctgtgtctctgggcgagagggccaccatcaactgcaagtccagccagaatatttatacaactaccaataataagaactacttagtcttgttccagacagaaaccaggacagcctacctaagatgtcttcttttattggtcatctcggcccgggacgtcccggggtcccgtcgaccgtactcgagtggcgagcggtcgtcgggacgagtattctactgcnccactcacgcggccgtcgcgacggacgtagaagagtaggtggtcgtagtttacttactagtacgtagtacttaatttaattacgttacgttacccgtacggtaccggttaccggtaccgtaacgggtaacggtaaacggtaacggaaacgtaacgtaaaacgtaaacgtacggtacggtntacgtacctaccgtactacttcgttaccttaaccgtaccttnacccttaccccgtaccctacctaccgac

SEQ ID NO: 396619 - DNA, 562 bp, Homo sapiens
  misc_feature: GZ8MTXP02F3JTA.19.22.B11.1.454.CMB.2.raw
  modified_base (208)..(208): a, c, t, g, unknown or other
  modified_base (280)..(280): a, c, t, g, unknown or other
  modified_base (438)..(438): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactaccaataataagaactacttagcttggttccagcaagaaaccaggacagcctacctaagatgcttnttttagtggcatcgtcggcccggtaatcccggggtccctggaccgtattcagtggcaggcggtcgtgggacagtatttccactctaccaccatcacgcgaccctgccgtaggctagaagatggtagtctaagtttattactgtcagtactaattttanacgttactccgtggtacgttacgaccgaagggaccaagggtagaaactacgaaaacgacgtaggcgacgtcgacgacctagtctgttaccttcgaacttcctacccgctacgttcacgtaaccg

SEQ ID NO: 396620 - DNA, 581 bp, Homo sapiens
  misc_feature: GZ8MTXP02GW0Y3.19.22.B11.1.454.CMB.2.raw
  modified_base (210)..(210): a, c, t, g, unknown or other
  modified_base (228)..(228): a, c, t, g, unknown or other
  modified_base (555)..(555): a, c, t, g, unknown or other
  modified_base (566)..(566): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctcgtgggcgaggagggccaccatcaactgcaagtccagccagaattatttanacaactccaaataataanaactacttagcttggtccagcaagaaaccaggacagccctactaagatgtcttcttttatggctatcgtcggaccccggggaactcccggggtccctcggaccgatttcgaggtggacaggcggggtctggggacagtatttccactcctcaccatcaggcggccctagcgaggctggaagtagtggtgcttagtttacttacgtgtacagtacttaaagttttataacgttacctccgtagggtaccggttcgaccgtaagggacctaaagggtacgaactacgaaaacgtcgtaggtaggactacgacacctatcttacgtcctnacttcctaccnctactcgtagaaccg

SEQ ID NO: 396621 - DNA, 659 bp, Homo sapiens
  misc_feature: GZ8MTXP02HH614.19.22.B11.1.454.CMB.2.raw
  modified_base (207)..(207): a, c, t, g, unknown or other
  modified_base (224)..(224): a, c, t, g, unknown or other
  modified_base (252)..(252): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactcaaataataanaactactagcttggtccagtagaaaccnggacagcctacaagatgcttctttagtggctatctcggccccgggtaatcccggggtccctggacccgtattcgaggtggcaggcgggtctgggactagtactttcactcgtaccacctagtccaggccggcctgccgagggtcctaggaagtagtggtacggtctaggttttactacgtgtactaagtacttaaagtttttagaacgttaccgttcccgttagggtaccggtttccgggaaacccgtaaaggggaacccgtaaaggggtaacgtaaaacgtaccgtaaaacgtacgttacggtacggtaacgtcggaaccctaaccgtaacttccgtcggtttaccctacgtaaccttaccccgtttaccccggccttaactaccgttacggaaaccccgtaacgg

SEQ ID NO: 396622 - DNA, 504 bp, Homo sapiens
  misc_feature: GZ8MTXP02FGITA.19.22.B11.1.454.CMB.2.raw
  modified_base (404)..(404): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttatacaactccaaataataagaactacttagcttggttccagcagaaccaggacagcctcctaagatgctctttatggcatctgcccggaatccggggtcctgaccgatcagtgcagcgggtctgggacagatttcactctcaccatcagcgcctgcaggctgaagatgtggctagttattactgtcagctaaattttanagttactccctgggacgttcggccaaaggggaccaaaggtcggaaatacgaaaacgaactgtaggctgcaccatctgtctcatcttcccgccatctgaac

SEQ ID NO: 396623 - DNA, 522 bp, Homo sapiens
  misc_feature: GZ8MTXP02H93V1.19.22.B11.1.454.CMB.2.raw
  modified_base (206)..(206): a, c, t, g, unknown or other
  modified_base (245)..(245): a, c, t, g, unknown or other
  modified_base (259)..(259): a, c, t, g, unknown or other
  modified_base (272)..(272): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagaggccaccatcaactgcaagtccagccagaatatttanacatccaataataagactatagcttgtccagcagaaccngacagcctctaagntgctctttatggnatctgcccggaatccggggtcctgaccgtatcagtgcaggcggtctggggacagtactttcactctcacctatcagcgcctgcagctagagatgtggctagtttattactgtcagtactaaattttatacgtaacttccctgggaccttcgggaccgaaagggacctaaggtacggaaactacgtaaaacgaacgtgacggtactgaccaccagtctgtcttcactccttcccgactactcgtacgaccg

SEQ ID NO: 396624 - DNA, 537 bp, Homo sapiens
  misc_feature: GZ8MTXP02G5EZL.19.22.B11.1.454.CMB.2.raw
  modified_base (208)..(208): a, c, t, g, unknown or other
  modified_base (405)..(405): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaaataataagaactacttagcttggtccagcagaaaccaggacagcctctaagatgctctttatggcatctgcccggaatccggggtccctgaccgatcagtgcagcggtctgggacagtattcactctcaccatcagcgcctgcagctgaagatgtgctagtttattactgtcagtctaaatttttanacgttacctccgtaggacgttacgaccgaaagggaaccaaggtaagaaaatacgaaaacgtaacgtgtacggctacgaccactacttctgttaccttaactacttcccgttaccccgactactactagaacg

SEQ ID NO: 396625 - DNA, 540 bp, Homo sapiens
  misc_feature: GZ8MTXP02FLS0Y.19.22.B11.1.454.CMB.2.raw
  modified_base (207)..(207): a, c, t, g, unknown or other
  modified_base (380)..(380): a, c, t, g, unknown or other
  modified_base (398)..(398): a, c, t, g, unknown or other
  modified_base (414)..(414): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaaataataagaactacttagcttggttccagcagaaaccaggacagcctctaagatgctctttatggcatctgcccggaatcccggggtccctgaccgtatcagtggcagcgggtctggggacagtatttccactctcaccatcagccgcctgcaggctgaaagntgtggcttagttattacngtcagtactaatttanagtacctccgtggtaccgttcggaccgaaagggaccaaagggtagaaactacgaaaacgaactggtacggctacgaccacacttactcgttctcgtacttccgttacccgcctactcgtacgaacg

SEQ ID NO: 396626 - DNA, 654 bp, Homo sapiens
  misc_feature: GZ8MTXP02JOBMK.19.22.B11.1.454.CMB.2.raw
  modified_base (207)..(207): a, c, t, g, unknown or other
  modified_base (397)..(397): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaaataataagaactacttagcttggtccagcaagaaaccaggacagcctacctaagatgcttctttatggcatctcggcccgggaagtcccggggtcctggaccgtattcaggtcggcaggcgggtctggggacagtatttccactctacaccatcaggccgccgtgacagggctagaaagngtggtggacttagtttactaacgttgtacgaagtactttaaagttttacgtacgttaccttccccgttagggtaacccggtttacggaacccggtaaaggggtaaacccgtaaaggggttaaacggaaaacctaacggtaaaaaccgtaacggtttcggtaaggggaccttaacggaaccctaaaccgtacttccgttaacgttccttaacgtaactttcccgtttaccccgacttaacgttccgtaacgtaaaccg

SEQ ID NO: 396627 - DNA, 608 bp, Homo sapiens
  misc_feature: GZ8MTXP02IBM7E.19.22.B11.1.454.CMB.2.raw
  modified_base (208)..(208): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaataataagaactacttagcttggttccagcaagaaaccaggacagcctcctaagatgcttctttatggactatctgcccggaatcccggggtccctgaccgattcgagtgcaggcggtctcggggacagtactttcacttctacaccatcacggtccgcctggacaggctaggaaagagtgtggactagtttatacgtgtcagtacttaaattttctagttaccctccttagggtaccggtttaccggaccgaaaggggtaacccgtaaagggtaacggaaaactaaccgtaaaacggtaactacgggttacgggacttacggaccaccgtacttacgttccggttcttaaccgtaacttcccttaccccgactacgttcctacgaacccg

SEQ ID NO: 396628 - DNA, 567 bp, Homo sapiens
  misc_feature: GZ8MTXP02H4XOB.19.22.B11.1.454.CMB.2.raw
  modified_base (207)..(207): a, c, t, g, unknown or other
  modified_base (362)..(362): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactcaaataataagactacttagcttggtccagcagaaaccaggacagcctacctaagatgcttctttagtggctatctgcccggaactcccggggtccctgaccgtattcgagtcggcaggcgggtctggggacagtacttcactctaccncactcacgcgcctgcaggctagaagtagtggtgcgttaagtttactactgtacctagtacttaattttatacgttacctccgtaggtacgttaccggaccgaagggaccgtaaggagtaaactacgaaaacgtacgtaggtacggactacgactaacgtactcttagtccttaacgacttccgtacccgactacgtctacgaccg

SEQ ID NO: 396629 - DNA, 514 bp, Homo sapiens
  misc_feature: GZ8MTXP02JWTUF.19.22.B11.1.454.CMB.2.raw
  modified_base (207)..(207): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatatttanacaactccaataataagaactacttagcttggttccagcagaaaccaggacagcctccaagatgctctttatggcatctgcccggaatccggggtcctgaccgattcagtgcagcggtctgggacagatttcactctcaccatcagcgcctgacagggctagaaagatgtaggctagtttatactgtcagctaaatttatagtactccctggacgttcggaccaaagggaccaaggtagaaatacaaaacgaatcgtaggctcgacacatctatcttaacacttccttcccgactactctagaaccg

SEQ ID NO: 396630 - DNA, 574 bp, Homo sapiens
  misc_feature: GZ8MTXP02JQ8JW.19.22.B11.1.454.CMB.2.raw
  modified_base (208)..(208): a, c, t, g, unknown or other
  modified_base (368)..(368): a, c, t, g, unknown or other
  modified_base (395)..(395): a, c, t, g, unknown or other
  modified_base (431)..(431): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactaccaaataataagaactacttagcttggttccagcaagaaaccaggacagcctacctaagatgcttcttttatggcatctcggcccggaagtcccggggtccctgaccgattcaggtgcgagcggggtctcggggacagtactttcactccacnccatcagccgcctgcagggcagaagtntggtggctagtttatactgtcagtacttaaattttnacgttacctccgtaggtaccggttacgaccgtaaagggacctaagggtacgaaactacgaaaacgtactaggtacggactcgacctaacctacgttccgtgttcctttcgaacttcccttacccgacctattcctacgaaccg

SEQ ID NO: 396631 - DNA, 658 bp, Homo sapiens
  misc_feature: GZ8MTXP02I6JEU.19.22.B11.1.454.CMB.2.raw
  modified_base (209)..(209): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctcgtgggcgagagggccaccatcaactgcaagtccagccagaattatttanacaactacaataataagaactacttagcttggtcagcaagaaaccaggacagcctactaagatgtcttactttagtggctatcgtcggcccgggaacgtccccggggtcctaggaccgtacttcgaggtcggacgagggtcggggttactacggggactacggtactttccgacttcctccacccgtatccggacggtcccggtcctaggccgtacggacgtaggaaagtagtcggtagggtcttaaacggtttatacttgtacaagtactttaaagtttactacgttcccgttaccgtacgggtaccggttaccggaacggtaaacggggaaccgtaagggtaacggaaacttaacgaaaacgtaacgtcggtacgcgtacgacctactaacgttcccgtgttaccttaactccgttcccttacccgacctacgttccgacgtaaccg

SEQ ID NO: 396632 - DNA, 552 bp, Homo sapiens
  misc_feature: GZ8MTXP02IZQSC.19.22.B11.1.454.CMB.2.raw
  modified_base (205)..(205): a, c, t, g, unknown or other
  modified_base (376)..(376): a, c, t, g, unknown or other
  modified_base (379)..(379): a, c, t, g, unknown or other
tcagtactctcgtgcacgaccggtgctcgatttagacgacagctcaggggcagcaagatggtgttgcagacccaggtcttcatttctctgttgctctggatctctggtgtcttcgggacatcgtgatgacccagtctccagactccctggctgtgtctctgggcgagagggccaccatcaactgcaagtccagccagatatttanacaactcaatataagactacttagcttggtccagcagaaaccaggacagcctcctaagatgctctttatggcatctgcccggaatcccggggtcctgaccgtattcgagtggcaggcgggtctgggacagtatttcgactctcaccatcgagcgtactgcaggctgaaagntgngctagttatagtgacagtattaatttatacgtaccttccgtaggtaccgttacgacgtaacggtacgaaggtaacgaaactacgaaaacgtaactcggtacgtacgtacgacctaacgtacttacgtacgttacttctaccgtttccgttaccctactacctcgtacgaaccg

SEQ ID NO: 396633 - DNA, 639 bp, Homo sapiens
  misc_feature: GZ8MTXP02HHFUB.19.22.B11.1.454.CMB.2.raw
  modified_base (208)..(208): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctcgtgggcgagagggccaccatcaactgcaagtccagccagaatatttanacaactccaaataataagaactacttagcttaggtccagcaagaaccaggacacgacctacctaagatgtactttctttaagtgggctagtccgtcggaccccggtaagtcccggggtccctaggaccgtattcgagtcggacgaggtcggtctacggggactagtacttcactctccaccagtcacggccgcctacggcgacggtctaggaagtacgtggtacggtacgttaaggttttactaacgttggtacacggttactttaaatttacgttacgttacccgttccgtacgggtacggttaccggaccgaacgggtaccgaaagggttacggaaaacttacggaaaacgtacgtacggttcggactacggacaccgtataccttgttacctctacgttcccgttaccaccgtactaccgtagaaccg

SEQ ID NO: 396634 - DNA, 664 bp, Homo sapiens
  misc_feature: GZ8MTXP02H1QLL.19.22.B11.1.454.CMB.2.raw
  modified_base (209)..(209): a, c, t, g, unknown or other
  modified_base (254)..(254): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccaagaatattttanacaactcaaataataagaactatagcttggtccagcaagaaaccnggacagcctacctaagatagcttcttttatgggcattcgtggaccccgggtaatcccggggtcccctggaacccgtattacgaggtggcgacggcggggtctacggggaaccagtactttcactccgtcaccctaatcaacggccgcctgccgaggctacggaaagcgttggtcgggattaaacggtttttataacgtcgtactacgtacttaaagtttttactacggtaacttcccgtagtaccgggtttcgggacccgtaaaaggggacccgttaaagggtcgaaaaacgttacgtaaaaccggaaacgttcggtaacggtcgtaacgcctaaaccgttacgtaccttcggttaccttaaccgtactttaccccgttccccgtaccgtacttacccggtctaaaccgg

SEQ ID NO: 396635 - DNA, 643 bp, Homo sapiens
  misc_feature: GZ8MTXP02FY6AD.19.22.B11.1.454.CMB.2.raw
  modified_base (600)..(600): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatcgacccagtctccagacctccctggctgtgtctcgtgggcgagacgggccaccatacaactgacaagtccagaccaagtaattattttaactaacaacctaccaaataaataaagtaactacttagtcttggttacccagacaacgaaaccaggacacgcctacgtaagatgtcttcttttagtggctatcgtcggaccccggtacgtccccgggtacctagaccgtattcgaggtcggacgtacggcgggtcgtacgggactagtactttccacttcacacatcgaggccgcctgacgaggactaggaagtgtggtaggtacttagtttactacgtcgtacaagtactttaaattttacgaccgttaccgttccgtacgggtaccgttaccggaaccgaaagggtacgaaagggttaagaaacgtaacgaaaacgtagtacggtacgacctacgacctacctagttacctnttacctaacgtccttcccgtaccgacctagtacccgagaaccg

SEQ ID NO: 396636 - DNA, 710 bp, Homo sapiens
  misc_feature: GZ8MTXP02IABO4.19.22.B11.1.454.CMB.2.raw
  modified_base (214)..(214): a, c, t, g, unknown or other
  modified_base (285)..(285): a, c, t, g, unknown or other
tcagtactctcgtgcacgaccggtgctcgatttagacgacagctcaggggcagcaagatggtgttgcagacccaggtcttcatttctctgttgctctggatctctggtgtcgttcggggacatcgtgatgacccagtctccagactccctggctgtgtctcgtgggcgagagggccaccatcaactgcaacgtccagccaagtaattattttanacaactcaaataataagactattagcttggtccagacaagtaaaccaggacagcctaccagtatagtcttntttagtcgggctactcgtcgggacccggtaacgttccccggggtacccctaggacccggttaacttccgaaggtcgggaccgtagggtccgggggttctaccggggtaacctaggtactttaccgaacttccttaccgtaccgaattccgacggggtccgtccctaggggtacacggggtacctagggtaaggtacgttggggtacggtaacccgtttagggtttactttaccggttggtaccaaggttacctttaaagtttttaacgtacgttacccggttcccgtaaggggtccgggttacccggtaacgacgggaactaacgggtaggaaaccttagaaacgtagttacggagccttaggaccctagtcctaacgttcgttcgtaacgttcacccgtttccgaccctacttactcgtaacgg

SEQ ID NO: 396637 - DNA, 587 bp, Homo sapiens
  misc_feature: GZ8MTXP02FU2DP.19.22.B11.1.454.CMB.2.raw
  modified_base (207)..(207): a, c, t, g, unknown or other
  modified_base (225)..(225): a, c, t, g, unknown or other
  modified_base (235)..(235): a, c, t, g, unknown or other
  modified_base (332)..(332): a, c, t, g, unknown or other
  modified_base (351)..(351): a, c, t, g, unknown or other
  modified_base (378)..(378): a, c, t, g, unknown or other
  modified_base (396)..(396): a, c, t, g, unknown or other
tcagtactctcgtgcacgaccggtgctcgatttagacgacagctcaggggcagcaagatggtgttgcagacccaggtcttcatttctctgttgctctggatctctggtgtcttcgggacatcgtgatgacccagtctccagactccctggctgtgtctctgggcgagagggccaccatcaactgcaaagtccagccagaatatttanacaactccaaataataanaactacttancttggttccagcagaaaccaggacagcctcctaagatgctcttttatgggcatctgcccggaatccggggtccctgaccgattcaggtgcagcggtngggacagatttcactctcnccatcagcgcctgcagctgaagatcgnggctagttattagtgttnacgtataaatttttagagttactcccgttgtaaccggttcggacccgtaaaggggaccctaaaggggtacggaaaatacgtaaaaccggaaaactggttacgggacttcggaccttaaaccgacttcgtcggtttaacctcctaaggttaccccctttccggaccccgttttaacgtaccgtacgaaaccg

SEQ ID NO: 396638 - DNA, 532 bp, Homo sapiens
  misc_feature: GZ8MTXP02GOVVM.19.22.B11.1.454.CMB.2.raw
  modified_base (208)..(208): a, c, t, g, unknown or other
  modified_base (313)..(313): a, c, t, g, unknown or other
  modified_base (350)..(350): a, c, t, g, unknown or other
  modified_base (378)..(378): a, c, t, g, unknown or other
  modified_base (406)..(406): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttanacaactccaataataagaactacttagcttggttccagcagaaaccaggacagctctaagatgctctttattggcatctgcccgggaatccggggtcctgaccgnttcagtggcagcggtctggggacagatttcactctcnccatcagcgcctgcaggctgaaagatgnggcagtttactactgtcagcaaattttntaatactccctgggtaccgttcggccgtaaagggacctaaagggtacggaaaatcgaaaaacggtactagtggactcggacaacctagtctagtcttaacgactccttcccgctactcctagaacc

SEQ ID NO: 396639 - DNA, 579 bp, Homo sapiens
  misc_feature: GZ8MTXP02F10LW.19.22.B11.1.454.CMB.2.raw
  modified_base (206)..(206): a, c, t, g, unknown or other
  modified_base (253)..(253): a, c, t, g, unknown or other
  modified_base (288)..(288): a, c, t, g, unknown or other
  modified_base (350)..(350): a, c, t, g, unknown or other
  modified_base (355)..(355): a, c, t, g, unknown or other
  modified_base (379)..(379): a, c, t, g, unknown or other
  modified_base (382)..(382): a, c, t, g, unknown or other
  modified_base (399)..(399): a, c, t, g, unknown or other
  modified_base (413)..(413): a, c, t, g, unknown or other
tcagtactctcgtgcacgaccggtgctcgatttagacgacagctcaggggcagcaagatggtgttgcagacccaggtcttcatttctctgttgctctggatctctggtgtcttcggggacatcgtgatgacccagtctccagactcctggctgtgtctctgggcgagagggccaccatcaactgcaagtccagccagaatatttanacaactcaaataataagaactacttagcttggtccagtagaaaaccnggacagcctacctaagatgcttctttatggcatcnggccggaatccggggtccctgaccgtattcagtgcagcggtctgggacctagactttcactntcacngtcagcgctgctaggctgaaagtntgngtatagttatactgtanagtacttaatttanacgtaccttccgtaggtaccgttaccggaccgtaaaggaccgtaaaggtaacgtaaacgtaccgaaaacgtacgtcggtacggaccgttaggacctaaaccgtattccgtacgttccttaccaacgtttccgttaccccggacttaactcgtacggacctaacggg

SEQ ID NO: 396640 - DNA, 512 bp, Homo sapiens
  misc_feature: GZ8MTXP01DUVXG.9.53.E09.1.454.CMB.2.raw
  modified_base (226)..(226): a, c, t, g, unknown or other
  modified_base (245)..(245): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattangaccttgtctcctggtaccaacagcacccaggcaaacgccccaaactcatcatttatgaggtcactaagcggcctcagggtttctattcgtccttctctggctccaaagtctgactaacacggcctcctgacaatctctgggctccaggctgaggacgaggctgattatactggctgctcatatgacagatgtgcactccgtcggttagtcggttcggacgggacgacggttgacgtccgtacgtcgacgccgacgtcgcgtccccg

SEQ ID NO: 396641 - DNA, 512 bp, Homo sapiens
  misc_feature: GZ8MTXP01BRCZW.9.53.E09.1.454.CMB.2.raw
  modified_base (437)..(437): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaatcatcatttatgaggtcactaagcgcctcagggtttctattcgccttctctggctccaaagtctgacaacacggcctccctgacaatctctgggctccaggctgaggacgaggctgattattactggcttgctcatatgcagatggtnacactcccgtggttattcgggcggagggaccaagggttcgaccgtctagggtcaggcccaaggccttcgcccccg

SEQ ID NO: 396642 - DNA, 509 bp, Homo sapiens
  misc_feature: GZ8MTXP01BYS8G.9.53.E09.1.454.CMB.2.raw
  modified_base (227)..(227): a, c, t, g, unknown or other
  modified_base (303)..(303): a, c, t, g, unknown or other
  modified_base (429)..(429): a, c, t, g, unknown or other
  modified_base (435)..(435): a, c, t, g, unknown or other
  modified_base (440)..(440): a, c, t, g, unknown or other
  modified_base (444)..(444): a, c, t, g, unknown or other
  modified_base (486)..(486): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaacgcccccaaatcatcatttangagtcactaagcgcctgagggtttctattcgccttctctggctccaaagtctgacaacacggcctcctgacaatctctgggctccgaggctaggaggacgaggctgattattactggctgctcatntgcagntggtnaccnctccggtggttattcgggcggagggaccagggttgaccgtcnggtcagcccagtcttcgtccccg

SEQ ID NO: 396643 - DNA, 488 bp, Homo sapiens
  misc_feature: GZ8MTXP01EF6BK.9.53.E09.1.454.CMB.2.raw
  modified_base (282)..(282): a, c, t, g, unknown or other
  modified_base (378)..(378): a, c, t, g, unknown or other
  modified_base (395)..(395): a, c, t, g, unknown or other
  modified_base (483)..(488): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtattttagcagtggggacaccaactacagcccctccctcaagagtcgagtcaccatgtcagtagacacgtccaaagaaccagatctccctgaagctgacctctgtgaccgccgcggacacggccgtgtattactgtgcgagagttcccaaaatanagcaacagctggtacattcctttgatatgtggggccaaaggacaatggtcaccgtctcttcagccctccaccccaagggccatccggtcttccccnggcgccctgctccaggncacctcgagagcacagcggccctgggctcgcctggtcaaaggctacttcagacgtatcactgagcgggctgggcaaggcgcagttagnnnnnn

SEQ ID NO: 396644 - DNA, 517 bp, Homo sapiens
  misc_feature: GZ8MTXP01C64C3.9.53.E09.1.454.CMB.2.raw
  modified_base (316)..(316): a, c, t, g, unknown or other
  modified_base (334)..(334): a, c, t, g, unknown or other
  modified_base (365)..(365): a, c, t, g, unknown or other
  modified_base (394)..(395): a, c, t, g, unknown or other
  modified_base (407)..(407): a, c, t, g, unknown or other
  modified_base (417)..(417): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggaccaacagcacccaggcaaagccccaaatcatcatttatgagtcactaagcgccctnagggttcattcgcttctntgctccaaagtctgacaaacacggcctcccngacaatctctggctcagctgaggagaggnntatatatgtctnctacatatgnagagtgtacgtacgtacgtccgtcggttacgtcggacgggacggaacgaacggttcgttaccgtaaccgtacgtcgacgaccgacgtccgttccgtcccg

SEQ ID NO: 396645 - DNA, 526 bp, Homo sapiens
  misc_feature: GZ8MTXP01ARBPR.9.53.E09.1.454.CMB.2.raw
  modified_base (452)..(452): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattatgagtcactaagcggccctcaggggtttctggtcgcttctcctgcctcaagtctggcaacacgcctccctgacaatctctgggctccagtctgacgacgaggctgattatactgcaggctcatatgctagtttcggttcctctttcaaagtnttagttcgggcggaggggtacccagggctggacccgttcttgaacgtcaagccccaaggcctcgcccccgtcgg

SEQ ID NO: 396646 - DNA, 528 bp, Homo sapiens
  misc_feature: GZ8MTXP01AV7C7.9.53.E09.1.454.CMB.2.raw
  modified_base (446)..(446): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggcaaacgccccaaactcatcatttatgaggtcactaagcggccctcgtaggggtttctattcgccttctctggctccaaagtctgacaacacggcctccctgacaatctctgggctccgaggctggaggacgaggctgattatactggctgctcatatgcagatggtnacacgtcccgtggttagttcgggcggacgggaccaagggttcgaccgtcaaggtccacggcccgaagggccttcgtcccccg

SEQ ID NO: 396647 - DNA, 512 bp, Homo sapiens
  misc_feature: GZ8MTXP01CJJQB.9.53.E09.1.454.CMB.2.raw
  modified_base (293)..(293): a, c, t, g, unknown or other
tcagtgatacgtctcacgaccggtgctcgatttagagagagtgtgtttggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcaccaggcaaagcccccaaatcatcatttangaggtcactaagcggccctcaggggtttctattcgcttcctctggctccaagtctgaacaacacggcctcctgacaatctctgggctccaggctgaggacgaggctgattatactgctgcttcatatgcagatggtgacacctcccggtggtattcgggcggagggacccaaggttcgaccgttcctaaggtcaacggcccaaggctcgcccccgtcgg

SEQ ID NO: 396648 - DNA, 506 bp, Homo sapiens
  misc_feature: GZ8MTXP01CBNKP.9.53.E09.1.454.CMB.2.raw
  modified_base (240)..(240): a, c, t, g, unknown or other
  modified_base (258)..(258): a, c, t, g, unknown or other
  modified_base (302)..(302): a, c, t, g, unknown or other
  modified_base (443)..(443): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgacattggtncttataactatgtctccnggtaccaacagcacccaggcaaagtccccaaactcatgatttangaggtcaataagcggccctctggggtccctgactcgcttctctggctccaagtctggcaacacggcctcctgaccgtctctgggctccaggctgacgagtgaggctgatttagttactgcagctcatatgcaggcacccanaatgttcttcggagtcgggacacgggttcaccgtctaggtcacgcccaggcccaacccgtaac

SEQ ID NO: 396649 - DNA, 512 bp, Homo sapiens
  misc_feature: GZ8MTXP01CXL52.9.53.E09.1.454.CMB.2.raw
  modified_base (309)..(309): a, c, t, g, unknown or other
  modified_base (444)..(444): a, c, t, g, unknown or other
  modified_base (449)..(449): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcacccaggcaaacgcccccaaatcatcatttangagtcactaagcgcctgaggggtttctacttcgcttctctggctccaagtctagacacacggcctcctgacaatctctgggctccgaggctggacggacgaggctagtatttattactgctgcttcatatgcagntggtnaacacgttccgtgttagttcggcggagggccaggtcgaccgtcgtaggtcacgccgaaggtcc

SEQ ID NO: 396650 - DNA, 506 bp, Homo sapiens
  misc_feature: GZ8MTXP01C38H6.9.53.E09.1.454.CMB.2.raw
  modified_base (227)..(227): a, c, t, g, unknown or other
  modified_base (435)..(435): a, c, t, g, unknown or other
  modified_base (444)..(444): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaaccngcagtgatgttggggattatgaccttgtctcctggaccaacagcacccaggcaaagccccaaactcatcatttatgaggtcactaagcggccctcaggggtttctattcgcctttctctggctccaaagtctgacaacacggcctcctgacaatctctgggctccaggctgaggacgaggctgtattattactggctgctacatatgnagatggtanacacgtccgtgttgtcgggcgtaggcaaggttcgacgtcagtcacgccagtccgcgtccccg

SEQ ID NO: 396651 - DNA, 521 bp, Homo sapiens
  misc_feature: GZ8MTXP01BIUXT.9.53.E09.1.454.CMB.2.raw
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcattggtggttatgactatgtctcctggtatcaacaacacccaggcaaagcccccaaatcttgatttatgaggtcagtaggaggccctcagggggtccctgatcgcttctcctggctccaagtctagccaacacggccctccctgacccgtctctgggctccaggctgaggatgaggctgattattattgcaggctcatattcaggcagtaacgtagggttttcggcgggtaggaccaagcttgaccgttcgtaggtcacgccaggctcgcccctcggtcactcgttcgttcccc

SEQ ID NO: 396652 - DNA, 546 bp, Homo sapiens
  misc_feature: GZ8MTXP01ALHF4.9.53.E09.1.454.CMB.2.raw
  modified_base (246)..(246): a, c, t, g, unknown or other
  modified_base (298)..(298): a, c, t, g, unknown or other
tcagtgatacgtctcacgaccggtgctcgatttagagagagtgtgttgggtttgggggggtcacaagaggcagcgctctcgggacgtctccaacatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattangacttgtctctggaccaacagcaccaggcaaagcccccaaatcatcatttangagtcactaagcggcctgagggtttctattcgccttctctgctccaaagtctgacaacacggccctcctagacaatctcgtgggctccgaggctggacggacgagggctgtattattactgggctgctcatactgcagtatggtagacctacgtcccggtgggttacttccggggcggtaacggggaccttaaggggttcgaacccggtctagggtccacggcccgaacgggtccttccggtcccccg

SEQ ID NO: 396653 - DNA, 512 bp, Homo sapiens
  misc_feature: GZ8MTXP01BV2RL.9.53.E09.1.454.CMB.2.raw
  modified_base (241)..(241): a, c, t, g, unknown or other
  modified_base (295)..(295): a, c, t, g, unknown or other
tcagtgatacgtctcacgaccggtgctcgatttagagagagtgtgtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattangacttgtctcctggtaccaacagcaccagcaaacgcccccaaatcatcatttangagtcactagcgcctgagggtttctattcgcttcctctggctccaagtctagaacaacacggccctcctgacaatctctggctcgagctgaggacgagctgattatactgctgcttcatatgcagtatgtgaccacgtcccgtggtacttcgggacggacgggaaccgtagggttcgccgttcgtaaggtcaacgcccaaggcctccgcccccgtcg

SEQ ID NO: 396654 - DNA, 519 bp, Homo sapiens
  misc_feature: GZ8MTXP01AVDPG.9.53.E09.1.454.CMB.2.raw
  modified_base (231)..(231): a, c, t, g, unknown or other
  modified_base (310)..(310): a, c, t, g, unknown or other
  modified_base (449)..(449): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagccacccaggccaaacgcccccaaactcatcatttangagtcactaagcgcctgagggtttctacttcgtcttctctggctccaagtctgacacacggcctcctgacatctcgtgggcctcgaggctgacgggacgaggctagtatttattactgtctgctcatatgctagatggngaactacgttccggtgttacgtcgggcggacggcgaaggtcgaccgtcgaggtcacgtccgaaggtcccg

SEQ ID NO: 396655 - DNA, 502 bp, Homo sapiens
  misc_feature: GZ8MTXP01BUBTU.9.53.E09.1.454.CMB.2.raw
  modified_base (316)..(316): a, c, t, g, unknown or other
  modified_base (437)..(437): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgacttgtctcctggtaccaacagcacccaggcaaagcccccaaatcatcattatgaggtcactaagcgcctnagggtttctattcgccttctctggctcaaagtctgacaacacggcctccctagacaatctctgggctccaggctaggaggcgaggctgattatactggctgctcatatgcagatggtgacncgtcccgtggttatcggcggaggaccaagttcgaccgtctaggtcacgccaggtcttcgcccccg

SEQ ID NO: 396656 - DNA, 518 bp, Homo sapiens
  misc_feature: GZ8MTXP01BBJHM.9.53.E09.1.454.CMB.2.raw
  modified_base (298)..(298): a, c, t, g, unknown or other
  modified_base (437)..(437): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggaccacagcaccaggcaaacgcccccaaatcatcatttangagtcactaagcgacctcgacgggtttctattcgtccttctcgtgctccaaacgtctcgacaaacacggcctccctgacaactctctgggctcaggcgtcgaggacgagctgtattattactgctgctacatatgcagngtagtgacactcccgtgttagttcgcgggacggaccgaggttcgaccgtcctaggtcacgcccgaaggccgttcgcccccg

SEQ ID NO: 396657 - DNA, 538 bp, Homo sapiens
  misc_feature: GZ8MTXP01ETULY.9.53.E09.1.454.CMB.2.raw
  modified_base (226)..(226): a, c, t, g, unknown or other
  modified_base (302)..(302): a, c, t, g, unknown or other
  modified_base (438)..(438): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggaccaacagcacccaggcaaacgcccccaaatcatcatttangagtcactaagcggcctgagggtttctattcgtccttctctggctccaaagtctgacaacacgcctcctgacaatctctgggctcaggctgaggacgaggctgattattactggctgctcatatgcagtatgggtnactctccggttggttacgttcgggcgggagggaaccgttaaagggttcgttacccggtccgtaagggtccaacggcccgaagggtccttcgtcccccccg

SEQ ID NO: 396658 - DNA, 532 bp, Homo sapiens
  misc_feature: GZ8MTXP01DXW9U.9.53.E09.1.454.CMB.2.raw
  modified_base (308)..(308): a, c, t, g, unknown or other
  modified_base (415)..(415): a, c, t, g, unknown or other
  modified_base (448)..(448): a, c, t, g, unknown or other
  modified_base (503)..(503): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttggggattatgaccttgtctcctggaccaacagcacccaggacaaacgcccccaaactcatctatttangaggtcactaagccggccctcgtaggggtttctattcgtccttctctggctccaaatctgacaacacgcctccctgacatctcgtcgggctcgagcgtagaggacgnggctgattattactggcttgctcatatgacagntggtcgtacacgtccgtggttacgttcgggacggagggaccagggttcacccgtntaggtcacgcccaaggtccttcgtccccg

SEQ ID NO: 396659 - DNA, 510 bp, Homo sapiens
  misc_feature: GZ8MTXP01BA9ZL.9.53.E09.1.454.CMB.2.raw
  modified_base (441)..(441): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcaccaggcaaacgccccaaactcatcatttatgaggtcactaagcggcctcgaggggtttctattcgtccttctctggctccaaagtctgacaacacggcctcctgacaatctctgggctcaggctgagacgagctgattattactggctgctcatatgacagagtggtnacacgtcccgtggttagttcggcggagggacaaggttgaccgtctaggtcacgccaggcttcgtccccg

SEQ ID NO: 396660 - DNA, 521 bp, Homo sapiens
  misc_feature: GZ8MTXP01DS2VB.9.53.E09.1.454.CMB.2.raw
  modified_base (227)..(227): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttggggattatgaccttgtctcctggtaccaacagcacccaggcaaagcccccaaatcatcatttatgaggtcactaagcggcctcaggggtttctattcgcttctctggctcaaagtctgacaacacggcctcctgacatctctggctcaggctgaggcagctgattatactggctgctcatatgcagatggtgacacgtcccgtggttacgttcgggcgggtacgggaccaagggttcgaccgttcgtaaggtccgacgcccgaaggccgttcgtccccccg

SEQ ID NO: 396661 - DNA, 443 bp, Homo sapiens
  misc_feature: GZ8MTXP01DNGIU.9.53.E09.1.454.CMB.2.raw
  modified_base (298)..(298): a, c, t, g, unknown or other
  modified_base (302)..(302): a, c, t, g, unknown or other
  modified_base (317)..(317): a, c, t, g, unknown or other
  modified_base (428)..(428): a, c, t, g, unknown or other
  modified_base (434)..(443): a, c, t, g, unknown or other
tcagtgatacgtctcacgaccggtgctcgatttagagagagtgtgttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtgggccaagggacaatggtcaccgtctcttcagcctccaccaaggcccatcggtcctccccnggcnccctgctccaggacncacctccgagacgcacgagccggccctggggcctcgcccgtggtaccaaacggaccttaaaccttcccaagacgttaatccaacgtgacggcggggctgggacaaagggcncaatgnnnnnnnnnn

SEQ ID NO: 396662 - DNA, 522 bp, Homo sapiens
  misc_feature: GZ8MTXP01C4P87.9.53.E09.1.454.CMB.2.raw
  modified_base (378)..(378): a, c, t, g, unknown or other
  modified_base (436)..(436): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcacccaggcaaacgcccccaaactcatcatttatgaggtcactaagcggccctcgaggggtttctattcgcttctctggctccaagtctgacacacgctccngacatctctgggctccaggctggacggacgaggctagatttattactgcctgctcatntagctagatggtgaacacttcccggtggttacgttcgggcggttagggcaagggtcgaccgtccgttaggcacgcccgaaggtccc

SEQ ID NO: 396663 - DNA, 565 bp, Homo sapiens
  misc_feature: GZ8MTXP01A922W.9.53.E09.1.454.CMB.2.raw
  modified_base (537)..(537): a, c, t, g, unknown or other
  modified_base (555)..(555): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctccctccgcgtccgggtctcctggacagtcagtcaccatctcctgcactggaaccagcattggtgttatgactatgtctcctggtatcaacaacacccaggcaaacgcccccaaactcttgatttatgaggtcaggtaggaggccctcgagggggtccctggactcgcttctctggcctccaagtctgaccaaacaccggcctccctgacccgtctcgtcgggctaccaggctggagatgaggctgtattattattgcagctcatattcaggcagttaacgaggggttttcggcgggtaagggaccaaagtcgtcgaaccgttccgtaagggttcaacgcccgaacggcttcgccccctcggtccncgtccttcgttaaccccncccgttcccg

SEQ ID NO: 396664 - DNA, 514 bp, Homo sapiens
  misc_feature: GZ8MTXP01EH8AF.9.53.E09.1.454.CMB.2.raw
  modified_base (327)..(327): a, c, t, g, unknown or other
  modified_base (387)..(387): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgacttgtctctggtaccaacagcaccaggacaaacgcccccaaactcatcatttatgaggtcactaagcgccctnaggggtttctacttcgctctctggctacaagtctgacaacacggcctcctgacaatctcnggctcaggctggaggacgaggctgattattactgtctgctcatatgcagatggtcgaactacgttccgtggttacgttcgggcggagggccaaggtgaccgtcgttaggcacgcccgaagggtcccg

SEQ ID NO: 396665 - DNA, 503 bp, Homo sapiens
  misc_feature: GZ8MTXP01DIGMB.9.53.E09.1.454.CMB.2.raw
  modified_base (437)..(437): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacaggtcgatcaccatctcctgcactggaacaagcagtgatgttgggattatgaccttgtctcctggtaccaacagcacccaggcaaagccccaaactcatcatttatgaggtcactaagcggcctcaggggtttctattcgccttctctggctcaaaagtctgacaacacggcctccctgacaatctctgggctcagctgagacgaggctgattattactggctgctcatatgcagatggtnacatcccgtggttattcgggcggagggccaaggttcgacgtcaggtcagcccaaggcttcgccccg

SEQ ID NO: 396666 - DNA, 531 bp, Homo sapiens
  misc_feature: GZ8MTXP01BKPIV.9.53.E09.1.454.CMB.2.raw
  modified_base (221)..(221): a, c, t, g, unknown or other
  modified_base (240)..(240): a, c, t, g, unknown or other
  modified_base (297)..(297): a, c, t, g, unknown or other
  modified_base (432)..(432): a, c, t, g, unknown or other
tcagtgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgacttagcctgcctccgtgtctgggtctcctggacagtcgatcaccatctcctgcactggaaccngcagtgatgttgggattangaccttgtctcctggtaccaacagcacccaggcaaacgcccccaaatcatcatttangaggtcactaagcggccctgagggtttctattcgcttctctggctcaagtctagacaacacgcctccctgacatctctgggctccgagctgaggacgagctgattatactgctggctcgatagtgcagatgggtnaccacgttcccgtgggtaacgttcgggcgggtagggaccgaagggtcgaccgttccgttaggtccaggcccgtaaggccttacgccccgttggtaaccc

SEQ ID NO: 396667 - DNA, 511 bp, Homo sapiens
  misc_feature: GZ8MTXP01BFJ5G.9.53.E09.1.454.CMB.2.raw
  modified_base (231)..(231): a, c, t, g, unknown or other
  modified_base (310)..(310): a, c, t, g, unknown or other
  modified_base (441)..(441): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggagttatgaccttgtctcctggtaccaacagcacccaggcaaacgcccccaaactcatcatttangaggtcactaagcgcctcgaggggttctacttcgcttctctggctccaagtctgacacacgcctcctgacatctctgggctccagctgaggacgagctgtattatactgctgctcatatgcagtatgggtnaactacgttcccggtgttagtcggcgggaggttccgaggtcgccgtcgtaggcacgtcccgaaggtcccg

SEQ ID NO: 396668 - DNA, 503 bp, Homo sapiens
  misc_feature: GZ8MTXP01DHT1M.9.53.E09.1.454.CMB.2.raw
  modified_base (424)..(424): a, c, t, g, unknown or other
  modified_base (444)..(444): a, c, t, g, unknown or other
  modified_base (453)..(453): a, c, t, g, unknown or other
  modified_base (495)..(495): a, c, t, g, unknown or other
tcagtgatacgtctcacgaccggtgctcgatttagagagagtgtgttggctttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgtggagttatgacttgtctctggtaccaacagcaccaggcaaagccccaaactcatcatttatgagtcactaagcggcctcgagggtttcctattcgtcttctctggctcaaagtctgacaacacggcctccctagactaatctctgggctccagctgagacgaggctagattatactgctgctnatatgtctagttcgttcctntttcaagtnttagtcggcggttagggccagggtctgaaccgtcctgagtcncgaacccg

SEQ ID NO: 396669 - DNA, 561 bp, Homo sapiens
  misc_feature: GZ8MTXP01AYDU5.9.53.E09.1.454.CMB.2.raw
  modified_base (227)..(227): a, c, t, g, unknown or other
  modified_base (266)..(266): a, c, t, g, unknown or other
  modified_base (297)..(297): a, c, t, g, unknown or other
  modified_base (430)..(430): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctctggacaacngcaccaggcaaacgccccaatcatcatttangagtcacgtaagtcgcctgtagggtttctattcgtccttctctggctcaaagtctgacaacacgcctcctagactatctcgtcggctcgaggctaggaggacgaggctgtattattactgggctgctactatntgacagagtcggtacgaccgtcgttcccggtagggttacggttcgggcgggtaaacggggaccgttaacgggttccgttacccggtaaccgttacggccgaccgcccgaacggtcccgttccggtcccccg

SEQ ID NO: 396670 - DNA, 579 bp, Homo sapiens
  misc_feature: GZ8MTXP01B15SD.9.53.E09.1.454.CMB.2.raw
  modified_base (287)..(287): a, c, t, g, unknown or other
  modified_base (412)..(412): a, c, t, g, unknown or other
  modified_base (437)..(437): a, c, t, g, unknown or other
  modified_base (527)..(527): a, c, t, g, unknown or other
  modified_base (563)..(564): a, c, t, g, unknown or other
  modified_base (566)..(579): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgttatttttagcaggtggggacaccaactacacgcccctcctcaagagtcgagtcaccatgtcagtagacacgtccaagaaccagatcctcctgaagctgacctctgtcgaccgccgcggacacggccgtgtattactgtgcgagtacgttacccaaatanagacaacagctaggtactatttcctttgatagtggtggggaccaagggaactaagtcggtaccaccgttctcttacacgccctaccaaccccgaacggggccctagtcccggtcccttcccccgnggcccgccctgccctcccgaggacnccaaccctccgagacgcacgacgcccggccccgtggggctcggcctggtaccaagggtaccttacgttccgaaggtacctataccacggnggacggcgggcgtcgggacgacgggcgtaacagagnngnnnnnnnnnnnnnn

SEQ ID NO: 396671 - DNA, 521 bp, Homo sapiens
  misc_feature: GZ8MTXP01D9N0F.9.53.E09.1.454.CMB.2.raw
  modified_base (282)..(282): a, c, t, g, unknown or other
  modified_base (382)..(382): a, c, t, g, unknown or other
  modified_base (514)..(521): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaaagaaccagatctccctgaagctgacctctgtgaccgccgcggacacggccgtgtattactgtgcgagagttcccaaatanagcaacagctggtacattcctttgatatggtggggaccaaagggacaatggtcaccgtctcttcagcctccacccaagggccagtccggtccttcccccnggcccgccctgcctcccaggacgcaccctccgagacgcacgagccggcccgtggggctcgccgtggtacaaagggaccttacgttcccagtaccgtatcgaactgaggcgggctggaccaaggcgcattagnnnnnnnn

SEQ ID NO: 396672 - DNA, 547 bp, Homo sapiens
  misc_feature: GZ8MTXP01BBXZ1.9.53.E09.1.454.CMB.2.raw
  modified_base (227)..(227): a, c, t, g, unknown or other
  modified_base (417)..(417): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaagcccccaaactcatcatttatgaggtcactaagcggccctcaggggtttctattcgccttctctgctccaaagtctgacaacacgcctcctgacaatctctgggctcaggctgaggacgaggctgtattattacnggctgcttcagtactgacaggatgggtacacgacctccccggtgggttacgttccggggcggaacggggaccaaggggttcgaaccgtccgtaacggtcacggcccgaaggtcccgttcgtcccccccgg

SEQ ID NO: 396673 - DNA, 581 bp, Homo sapiens
  misc_feature: GZ8MTXP01EWAUW.9.53.E09.1.454.CMB.2.raw
  modified_base (260)..(261): a, c, t, g, unknown or other
  modified_base (318)..(320): a, c, t, g, unknown or other
tcagtgatacgtctcacgaccggtgctcgatttagagagagtgtgggtttgggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattacnntgtacgtacgtacgtacgtacctaactaatacgacgaacgtacgtacgtacgttacnnntactctcgttaacgttagtcgtacgtcggtaccggacggacgtacgtacgtaccgtaccgtaccgtccgtaccgtaccgaccgtacccgtacccgacccgaccgtaccgtacccgttcccgttccccgtcccgtccgcccggtccgtccgtaccgacgacgaccgaccgaccgacgacgacgacgacgcggccggtccggcgtcgttcgtcgtacgacgacgttacgtaacctacgtaacgtacgtacgacgtcgcggcgg

SEQ ID NO: 396674 - DNA, 551 bp, Homo sapiens
  misc_feature: GZ8MTXP01B8GIH.9.53.E09.1.454.CMB.2.raw
  modified_base (300)..(300): a, c, t, g, unknown or other
tcagtgatacgtctcacgaccggtgctcgatttagagagagtgtgtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattatgaccttgtctcctggtaccaacagcaccaggacaaacgccccaaactcatcatttangagtcactaagcgcctcgtagggtttctattcgcttcctctgctcagtctgaacacacggcctcctgacaatctctggctccgagtctaggaggacggagctagattattactgtctgtctcatatgcagtaacgtggtacgaacctccgtcccggttggtacgttcggggacgggacgggaaaccgtaagggttcggaccgttccgtaaggtacgaacgacccggacggccgtcccgccccgttcccggg

SEQ ID NO: 396675 - DNA, 586 bp, Homo sapiens
  misc_feature: GZ8MTXP01CPV7T.9.53.E09.1.454.CMB.2.raw
  modified_base (304)..(304): a, c, t, g, unknown or other
  modified_base (363)..(363): a, c, t, g, unknown or other
  modified_base (372)..(372): a, c, t, g, unknown or other
  modified_base (380)..(380): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctctggaccaacagcacccaggacaaacgccccaaatcatcatttangagtcactaagcggccttgagggtttctattcgccttctctggctcaagtctgacaacncggcctccngacatctntcgggctcgaggctaggacggtacggaggtcgtagtatttattacgtggtctgctacattacgtgacgtagtagtcggtacgacctaccgttaacccggtggttacggttccggggacgggtaacgggaccggttaacgggttcggttacccggttccgtacgggtccgaacggcccgaaacgggtccgttaacccggtcccccgg

SEQ ID NO: 396676 - DNA, 503 bp, Homo sapiens
  misc_feature: GZ8MTXP01DUSUJ.9.53.E09.1.454.CMB.2.raw
  modified_base (286)..(286): a, c, t, g, unknown or other
  modified_base (341)..(341): a, c, t, g, unknown or other
  modified_base (384)..(384): a, c, t, g, unknown or other
  modified_base (435)..(435): a, c, t, g, unknown or other
  modified_base (445)..(445): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcatcctcctcactcaggacacagggtcctgggcccagtctgccctgactcagcctgcctccgtgtctggtctcctggacagtcgatcaccatctcctgcactggacccaccactgatattgggcattataaccttgtctcctgatcaacaacgcccagacaaagcccccanactcttaatttatgaggtcactaagcggccctcgaggggtttctggtcgctttcnctgcctcaagtctgcaacacgcctccctgacatctctggctcngtctgacgacgagctgattattactgcagctcatatgctagttggttcctntttacaagtntaattcggcggaggaccagggcttagccgttctgagtcagccagtcgttcgtcccccg

SEQ ID NO: 396677 - DNA, 505 bp, Homo sapiens
  misc_feature: GZ8MTXP01BJSCF.9.53.E09.1.454.CMB.2.raw
  modified_base (225)..(225): a, c, t, g, unknown or other
  modified_base (293)..(293): a, c, t, g, unknown or other
  modified_base (430)..(430): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactgaaccngcagtgatgttgggattatgacttgtctctggacacagcaccaggcaaacgccccaaatcatcattangagtcactaagcgcctgtagggtttctattcgcttctcgtggctcaaagtctgacaacgacggcctcctgactaactctcgtgggctcgaggctaggacggacgaggctagattattactggctgctcatatgcagntgggtcacacgtccgtagttcgttcgggcggagggacagggttcaccgtctaggcacgccaggccttcgtccccg

SEQ ID NO: 396678 - DNA, 543 bp, Homo sapiens
  misc_feature: GZ8MTXP01EPU7H.9.53.E09.1.454.CMB.2.raw
  modified_base (229)..(229): a, c, t, g, unknown or other
  modified_base (248)..(248): a, c, t, g, unknown or other
  modified_base (303)..(303): a, c, t, g, unknown or other
  modified_base (343)..(343): a, c, t, g, unknown or other
  modified_base (369)..(369): a, c, t, g, unknown or other
  modified_base (437)..(437): a, c, t, g, unknown or other
  modified_base (448)..(448): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattangaccttgtctctggaccaacagcaccaggacaaacgcccccaaatcatcatttangagtcactaagcggcctgtagggtttctattcgccttctntgctcaaagtctgacacacgcctccngacatctcgtggctccaggctaggaggtacgaggctagatttattacgtggtctgctacattagtggnaaggtatggtntaccgacgttcccggttggttacgttcggggacggagggaaccgaagggttcgacccgttcgtaggtcgacgcccgaaggtccgttcgtcccccg

SEQ ID NO: 396679 - DNA, 533 bp, Homo sapiens
  misc_feature: GZ8MTXP01CRP2G.9.53.E09.1.454.CMB.2.raw
  modified_base (283)..(283): a, c, t, g, unknown or other
  modified_base (522)..(533): a, c, t, g, unknown or other
tcagtgatacgtctcacgaccggtgctcgatttagagagagtgtgggtttgggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaaagaaccagatctccctgaagctgacctctgtgaccgccgcggacacgggccgtgtattactgtgcgagacgttcccaaatanagcaacagctggtacatttccttttgatatggtgggggaccaaagggacaagtggtcaccgtctcttcacgcctccaccccaacgggccagtccggtcccttccccccgtgggcccgcccctgcctccgagggacgccaaccctccgagacgcacgagccggccctggggctcgccgtgtacaacggacctacgttccagtacgtactcacgtggagcgggctggcaaggcgcattagnnnnnnnnnnnn

SEQ ID NO: 396680 - DNA, 549 bp, Homo sapiens
  misc_feature: GZ8MTXP01DBJF6.9.53.E09.1.454.CMB.2.raw
  modified_base (304)..(304): a, c, t, g, unknown or other
tcagtgatacgtctcacgaccggtgctcgatttagagagagtgtggttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacacgcacccaggaccaaacgacccccaaatcatctatttangagtacactaagcggtccctcgtaggggtttctattcgtcttcctctggctcagtctagaacaacacggccctccagacatctcgtggcctcgaggcgtaggaaggacgagctagatttacttactgtctcgcttacagtatgacagagtggtcgactaccgtcccggtggtacgttcggggacgggacgggtacgaggttcgaccgttcgtaacggcaacgccgacggcctcgccccgttccgg

SEQ ID NO: 396681 - DNA, 514 bp, Homo sapiens
  misc_feature: GZ8MTXP01B3EY8.9.53.E09.1.454.CMB.2.raw
  modified_base (227)..(227): a, c, t, g, unknown or other
  modified_base (301)..(301): a, c, t, g, unknown or other
  modified_base (371)..(371): a, c, t, g, unknown or other
tcagtgatacgtctcacgaccggtgctcgatttagagagagtgtgttggggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgacttgtctctggaccaacagcacccaggacaaacgcccccaaatcatcatttangaggtcactaagcggcctcgtagggtttctattcgccttctctggctcaaagtctgacacacgcctcctnacatctctggctcaggctagaggacgaggctgattattactggctgcctacatatgcagatggtgacacgtccggtgttacgttcggacggacgggacaagggttcgacccgtcgtaggtcacggccaggtccttcgtccccg

SEQ ID NO: 396682 - DNA, 539 bp, Homo sapiens
  misc_feature: GZ8MTXP01ATSCS.9.53.E09.1.454.CMB.2.raw
  modified_base (447)..(447): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgacttgtctctggtaccaacagcacccaggcaaacgccccaaactcatcattatgagtacactaagcggcctacacgggggtttctattcgtccttctctcggctccaaagtctgacaacacggcctcctgacaatctactgggctccaggctagaggacgaggctgacttattactggctgctcatatgcagtatggtnaccacgtccgtggttagttcggcgggacgggacgaacgggttcgacccggtcgtacgggtccacggacccgaacggtccgttccgtcccccg

SEQ ID NO: 396683 - DNA, 513 bp, Homo sapiens
  misc_feature: GZ8MTXP01EZL3D.9.53.E09.1.454.CMB.2.raw
  modified_base (295)..(295): a, c, t, g, unknown or other
tcagtgatacgtctcacgaccggtgctcgatttagagagagtgtgttggggggtcacaagaggcagcgctctcgggacgtctccaccatggcctgggctctgctgctcctcaccctcctcactcaggacacagggtcctgggcccagtctgccctgactcagcctgcctcgtgtctggtctcctggacagtcgatcaccatctcctgcactggaaccagcagtgatgttgggattatgaccttgtctcctggtaccaacagcacccaggcaaacgcccccaaactcatcatttangagtcactaagcggccctcgagggtttcattcgcttcctctggctccaagtctgcaacacggcctccctgacaatctctgggctccaggctggaggacgaggctgattattactgctgctcatatgcagatggtgacactcccggtggtacttcgggcggttagggaccaagggttcgaccgttccgtaaggtcaacgcccaggcctcgccccgtcgg

SEQ ID NO: 396684 - DNA, 518 bp, Homo sapiens
  misc_feature: GZ8MTXP01EDHYT.9.53.E09.1.454.CMB.2.raw
  modified_base (226)..(226): a, c, t, g, unknown or other
  modified_base (299)..(299): a, c, t, g, unknown or other
  modified_base (369)..(369): a, c, t, g, unknown or other
  modified_base (375)..(375): a, c, t, g, unknown or other
  modified_base (388)..(388): a, c, t, g, unknown or other
  modified_base (414)..(414): a, c, t, g, unknown or other
  modified_base (433)..(433): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactggaaccngcagtgatggttgggattatgacttgtctcctggaccaacagcaccaggacaaacgccccaatcatcatttangagtcactacgcgccctgtagggtttctattcgccttctctggctccaaagtctgacacacggcctcctnacatcncgtggctcgaggntaggaggacgaggctagattattacnggtctgctcatatgcaagntggtcgactcgtccggtgttacgttcgggcgggaggaccttaaggttcgacccgtcgtagtcgcgccgacgtccgttccgccccg

SEQ ID NO: 396685 - DNA, 555 bp, Homo sapiens
  misc_feature: GZ8MTXP01B5C6Y.9.53.E09.1.454.CMB.2.raw
  modified_base (268)..(268): a, c, t, g, unknown or other
  modified_base (300)..(300): a, c, t, g, unknown or other
  modified_base (355)..(355): a, c, t, g, unknown or other
  modified_base (436)..(436): a, c, t, g, unknown or other
  modified_base (441)..(441): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcacatctctgcactggaaccagcagtgattggttggggattatgaccttgtctcctggaccaacngcaccaggcaaacgccccaaatcatcatttangagtcactaagcgcctgagggttctatcgtcctctctgctcaaagtctgacaacncggccctcccgacactctcgtcggcctccgaggccgtaggacgggaaccgaggtctagtatttaagtacgtgctgtcctanattangacgagtacgtcggtacgtaccgtaccgtccggttaagggtcgttcggggacggacggaacgtacggttcgccgttcgtaacgcgaacgaccgacggcctcccgttccccgtcg

SEQ ID NO: 396686 - DNA, 510 bp, Homo sapiens
  misc_feature: GZ8MTXP01EXHDB.9.53.E09.1.454.CMB.2.raw
  modified_base (413)..(413): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggaccaacagcaccaggcaaacgcccccaaactcatcatttatgaggtcactaagcggcctcgtaggggtttctattcgccttctctggctccaaagtctgacaacacgcctcctgacactctcgtggctcagctgagacgagctagattatacnggctgctcatactgcagatggtcgcacgtcccgtggttacgttcggacggacggacgaacggttcgaccgtctagtcacgccgaggcttcgcccccg

SEQ ID NO: 396687 - DNA, 525 bp, Homo sapiens
  misc_feature: GZ8MTXP01CB2Q2.9.53.E09.1.454.CMB.2.raw
  modified_base (246)..(246): a, c, t, g, unknown or other
  modified_base (303)..(303): a, c, t, g, unknown or other
  modified_base (450)..(450): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattangaccttgtctcctggtaccaacagcacccaggcaaacgcccccaaatcatcatttangaggtcactaagcggccctcgaggggtttctattcgccttctctggctccaaagtctgacaacacgcctccctgacaatctctgggctccgaggctaggaggacgaggctgattagttactggctgctcatatgcagagtggtcacncgtcccggtggttacgttcgggcggagggaccaagggttcgaccgtcgtagtcacgcccagggtcttcgtccccg

SEQ ID NO: 396688 - DNA, 514 bp, Homo sapiens
  misc_feature: GZ8MTXP01AF1GR.9.53.E09.1.454.CMB.2.raw
  modified_base (344)..(344): a, c, t, g, unknown or other
tcagtgatacgtctcacgaccggtgctcgatttagagagagtgtgttgggtttggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgcccccaaactcatcatttatgaggtcactaagcggccctcaggggtttctattcgnttctctggctccaagtctgacaacacggactccctgacaatctctgggctccgaggctgaggacgaggctgattagttactgctgctcatatgctagatggtgaacacttcccgtggttagttcggcggttgggaccagggtgaccgtcgtaggtcagcccgaaggcccg

SEQ ID NO: 396689 - DNA, 505 bp, Homo sapiens
  misc_feature: GZ8MTXP01EG9NS.9.53.E09.1.454.CMB.2.raw
  modified_base (349)..(349): a, c, t, g, unknown or other
tcagtgatacgtctcacgaccggtgctcgatttagagagagtgtgttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctcaatctncaacacggcctcctgacaatctctggctccaggctgaggcgaggctgattattactgctgcttcatatgcagatggtgacactcccggtgtagttcgggcggagggacgaaggttgccgttcctaaggtcaagcccgaaggcctcgccccgtccgg

SEQ ID NO: 396690 - DNA, 567 bp, Homo sapiens
  misc_feature: GZ8MTXP01DQF63.9.53.E09.1.454.CMB.2.raw
  modified_base (417)..(417): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggccaaacgcccccaaactcatcatttatgaggtcactaagcggcctcgagggtttctattcgtccttctctggctcaaagtctgacaacacggcctccctgacaatctctggctcagctgagacgaggctgattatacnggctgctcatatgacagtagtggtacgacctacgttccccggtggttacggtttcgggaccgggtacggggaaccgttaaacggggttcgaacccggttccgtaagggttcccgacggaccccgaaggggtcccttccggtcccccccgg

SEQ ID NO: 396691 - DNA, 527 bp, Homo sapiens
  misc_feature: GZ8MTXP01AGJXI.9.53.E09.1.454.CMB.2.raw
  modified_base (227)..(227): a, c, t, g, unknown or other
  modified_base (247)..(247): a, c, t, g, unknown or other
  modified_base (270)..(270): a, c, t, g, unknown or other
  modified_base (303)..(303): a, c, t, g, unknown or other
  modified_base (448)..(448): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattangaccttgtctcctggtaccaacngcaccaggacaaacgccccaaatcatcatttangagtcactagcggcctgtagggttctattcgccttctctgctcaaagtctgacaacacgcctcctgacaatctcgtcgggctcgaggcgtaggaggacgaggctagtattattactggctgtctcatactgcagtatggtcaccncgtccggtgttacgtcgggcggtagggacgacggttcgaccggtccgtaggtcacgcccgaggtccgttccgtcccccg

SEQ ID NO: 396692 - DNA, 564 bp, Homo sapiens
  misc_feature: GZ8MTXP01CYGUS.9.53.E09.1.454.CMB.2.raw
  modified_base (301)..(301): a, c, t, g, unknown or other
  modified_base (374)..(374): a, c, t, g, unknown or other
  modified_base (447)..(447): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctctggaccaacagcaccaggcaaacgccccaaactcatcatttangaggtcactaagcggcctcgaggggtttctattcgtccttctctggctcaaagtctgacaaacacggcctccngacaatctcgtgggctcgaggcgtagacggacgagggctagacttattactggactgactcaatatgctaagntggtgactaaccgtcccggtggttaacggttcgggcgggtaacggggaccgaaaagggttcgttaacccgggtctacgggtcgaacggcccaaacgggtccgttaaccgttcccccg

SEQ ID NO: 396693 - DNA, 527 bp, Homo sapiens
  misc_feature: GZ8MTXP01B89BV.9.53.E09.1.454.CMB.2.raw
  modified_base (227)..(227): a, c, t, g, unknown or other
  modified_base (304)..(304): a, c, t, g, unknown or other
  modified_base (380)..(380): a, c, t, g, unknown or other
  modified_base (517)..(517): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcacccaggcaaagcccccaaactcatcatttangagtcactaagcggcctgagggtttctattcgccttctctggctccaaagtctgacaacacggcctcctgacatcnctggctcagctgaggacgaggctgattattactggcttgcttacagtatggctagatggtgacctacgtcccgtggttacgtcgggcgggaagggccaagggttcaccggtctacgggtcaacgtcccgaaggtccncggtcccccg

SEQ ID NO: 396694 - DNA, 572 bp, Homo sapiens
  misc_feature: GZ8MTXP01A9SB0.9.53.E09.1.454.CMB.2.raw
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggggattatgaccttgtctctggtaccaacagcaccaggcaaacgccccaaactcatctatttatgagtcactaagcggcctcgtaggggtttctattcgtcttctcgtggtctccaaagtctgacaacacgaccctcctacgactaaactctcgtcgggctccgaggctggacggacgaggctgaattattactggctgctctatacgtgacgagatgggtatacctacgtcccggttaggttaacggttcgggcggtaacggggaccgaagggttcgttacccggttaaccgtacgggttcaccggcccgaacgggtccgttccggtcccccg

SEQ ID NO: 396695 - DNA, 527 bp, Homo sapiens
  misc_feature: GZ8MTXP01EEPHJ.9.53.E09.1.454.CMB.2.raw
  modified_base (229)..(229): a, c, t, g, unknown or other
  modified_base (305)..(305): a, c, t, g, unknown or other
  modified_base (392)..(392): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggaccaacagcacccaggcaaacgcccccaaatcatcatttangagtacactaacgcggcctctagggtttctattcgccttctctggctccaaagtctgacaacacgcctcctgacatctcgtggctcnggctaggaggacgaggctgattattactggtctgctcatactggcagatggtcactcgtcccgtggttagttcgggacgggtacgggaacaggttcgaccgttctaaggtcacgccgaagtccgttcgtcccccg

SEQ ID NO: 396696 - DNA, 507 bp, Homo sapiens
  misc_feature: GZ8MTXP01EFR1F.9.53.E09.1.454.CMB.2.raw
  modified_base (370)..(370): a, c, t, g, unknown or other
  modified_base (377)..(377): a, c, t, g, unknown or other
  modified_base (432)..(432): a, c, t, g, unknown or other
tcagtgatacgtctcacgaccggtgctcgatttagagagagtgtgttgggtttgggggggtcacagaggcagtgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctctggaccaacagcaccaggcaaacgcccccaaatcatcatttatgaggtcactaagcggcctcgtagggtttctattcgccttctctggctccaaagtctgacaacacgcctccngacatcntggctcaggctgaggacgaggctgattattactggctgctcatatgcagatggtnacactccgtggttacgttcgggcggagggaccaagggttcgaccgtctaggtcacgcccaaggtcttcgtccccg

SEQ ID NO: 396697 - DNA, 531 bp, Homo sapiens
  misc_feature: GZ8MTXP01CD2SX.9.53.E09.1.454.CMB.2.raw
  modified_base (303)..(303): a, c, t, g, unknown or other
  modified_base (421)..(421): a, c, t, g, unknown or other
  modified_base (443)..(443): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggaccaacagcacccaggcaaacgcccccaaatcatcatttangaggtcactaagcggtcctcgtagggtttctagttcgccttctctggctccaaatctgacaacgacgcctcctgacatctctgggctccgaggctagaggacgaggctgattattacnggctgctcatatgcagatgggnacacgtcccgtggttacgttgggcggtagggaccagggttcgacccggtcgtacgggtcacgacccgaacggtccgttccgtcccccg

SEQ ID NO: 396698 - DNA, 561 bp, Homo sapiens
  misc_feature: GZ8MTXP01ESL5J.9.53.E09.1.454.CMB.2.raw
  modified_base (300)..(300): a, c, t, g, unknown or other
tcagtgatacgtctcacgaccggtgctcgatttagagagagtgtggttggggggtcacaagaggcagcgctctcgggacgtctccaccatggcctgggctctgctgctcctcaccctcctcactcaggacacagggtcctgggaaacccagtctgccctgactcagcctgcctccgtgtctgggtctcctggacagtcgatcaccatctcctgcactggaaccagcagtgatggttgggagtatgaccttgtctctggtaccaacagcaccaggacaaacgcccccaaatcatcatttangagtcactagcgccctgtagggttctattcgcttcctctggctccaagtctacgaacaacacggccctccctagacaatctcgtcggactccgagctgaggacgagctagattattactgctgtctacattaatgacgagtagtggtacgacgtaccgttcggtaaggttacggttcgggacgggaacgggaaccggtaacgggttccgttaccgttccgtaacggtccgaacgcccgacggccctcccgttccccgtccg

SEQ ID NO: 396699 - DNA, 522 bp, Homo sapiens
  misc_feature: GZ8MTXP01DC1PT.9.53.E09.1.454.CMB.2.raw
  modified_base (325)..(325): a, c, t, g, unknown or other
  modified_base (435)..(435): a, c, t, g, unknown or other
  modified_base (445)..(445): a, c, t, g, unknown or other
  modified_base (448)..(448): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcaacccaggcaaacgccccaaactcatcatttatgaggtcactaagcggccctnaggggtttctattcgtccttctctgctccaaagtctgacaacacggcctccctgacaatctctgggctccgaggctagacggacgaggctgattattactgctgctcatntgcagatggnacncgtccgtggttacgtcgggcggacggacgaaggttcgaccgtcgtaggtcacgcccaggtccgttcgtcccccg

SEQ ID NO: 396700 - DNA, 493 bp, Homo sapiens
  misc_feature: GZ8MTXP01CN9CB.9.53.E09.1.454.CMB.2.raw
  modified_base (333)..(333): a, c, t, g, unknown or other
  modified_base (370)..(370): a, c, t, g, unknown or other
  modified_base (382)..(382): a, c, t, g, unknown or other
  modified_base (419)..(419): a, c, t, g, unknown or other
  modified_base (422)..(422): a, c, t, g, unknown or other
  modified_base (425)..(425): a, c, t, g, unknown or other
tcagtgatacgtctcacgaccggtgctcgatttagagagagtgtgttgggtttggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggaccaacagcaccaggcaaagccccaaatcatcattatgagtcactaagcgcctgagggtttctatcgccttctntgctccaaagtctgacaacacggcctcctgacatctntcggctcgacgntagaggacgaggctgattattctggctgctcattagnganagngtgtgctcgtcgtcgttgtcggcggacggacgacgttcgacgtcgtcgtcgcgacgacgtcgcgtccg

SEQ ID NO: 396701 - DNA, 548 bp, Homo sapiens
  misc_feature: GZ8MTXP01AZ8K5.9.53.E09.1.454.CMB.2.raw
  modified_base (227)..(227): a, c, t, g, unknown or other
  modified_base (442)..(442): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgacctgactcagcctgcctccgtgtctgggtctcctggacagtcgatcaccatctcctgcactggaaccngcagtgatgttgggattatgaccttgtctctggaccaacagcaccaggcaaacgcccccaaatcatcatttatgaggtcactaagcggcctcgagggtttctattcgcttctctgctcaaagtctgacacacgcctcctgacatctctcgggctccgaggctagacggacgaggtctagaattattactgggctgtctcatagtgcagtatggtnaccgtccgtaacccgttgggttacgttcggggcgggtaacgggaacttaagggttcgacccggttcgtaagggtccacggacccgaagggtccgttccgtcccccg

SEQ ID NO: 396702 - DNA, 512 bp, Homo sapiens
  misc_feature: GZ8MTXP01ENYQZ.9.53.E09.1.454.CMB.2.raw
  modified_base (227)..(227): a, c, t, g, unknown or other
  modified_base (303)..(303): a, c, t, g, unknown or other
  modified_base (428)..(428): a, c, t, g, unknown or other
  modified_base (441)..(441): a, c, t, g, unknown or other
  modified_base (444)..(444): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaacgcccccaaatcatcatttangagtcactaagcgcctgtagggttctattcgccttctctggctccaaagtctgacaacacgcctcctgacaatctctgggctccaggctaggaggacgaggctgtattattactggctgctcatntgcagatgggtanacncgtccgtggttcgttcgggcggagggaccaaggttcgaccgtccaggtcacgccaggccttcgccccg

SEQ ID NO: 396703 - DNA, 568 bp, Homo sapiens
  misc_feature: GZ8MTXP01BNWWZ.9.53.E09.1.454.CMB.2.raw
  modified_base (226)..(226): a, c, t, g, unknown or other
  modified_base (298)..(298): a, c, t, g, unknown or other
  modified_base (384)..(384): a, c, t, g, unknown or other
  modified_base (415)..(415): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcacatctcctgcactggaaccngcagtgattggtgggattatgtacttgtctctgtacaacagcaccaggcaaacgccccaaatcatcattacngagtcactaagcgtcctgtagggtttctattcgccttctctgctcaaagtctgacaacacgcctcctgacatctcgtggctcgagngtagagacgagctgattatactggctgcctnatatgacgtagtaagtggttacgaccgtaaccgttccccgggttaggttaacggtttccgggacggggtaaacgggaaccccgttaaggggttcgacccggttaaccgtacgggtaacaccggacccgttaacgggccttccggtccccccgg

SEQ ID NO: 396704 - DNA, 591 bp, Homo sapiens
  misc_feature: GZ8MTXP01ED2FC.9.53.E09.1.454.CMB.2.raw
  modified_base (284)..(284): a, c, t, g, unknown or other
  modified_base (575)..(576): a, c, t, g, unknown or other
  modified_base (578)..(591): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaaagaaccagatctccctgaagctgacctctgtgaccgccgcggacacggccgtgtattactgtgcgagacgttacccaaatanagcaacagctggtactatttcctttgatagtggtgggggaccaaagggacaagtcggtccaccgtctcttcagccctccaaccccaacgggccagtccggtcccttccccccgtggcccgccctgcctacccgagggacgcacccgtcccgagacgaccacgacggcccgggtcccgttcggggccttcggcccgttcggtaaccaaacgggtacccttaaccgttcccgaagtacgttactcgaaccgtggacggcggggcgtcgggacgaacgggcgaacgagttaggnngnnnnnnnnnnnnnn

SEQ ID NO: 396705 - DNA, 525 bp, Homo sapiens
  misc_feature: GZ8MTXP01ENQ0S.9.53.E09.1.454.CMB.2.raw
  modified_base (227)..(227): a, c, t, g, unknown or other
  modified_base (246)..(246): a, c, t, g, unknown or other
  modified_base (304)..(304): a, c, t, g, unknown or other
  modified_base (323)..(323): a, c, t, g, unknown or other
  modified_base (433)..(433): a, c, t, g, unknown or other
  modified_base (437)..(437): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattangtaccttgtctcctggtaccaacagcacccaggcaaacgcccccaaatcatcatttangaggtcactaagcgccctnagggtttcattcgccttctctggctccaaagtctgacaacacgcctccctagacaatctctgggctccgaggctgaggcgagctgattattacctggtctgctcatatgnaagntggtcaactcgtcccgtggttacgttcgggcggacggggacagggttcgaccgtccgtaggtcacgcccgaaggtccttcgtcccccg

SEQ ID NO: 396706 - DNA, 527 bp, Homo sapiens
  misc_feature: GZ8MTXP01DSZU5.9.53.E09.1.454.CMB.2.raw
  modified_base (377)..(377): a, c, t, g, unknown or other
  modified_base (518)..(518): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcaacccaggacaaacgcccccaaatcatcatttatgaggtcactaagcggcctgagggtttctattcgtccttctctggctcaaagtctgacaacacggcctccngacatctctggctcaggctgagacgaggctgattatactggctgctcatatgacagtatggtacgtacaccgttcccggtgttagttccgggcgggtaagggcccaagggttcgaccgtcgtaggtcacgccgaaggtccncgtcccccg

SEQ ID NO: 396707 - DNA, 565 bp, Homo sapiens
  misc_feature: GZ8MTXP01CJ7OC.9.53.E09.1.454.CMB.2.raw
  modified_base (304)..(304): a, c, t, g, unknown or other
  modified_base (343)..(343): a, c, t, g, unknown or other
  modified_base (447)..(447): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttggggattatgaccttgtctcctaggaccaacagcacccaggcaaacgccccaaatcatcatttangagtcactaagcggcctgtagggtttctattcgctttcnctgctcaaagtctgacaacaccggcctcccagacactctcgtacgggctcgaggctaggaggtacgaggctagtattattactgggctgctcagtatgcgtaangtggtacgactaccgtccgttggttacgttcgggcgggtaaacgggtacgttaaacggttcggacccggttaactacgggtccgaacggccccgaagggtcccttccggttccccccg

SEQ ID NO: 396708 - DNA, 507 bp, Homo sapiens
  misc_feature: GZ8MTXP01C5NV3.9.53.E09.1.454.CMB.2.raw
  modified_base (319)..(319): a, c, t, g, unknown or other
  modified_base (430)..(430): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgccccaaatcatcatttatgagtcactaagcgcctnagggtttctattcgcttctctgctccaaagtctgacaacacggcctcctgacatctctggctcaggctagagacgaggctgattatactggctgctcatatgcagatggtnactactccgtggttagttcggcggagggaccgaaggttcgaccgtcgtaggtcacgcccgaaggtcttcgtcccccg

SEQ ID NO: 396709 - DNA, 545 bp, Homo sapiens
  misc_feature: GZ8MTXP01DS9V1.9.53.E09.1.454.CMB.2.raw
  modified_base (459)..(459): a, c, t, g, unknown or other
  modified_base (462)..(462): a, c, t, g, unknown or other
  modified_base (500)..(500): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttggagttatgacttgtctcctaggtaccaacagccacccaggacaaacgtcccccaaactcatctactttatgagtcaactaacgccggccctcgtaggggtttcttacttccgtcttctcgtcggcttaccgaagtctagaacacaccggcctcctagactaatctcgtcggctccgaggctagaggacgagctagattacgttatgctgctcatntgntagtagtggtcgaactaccgttccggtgttagtcgggnggacggccgaggtcgtaccgtcgtagacacggccgaacggtcccg

SEQ ID NO: 396710 - DNA, 535 bp, Homo sapiens
  misc_feature: GZ8MTXP01CTO6G.9.53.E09.1.454.CMB.2.raw
  modified_base (261)..(261): a, c, t, g, unknown or other
  modified_base (263)..(263): a, c, t, g, unknown or other
  modified_base (295)..(295): a, c, t, g, unknown or other
  modified_base (440)..(440): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgtgggattatgacttgtctctgacanancaccaggcaaacgccccaaactcatcatttangaggtcactaagcgcctcgtagggtttctattcgtccttctctgctcaaagtctgacaacacggccctcctgacaatctcgtcgggcctccaggaccgtagagggacgaggctagtattattacgtggtcttgctcgatatcganagtatggtcacacgtcccgtggttacgttcggcggaacgggccaaaggttcgaccgtcgtagggtccaacgcccgaacggtccgttcgtcccccg

SEQ ID NO: 396711 - DNA, 528 bp, Homo sapiens
  misc_feature: GZ8MTXP01EZLL8.9.53.E09.1.454.CMB.2.raw
  modified_base (303)..(303): a, c, t, g, unknown or other
  modified_base (388)..(388): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggcaaacgcccccaaatcatcatttangaggtcactaaagcggccctcgtaggggtttctattcgcctttctctggctcaaagtctgacaacacggcctcctgacaatctcngggctccaggctgaggacgaggctgaattagttactggggctgctcatatgcagagtgtgactactccgtgttagttcggcggagggaacaagggttcaccggtctaggtccacgacccgaagggtccttccgtcccccg

SEQ ID NO: 396712 - DNA, 634 bp, Homo sapiens
  misc_feature: GZ8MTXP01DEQ34.9.53.E09.1.454.CMB.2.raw
  modified_base (226)..(226): a, c, t, g, unknown or other
  modified_base (288)..(288): a, c, t, g, unknown or other
  modified_base (298)..(298): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtcgtgggtctcctggacagtcatcaccatctcctgcactggaaccngcagtgattggttgggattatgacttgtctctagaccaacagcaccagacaaacgccccaancatctattangagtcatagcgcctgaggttctatcgtccttctcgtggtcctcaaaagtctcgaacaacgccggtcctcctagaacaacttccgtcgtcgggctaccgaggtcgtaggaacgggacggacggtcttagtaactttaattacgtcgggtcttacggtccttaacaattacgttcgacgtaaaggtacgtcggtacgtaacccgtaacggtttcccgtaagggttaccgttccgggggacgggttaaaccggggaaccgttaacgggttcggttaccccgttcggtaacggttcccgacggaccccgaacgggttcccgttaaccccggtccccccgg

SEQ ID NO: 396713 - DNA, 532 bp, Homo sapiens
  misc_feature: GZ8MTXP01EDR58.9.53.E09.1.454.CMB.2.raw
  modified_base (242)..(242): a, c, t, g, unknown or other
  modified_base (301)..(301): a, c, t, g, unknown or other
tcagtgatacgtctcacgaccggtgctcgatttagagagagtgtgtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattangaccttgtctcctggtaccaacagcacccaggacaaacgcccccaaactcatcatttangaggtacactaagccgccctgtagggtttctattcgcttcctctggctcaagtctagaacaaacaccggccctcctgacaatctctggctccgaggctaggaaggacgaggctgtattatactgctgtctcatatgcagtactggtgactacgtcccgtggtacgttcgggcggaggacgaaggttcgcgttccgtaagggcaacggcccgaggcctaaccggccccgtcg

SEQ ID NO: 396714 - DNA, 558 bp, Homo sapiens
  misc_feature: GZ8MTXP01A6NE3.9.53.E09.1.454.CMB.2.raw
  modified_base (314)..(314): a, c, t, g, unknown or other
  modified_base (461)..(461): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgtaccttgtctcctggtaccaacagccacccaggaccaaacgcccccaaactcatcatttangaggtcactaagcgccctgtaggggtttctacttcgcttctctggctcaagtctgaacacacggtacctccctagacctaatctcgtcgggcctccgaggctggacgggacgaggctagtatttattacgtggtctgtctcattagngacgtagtagtcggtggaactaccgttccggtgggttagttccggggacgggacgggttacgagggtcgaccgtcgtaggcgacgccgaaggtcccg

SEQ ID NO: 396715 - DNA, 602 bp, Homo sapiens
  misc_feature: GZ8MTXP01BFT76.9.53.E09.1.454.CMB.2.raw
  modified_base (227)..(227): a, c, t, g, unknown or other
  modified_base (365)..(365): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggaccaacagcacccaggcaaacgcccccaaatcatcatttatgagtcactaagcggcctcgtagggtttctattcgtccttctctggctccaaagtctgacaacnccggcctccctgacaatctcgtgggctccaggctaggaggacgaggctgtattattactgggcttgctcatagtgcagtagtggtacgaccgtacgttccccggttgggttaacgtttccggggacggggaacgggggtaacccgttaaaggggttccggttaacccggttaacccggttacgggttccgaaccggtaccccggaaacggggtcccgttcccgggtccccccccggg

SEQ ID NO: 396716 - DNA, 558 bp, Homo sapiens
  misc_feature: GZ8MTXP01BKKAD.9.53.E09.1.454.CMB.2.raw
  modified_base (229)..(229): a, c, t, g, unknown or other
  modified_base (268)..(268): a, c, t, g, unknown or other
  modified_base (302)..(302): a, c, t, g, unknown or other
  modified_base (442)..(442): a, c, t, g, unknown or other
tcagtgatacgtctcacgaccggtgctcgatttagagagagtgtgttgggtttgggggctggtgtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccatcctctgcatggaaccngcagtgattgtggagttatgacttgctctggtaccaacngcacccaggcaaacgcccccaaatcatcatttangagtcactaagccgcctgtaggggtttcctattcgcttctctcgctcaatctgacaacgacggcctccctgactaatctcgtgggctaccgaggtctggacggacgagggctaggtagtttattacgtgcgttgcccttnattaactgacctagtacgtggtcgtaaaccgttccgttcccggttggttaacgttcgggacgggcgggaccgtaagggtcgaaccgttcgtacggttaccaacgcccgtaaccggg

SEQ ID NO: 396717 - DNA, 535 bp, Homo sapiens
  misc_feature: GZ8MTXP01C9LWK.9.53.E09.1.454.CMB.2.raw
  modified_base (309)..(309): a, c, t, g, unknown or other
  modified_base (429)..(429): a, c, t, g, unknown or other
  modified_base (436)..(436): a, c, t, g, unknown or other
  modified_base (457)..(457): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttagggattatgtaccttgtctcctggtaccaacacgcaacccgaggaccaaacgccccaaactcatcattangagtcactaagcggcctgtaggtttcattcgcttctctgctccaaagtctgacaacgaccgccctccccgaatactctcgtggctaccgagctggaacggtacgaggtctagattatacngctgctnagtatgctagagtgtcgaacnccgttccggtggttacttcggggacggacggtaaccagggttcgcgttcgtaagcgaacgccaggcctccgcccctcg

SEQ ID NO: 396718 - DNA, 543 bp, Homo sapiens
  misc_feature: GZ8MTXP01B0851.9.53.E09.1.454.CMB.2.raw
  modified_base (270)..(270): a, c, t, g, unknown or other
  modified_base (302)..(302): a, c, t, g, unknown or other
  modified_base (343)..(343): a, c, t, g, unknown or other
  modified_base (454)..(454): a, c, t, g, unknown or other
  modified_base (487)..(487): a, c, t, g, unknown or other
  modified_base (515)..(515): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattatgaccttgtctcctggaccaacngcaccaggcaaacgccccaaatcatcatttanagagtcactaagcggcctgtagggtttctattcgtcttctntcggctccaaaagtctgacaacgaccgcctccctgacaactctcgtcgggctccgaggcgtaggaggtacgaggctagtattattactggctgtctactatatggctaagngtggtgacctacgtcccggtggttacgttcggnggtacgggacacgggttgacccgttcgnggtccacgccacggtccgttcgtccccg

SEQ ID NO: 396719 - DNA, 572 bp, Homo sapiens
  misc_feature: GZ8MTXP01DXD4Y.9.53.E09.1.454.CMB.2.raw
  modified_base (316)..(316): a, c, t, g, unknown or other
  modified_base (429)..(429): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgagtggttgggagttatgtaccttgtctcctggtaccaacagccacccaggaccaaacgacccccaaatcatctatttangaggtcaacgtaacgccggccctgtaggggtttctacttcgcttctctcggaccttacaaggtctagaaccacaccggcctacctgacatcacgtggctcgagctagagacgngctgaattatactgctgcctatatagtgactagagtggtcgaacctcgttcccggttgggttaccgttcggggcgggaagggccgttaaaggggtccgtaaccggtccgttaacggggccttagggaaccccaagggtccccg

SEQ ID NO: 396720 - DNA, 498 bp, Homo sapiens
  misc_feature: GZ8MTXP01EIJB1.9.53.E09.1.454.CMB.2.raw
  modified_base (281)..(281): a, c, t, g, unknown or other
  modified_base (408)..(408): a, c, t, g, unknown or other
  modified_base (423)..(423): a, c, t, g, unknown or other
  modified_base (491)..(491): a, c, t, g, unknown or other
  modified_base (493)..(498): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtattttagcagtgggacaccaactacagcccctcctcaagagtcgagtcaccatgtcagtagacacgtccaaagaaccagatctcctgaagctgacctctgtgaccgccgcggacacggccgtgtattactgtgcgagacgttacccaaaatanagcaacagctggtactatttctttgatatgtgggggaccaaagggacaatggtacaccgtctcttcagcctccaacccgaacgggccagtccggtccttccccctggcccgccctgcctccagggcncacctcgagagcacngcggccctgggctcgcctggacaaaggctacttccagaccgtatcactgagcgggctggcaaggcaanannnnnn

SEQ ID NO: 396721 - DNA, 613 bp, Homo sapiens
  misc_feature: GZ8MTXP01CCYAB.9.53.E09.1.454.CMB.2.raw
  modified_base (222)..(222): a, c, t, g, unknown or other
  modified_base (261)..(261): a, c, t, g, unknown or other
  modified_base (263)..(263): a, c, t, g, unknown or other
  modified_base (298)..(298): a, c, t, g, unknown or other
tcagtgatacgtctcacgaccggtgctcgatttagagagagtgtgtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgacttgtctcgtagtaccanancaccgagacaaaccgccccaaatcatctatttagngacgtacacgtagcccggtcctgtacgggtttctacgttcgtcttccgtcgtcggtcctacctaaggtcctacggaaccaaccgtacccgggtcccctcgtagaacctactcctcgtcggtccacgaggtcgtagggacggacgaggtctagtactttaacttcgcgtactcgtacttactagtagtcgatagtacgtggtacgacctacggtcccggtggtacgttcggggacgggttaacggtaccgtaagggttccgttccgttaacgtgggccgaacgcccggagttcccgtcccggttccccgttaacgg

SEQ ID NO: 396722 - DNA, 526 bp, Homo sapiens
  misc_feature: GZ8MTXP01EZNFY.9.53.E09.1.454.CMB.2.raw
  modified_base (226)..(226): a, c, t, g, unknown or other
  modified_base (304)..(304): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttggggattatgaccttgtctcctggtaccaacagcacccaggcaaacgcccccaaactcatcatttangaggtcactaagcggcctcaggggtttctattcgccttctctggctcaaagtctgacaacaccggcctccctagacaatctctgggctcgaggctaggaggacgaggctgattattactggctgctcatatgcagacgtggtgacacgtcccgtggttagttcgggcggagggaccaagggttcgaccgtctaggtccaggcccaggtccgttcgtcccccg

SEQ ID NO: 396723 - DNA, 654 bp, Homo sapiens
  misc_feature: GZ8MTXP01CT133.9.53.E09.1.454.CMB.2.raw
  modified_base (372)..(372): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcagtgtacagggtcctgggcccagtccgcctgactcagcctgccgccgtgtccgggtctcctggacagtcgatcaccatctcgtgcactggaaacgaatagcgacagttgggtgctctaatcatgtctcctggtactataacagtcaaggacaaacgacccccaaatcaataatttatgatgtactttagacgccctgaggtatttcttctcggttgtcctggctcgaagtcgtagggaaccncggccctcctcgaccatctctggtacttcacgcctaggacggacggagggttagtactttaacttctaggtctaaggttcaagggtacttacgtaaacgtaaaccctttccccgttggttggggttcggtttaccgggggcggtaacggggtacctacgtcggtaaccgttcggttaacccggttcccgttggtaaccgttcgaaccggccccgaaacgggtcccgtaccccggtcccccgttacgggtcccttaccttcccgttcccgggtttcccccccg

SEQ ID NO: 396724 - DNA, 573 bp, Homo sapiens
  misc_feature: GZ8MTXP01COYW7.9.53.E09.1.454.CMB.2.raw
  modified_base (282)..(282): a, c, t, g, unknown or other
  modified_base (395)..(395): a, c, t, g, unknown or other
  modified_base (557)..(558): a, c, t, g, unknown or other
  modified_base (560)..(573): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaaagaaccagatctccctgaagctgacctctgtgaccgccgcggacacggccgtgtattactgtgcgagacgttcccaaatnagcaacagctggtacatttcctttgatatggtggggaccaaagggacaagtggtccaccgtctcttcacgccctccaaccccgaacgggccagtcccggtcccttccccccgnggcccgccctgccctcccgaggacgccaccctccgagacgcacacgcccggcccgtgggctcgccgtcggtaccaaaggtaccttacgttacccgaaggtaccgttagtaccaccgtggacggtccggggccgtagggcccgaaagggccggaacgtagagnngnnnnnnnnnnnnnn

SEQ ID NO: 396725 - DNA, 551 bp, Homo sapiens
  misc_feature: GZ8MTXP01B3BBW.9.53.E09.1.454.CMB.2.raw
  modified_base (221)..(221): a, c, t, g, unknown or other
tcagtgatacgtctcacgaccggtgctcgatttagagagagtgtgttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgacttgtctctggtaccaacagcaccaggacaaacgcccccaaactcatctatttatgaggtcactaagccggccctcgtagggtttctattcgcttcctctggctccaagtctgaaccaacgaccggccctccagacaatctcgtggctcgagctgaggacgaggctgtattattactgtcgtgctacattatcgcagtagtggtgacctccgtcccggtaaggtcgttcgggacggttacgggaaccgaagggttcgacccgttcgtaaggtccaacggtacccgaaggttccgtccgccccgttcgg

SEQ ID NO: 396726 - DNA, 582 bp, Homo sapiens
  misc_feature: GZ8MTXP01BXEL8.9.53.E09.1.454.CMB.2.raw
  modified_base (229)..(229): a, c, t, g, unknown or other
  modified_base (308)..(308): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcacccaggacaaacgacccccaaatcatcatttangagtcactaagcggtcctcgtagggtttctagttcgtccttctctggcctcctaaagtctgacaacgacggcctcctgactatctcgtcggctcgaggctaggaggacgaggctgtattattactgggctgctacatagtgcaagtagtcgggtataccgtccgtcccggttggttacggttccggggcggggtaaacgggaccgttaaagggttcggaacccgtccggtacggtccacggacccgttaacgggtccgttcccggtccccccgg

SEQ ID NO: 396727 - DNA, 558 bp, Homo sapiens
  misc_feature: GZ8MTXP01AIO4T.9.53.E09.1.454.CMB.2.raw
  modified_base (343)..(343): a, c, t, g, unknown or other
  modified_base (382)..(382): a, c, t, g, unknown or other
  modified_base (419)..(419): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcacccaggcaaagcccccaaactcatcatttatgaggtcactaagcgcctgaggggtttctattcgnttctctggctcaagtctgacacacgcctcctgacaatcnctgggctcaggctgaggacgaggctgtattacttacngtctgctcatatgctagtatgggtcgaactacttcccgggtaggttacgtttccggggacgggttacggggaacccgttaaggggttccggacccgttcccggttaacggtccgaccggtaaccccgaacgggtccccg

SEQ ID NO: 396728 - DNA, 737 bp, Homo sapiens
  misc_feature: GZ8MTXP01CXPDN.9.53.E09.1.454.CMB.2.raw
  modified_base (226)..(226): a, c, t, g, unknown or other
  modified_base (269)..(269): a, c, t, g, unknown or other
  modified_base (300)..(300): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcatcaccatcctcctgcactggaaccngcagtgtatggttagggattatgaccttgtctcctgaccaacngcaccagacaaacgccccaaatcatcattangagtacactagcggcctgtaggtttctagttcgtccttctctggtacctaccgtaaaacgttctaacgaaaccaaaccgtaccgggactaaccgtccccgttagaaacctaacttccgttacgtcggggtccttacccgaggggtacccgttagggaacgggtaacccggagggtacctttaaggtaactttttaacgtttaaccgggttcggtccctttaggtacccttacctaaagttagtacggtaccgtaaaggttcggttacgggtacgtaaccccgttaaccccggttcccgggtttagggttaaccggttaccgggggaccgggggtaaacggaaaccccggttaggggttaccggtaacccccgggttaaccgttaacggggtccgaacccgggttaccccgtaaccggttccccgttaaccccccggg

SEQ ID NO: 396729 - DNA, 535 bp, Homo sapiens
  misc_feature: GZ8MTXP01C6IV0.9.53.E09.1.454.CMB.2.raw
  modified_base (227)..(227): a, c, t, g, unknown or other
  modified_base (304)..(304): a, c, t, g, unknown or other
  modified_base (373)..(373): a, c, t, g, unknown or other
  modified_base (433)..(433): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttggggattatgaccttgtctctggaccaacagcaacccaggacaaacgccccaaatcatcatttangagtcactaagccggcctgtagggtttctattcgtccttctctgctcaaagtctgacaacacgcctccngacatctcgtggctcgaggctaggacggacgaggctagtattatactggtctgctacatntgcagagtggtcgacctcgtccggtggttagttcgggcgggtagggaccaaggttcgacccgtcgtaacggtccgacgcccgaacggtccgttccgtccccg

SEQ ID NO: 396730 - DNA, 559 bp, Homo sapiens
  misc_feature: GZ8MTXP01EKYF0.9.53.E09.1.454.CMB.2.raw
  modified_base (231)..(231): a, c, t, g, unknown or other
  modified_base (384)..(384): a, c, t, g, unknown or other
  modified_base (392)..(392): a, c, t, g, unknown or other
  modified_base (441)..(441): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggagttatgaccttgtctcctggtaccaacagcacccaggacaaacgccccaaactcatcatttatgaggtcaacgtaagcggccctgtaggggtttctacttcgtcttctctgctccaagtctgacacaccgcctcctnacatctcngggctcgaggctgaggacgagctgtatttagtactgctgtctcattagngactagtagtggtacgaacctaccgttccggttggttacggtcggggacgggttaacgggaccgttaacgggtccgtaccgtccgtacggtaccgaccgtaacccgttaacggtcccg

SEQ ID NO: 396731 - DNA, 571 bp, Homo sapiens
  misc_feature: GZ8MTXP01BO8OZ.9.53.E09.1.454.CMB.2.raw
  modified_base (300)..(300): a, c, t, g, unknown or other
  modified_base (443)..(443): a, c, t, g, unknown or other
tcagtgatacgtctcacgaccggtgctcgatttagagagagtgtggttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccagcagtgattggttgggattatgtaccttgtctctggtaccaacagcaccaggacaaacgccccaaatcatcatttangagtacactaacgcgcctcgtagggtttctagttcgcttcctctggcctcaagtctagaacaacgccgcctcctagacaatcctcgtcgggctccgaggctaggacggacgagtctagtattattacgtgtcgtgctcaagtntgcagtatggtcacgtaccgtcccggtaaggtaacgttcggggacggacggggtaaccgtaagggttccgttacccggttcgtaacggccgaacgccccgaggccctaaccggttcccccgttaacgg

SEQ ID NO: 396732 - DNA, 617 bp, Homo sapiens
  misc_feature: GZ8MTXP01CWPMX.9.53.E09.1.454.CMB.2.raw
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcatggaaccagcagtgatgttgggattatgacttgtctcctggaccaacacgcaccaggacaaacgccccaaactcatactattatgaggtcacgtaacgcggtccgtcgtagggtttctattcgtccttctcgtggtcctaccgaaagttctcgaaccaacgaccggtccctccctacgaacaactcctcgtcgggctaccgaggacgtaggacggacgacgggctagattattacgtggtctgtactacgtatgtgacgtagacgttggtacgtaccgtaccgtcccggttagggttagttaccgggggacgggaaacggggtaccgttaaacggggttcggttaacccgtcccgtaaggtccgaacggacccgaacggggtcccttccggtcccccg

SEQ ID NO: 396733 - DNA, 623 bp, Homo sapiens
  misc_feature: GZ8MTXP01EJEL7.9.53.E09.1.454.CMB.2.raw
  modified_base (266)..(266): a, c, t, g, unknown or other
  modified_base (306)..(306): a, c, t, g, unknown or other
  modified_base (497)..(497): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccatctcctgcactggaaccagcagtgatgttgggattatgacttgtctcctgaccaanacgcaaccgaggaccaaacgcccccaaatcatctatttangaggtacactaacgccggacctgtagggtttctagttcgtccttcctcgtggtcctacctaaaggttcctcggaaaccaaaccgacccgggtcccctacccgtagaactaacttcgtccgtcgggcctaccgaggtccgtaggacggaccgagggtctagtaattattactgggtctgcttacatactganagtagtgggtacaccgtaccgttcccggttggttacgttccggggaggtaacggggaaccgttaggggttcgttaccccggttcgtaggtaaccgacggcccgaaggtcccgttccggtccccccg

SEQ ID NO: 396734 - DNA, 627 bp, Homo sapiens
  misc_feature: GZ8MTXP01EGADZ.9.53.E09.1.454.CMB.2.raw
  modified_base (310)..(310): a, c, t, g, unknown or other
tcagtgatacgtctcacgaccggtgctcgatttagagagagtgtgttggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcacctatctcctgcactggaaccagcagtgagttggttagggattatcgaccttgtctcgtacggtaccaacagccaccgagaccaaaccgcccccaaatcatctatttagngagtcatacgcggtcctgtaggtttctagtcgtcttccgtcgtggtcctactaacgtctagaaccacgtcccgccctaccgagaacattccgtcgtcggctaccgaggtcgtaggaaacgggcgtaaggcttagaatttacgtactgtcggtatcctataattagccgtagaaggtcgttacggtcgtaaaccccgtccggttcccgggtaagggtttaacggcggggaacgggttaaccgggtacgtaaacgggttccgttcccgttacgtaacggccgaacgtacccgagttccccgtcccgttccccgttaacg

SEQ ID NO: 396735 - DNA, 562 bp, Homo sapiens
  misc_feature: GZ8MTXP01BSC1I.9.53.E09.1.454.CMB.2.raw
  modified_base (298)..(298): a, c, t, g, unknown or other
  modified_base (375)..(375): a, c, t, g, unknown or other
tcagtgatacgtctcacgaccggtgctcgatttagagagagtgtgttgggggggtcacaagaggcagcgctctcgggacttctccaccatggcctgggctctgctgctcctcaccctcctcactcaggacacagggtcctgggcccagtctgccctgactcagcctgcctccgtgtctgggtctcctggacagtcatcaccatctcctgcactggaaccagcagtgatggttgggattatgaccttgtctcctggtaccaacagcacccaggcaaacgcccccaaactcatcatttangagtcactaagccggccctcgtagggtttctattcgcttcctcgtgctcagtctgaacaacacgcctcctgacatcncgtggcctcgaggctggacggacggaggtcgtagttatttaacttacgtgtctcgtactctattaacgtcgagtagtaggtggtcgaccctaccgttcccgggtggttaacggttcggggacgggttacgggaaccgaggttcggccgttcgtaacggtcaacgcccgagggcctccgccccgtccg

SEQ ID NO: 396736 - DNA, 635 bp, Homo sapiens
  misc_feature: GZ8MTXP01CNVGD.9.53.E09.1.454.CMB.2.raw
  modified_base (209)..(209): a, c, t, g, unknown or other
  modified_base (315)..(315): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccntctcctgcactggaaccagcagtgagttggttgggatttatgtacctttgtctcccgtaggaaccaacagcaacccaggaccaaacgcccccaaatcatcatttangaggtcactaagcgcctgtacgggtttctattccgtccttctcgtggcctaccgtaaaagttctaagaaccaaaccgaccgggtccctaccctaggaacctaacttccgttcgtcggggtcctaccgaacggggtcttagggaacgggaccgaagggtccttagtaactttacttaccgtgggtcttacggcttacgattaacgtgactagtatgggtacgtaactcccggtcccggttaggttacggttccggggacgggtaaggggacttagggttcgaccgttccgaggtcacggtccgaggtccgttcgtcccccg

SEQ ID NO: 396737 - DNA, 540 bp, Homo sapiens
  misc_feature: GZ8MTXP01ERE3W.9.53.E09.1.454.CMB.2.raw
  modified_base (227)..(227): a, c, t, g, unknown or other
  modified_base (297)..(297): a, c, t, g, unknown or other
  modified_base (442)..(442): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgacttgtctctggacaacagcaccaggcaaacgccccaaatcatcatttangagtcacgtaacgcggcctgtaggggtttctattcgccttctctgctacaaagtctgacaacacggcctccctagactaatctctgggctcgaggctaggaggacgagggctagtaattattactggtctgtctactatagtganaagtgtggtacgacctacggtccgttaggttacgttcgggacgggacgggacgaaggttcgaccgtcgtacggcacgccgaagtccgttccgtccccg

SEQ ID NO: 396738 - DNA, 519 bp, Homo sapiens
  misc_feature: GZ8MTXP01DKNRQ.9.53.E09.1.454.CMB.2.raw
  modified_base (310)..(310): a, c, t, g, unknown or other
  modified_base (477)..(477): a, c, t, g, unknown or other
tcagtgatacgtctcacgaccggtgctcgatttagagagagtgtgttggctttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggacaaacgcccccaaactcatcatttangaggtcactaagcgcctgaggggtttcctattcgcttctctggctccaagtctagacaacacggcctccctgacaatctctgggctccgaggctggaggacgagctgatttattacgtgctgctcatatgtcgtagttcgttccttctttacagtattagttcgggnggacgggcagggtctacgccgtccgtgacgtcgcgaaccccg

SEQ ID NO: 396739 - DNA, 579 bp, Homo sapiens
  misc_feature: GZ8MTXP01DVDXU.9.53.E09.1.454.CMB.2.raw
  modified_base (439)..(439): a, c, t, g, unknown or other
  modified_base (459)..(459): a, c, t, g, unknown or other
tcagtgatacgtctcacgaccggtgctcgatttagagagagtgtgttgggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgtaccttgtctcctggtaccaacagcacccaggaccaaaacgcccccaaatcatcatttatgagtcactaagccggcctgtagggtttctagttcgtccttctctcggctccgaaaagtctgacaacgacgcctccctagacaatctcgtgggctccgaggtctaggacggacgaggctagtaattattacngggtctgtcctagtatagtnagtaagagttggtacgacctacccggttccggtggttacggttccgggacgggaacgggtaaccgttaagggttcgacccgtcgtaacggtcgacgacccgagggtccttccgtcccccg

SEQ ID NO: 396740 - DNA, 608 bp, Homo sapiens
  misc_feature: GZ8MTXP01CFT74.9.53.E09.1.454.CMB.2.raw
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactggaaccagcagtgagtggttgggattatgaccttgtctcctggtaccaacagcacccaggaccaaacgcccccaaactcatactatttactgaggtacaacgtaacgccggtccctacgtagggggttttctacgtttcgtccctttctcttcggctacccgtaaaagttccttcggaacaaaccgaccgggtcccctaccctagaactaactcttccgttcgggacctccgaggtcctaggacgggacgaggctagtattattactggtctagctacatagtgcagtatgggtacacctacgtcccggtggttacgttcgggcggaacggaccgaagggttcgaccggtccgtaggccacgcccgaagtcccgttaaccgtcccccgg

SEQ ID NO: 396741 - DNA, 516 bp, Homo sapiens
  misc_feature: GZ8MTXP01BEVLU.9.53.E09.1.454.CMB.2.raw
  modified_base (239)..(239): a, c, t, g, unknown or other
  modified_base (295)..(295): a, c, t, g, unknown or other
  modified_base (351)..(351): a, c, t, g, unknown or other
tcagtgatacgtctcacgaccggtgctcgatttagagagagtgtggtttggggggtcacaagaggcagcgctctcgggacgtctccaccatggcctgggctctgctgctcctcaccctcctcactcaggacacagggtcctggacccagtctgccctgactcagcctgcctcgtgtctgggtctcctggacagtcgatcaccatctcctgcactggaaccagcagtgatggtggattangacttgtctctggtacaacagcaccaggacaaacgacccccaaatcatctatttangagtcactaagcgcctgaggtttctattcgcttctctggctcaagtctagctaacncggccctcctgactaatctctgggctcgagctgaggacgagcgtgtattatacgtgctgtctcatagtcgacagtagtgtgacctacgtccgtggtacgttcgggagggacggaccgaaggttcgccgttcgtaaggcgaagcccgaaggcctccgcccgtccgg

SEQ ID NO: 396742 - DNA, 538 bp, Homo sapiens
  misc_feature: GZ8MTXP01E0RHU.9.53.E09.1.454.CMB.2.raw
  modified_base (303)..(303): a, c, t, g, unknown or other
  modified_base (320)..(320): a, c, t, g, unknown or other
  modified_base (425)..(425): a, c, t, g, unknown or other
  modified_base (439)..(439): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggggattatgaccttgtctcctggtaccaacagcacccaggcaaagcccccaaatcatcatttangaggtcactagcgcctnaggggtttcattcgccttctctggctccaaagtctgacaacacggcctcctagacaatctcgtgggctcaggctaggacggacagggctgtattatactggctcnctcatgtgacgagngtggtacgaccgcgtccggtgttacggtcgggacggacgggtaaccagggttcgacccggttcgacggtccgacgacccgacggtcccttcccgccccg

SEQ ID NO: 396743 - DNA, 797 bp, Homo sapiens
  misc_feature: GZ8MTXP01CKT6M.9.53.E09.1.454.CMB.2.raw
  modified_base (224)..(224): a, c, t, g, unknown or other
  modified_base (305)..(305): a, c, t, g, unknown or other
tcagtgatacgtctcacgaccggtgctcgatttagagagagtgtgttgggtttggggggggtcacagaggcagcgctctcgggactctccaccatggcctgggctctgctgctcctcaccctcctcactcaggacacagggtcctgggcccagtctgccctgactcagcctgcctcgtgtctgggtctcctggacagtcatcaccatctcctgcactggaaccngcagtgatgttgggattatgaccttgtctcctggtaccaacacgcaacccaggccaaaacgccccaaactcatctatttangaggtcacgtaacgccggtcctgtaggggtttctagttcgtcccttctcgtcggtcctacctaaaacggttccttaacgaaccaaaccgtaacccgggtccccttaccccgtacggaacctaaacttcccgtcgttcggggcccttaccggaacgggtcgttaacgggaacggggaaccggtaacggggtaccttacgggttaaattttaacgtttaacccggttagggggtacctttacgggtcctttactaaacgtttaagtcggtacctaaacgggttagtttaccggggtacgtaaacccgttcccggtttaacccccgggtttaggggttaccgggttttaccgggggaccgggggttaaacggggtaaccccgttaaagggggttcccggttaccccgggtttaaccggttaaccggggttcccgtaaacccggggtacccccgaaacggggttcccccgttaaccccggggtttccccccccggg

SEQ ID NO: 396744 - DNA, 556 bp, Homo sapiens
  misc_feature: GZ8MTXP01BYE01.9.53.E09.1.454.CMB.2.raw
  modified_base (227)..(227): a, c, t, g, unknown or other
  modified_base (301)..(301): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgacttgtctctggtaccaacagcaccaggcaaacgcccccaaactcatcatttangagtcactaagcggcctcgtagggtttctattcgcttctctggctcaaagtctgacaacacggcctcctgactactctctgggctcaggctaggaggacgagctgattattactggctgctcatatgcagtagtgggtcgacctaccgtcccggttgggttacgttcggggacgggaacggggtaccgaacggggttcgacccggttccgtacgggttccgacggccccgaagggtcccgttccggtccccccgg

SEQ ID NO: 396745 - DNA, 633 bp, Homo sapiens
  misc_feature: GZ8MTXP01DDQJD.9.53.E09.1.454.CMB.2.raw
  modified_base (230)..(230): a, c, t, g, unknown or other
  modified_base (514)..(514): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcacccctcctcactcaggacacagggtcctgggcccagtctgccctgactcagcctgcctccgtgtctgggtctcctggacagtcgatcaccatctcctgcactggaaccngcagtgtattggttaggggatttatgacctttgtcctccgtaggtaaccaacacgccaacccaacgggaccaaaaccgaccccccaaaactccaattactaatttagtgaaggtaccaactaacggccgtcccgttagtacggggtttctagttcgtcctttctcgtggctaccaaacgttctcgaacaaacccgtaccggtcccctacccgtagaactaactccttacgtcggccttccgaggtccgtaggacgggacgagggtctagtaatttacttaccgngggtcctgtctactatagtcgagtagtagtggtacgactaccgtccggtggttacgttcgggacggtacgggacttacggttcgaccgtcgtagtcgacgccgacgtccgccgtccccg

SEQ ID NO: 396746 - DNA, 602 bp, Homo sapiens
  misc_feature: GZ8MTXP01CBA7B.9.53.E09.1.454.CMB.2.raw
  modified_base (228)..(228): a, c, t, g, unknown or other
  modified_base (362)..(362): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggtggattatgacttgtctctgacaacagcaccaggcaaacgccccaaatcatctatttatgagtcactaagcggccttacgtagggtttctattcgtccttctctggctcaaagtctgacaacnccgcctcctgacactcgtcgtcgggctaccgaggtcgtaggacgggacgagggtcttagtatttactacgttcgggcttaggtcctacagtagttcgacgaggtacgtgggtacgacctaccgttcccggttgggttacggttccggggacggttaaacggggaccgttaaacgggttcgttacccggttaaccgtacggtccgacggacccgttaacggtcccgttcccggttcccccg

SEQ ID NO: 396747 - DNA, 812 bp, Homo sapiens
  misc_feature: GZ8MTXP01EK96Y.9.53.E09.1.454.CMB.2.raw
  modified_base (226)..(226): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctccgtggacagtcgatcacatctcctgcactggaaccngcagtgattggttgggattatgaccttgtctccgtggtaaccaacgagccaacccgaggaccaaaaccgaccccccaaaatcatacctatttatagaacggtcaacgtaacggccggtccttcgtaacgggggttttctaacgtttccggtccctttctcgtcgggtcctacccgtaaaaagttccaacggaaaccctaaaccgaacccgggtccccttaccccgtaggaacctaaacgttcccgttcggttcggggcccttaccgaacgggtccgttacggggaacggggtaaccggccggggtaccttacgggttaattttaacgtttaaccgttcgggggtacctttcgggtacccttaacgtaatttaacgttggaccgtaaaggtaacgttgggggttactaaccgttaaacccggttccccgggtttaggggttaaacggtttcccgggggaacgggggaaaccgggggtaaacccggttaacggggttaccggttaaccccggtttaaccgggtaaacgggttaaccgtaaacccgggaccccgaaacggggtccccgttcccgggttccccccccggg

SEQ ID NO: 396748 - DNA, 553 bp, Homo sapiens
  misc_feature: GZ8MTXP01D3QC6.9.53.E09.1.454.CMB.2.raw
  modified_base (228)..(228): a, c, t, g, unknown or other
  modified_base (248)..(248): a, c, t, g, unknown or other
  modified_base (302)..(302): a, c, t, g, unknown or other
  modified_base (341)..(341): a, c, t, g, unknown or other
  modified_base (372)..(372): a, c, t, g, unknown or other
  modified_base (440)..(440): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattangacttgtctctggaccaacagcaccaggacaaacgccccaaactcatcatttangagtcactaagcgcctgtagggtttctattcgtcttctntgctccaaagtctgacaacgaccgccctccngacatctcgtgggctccgaggctaggaggacgaggctgtatttattacctggtctgctactatagtgnaagtgtggtacgaaccgtcgttcccggttggttacgttcggggacgggaacgggaccaagggttcgacccggttccgtaaggtccacgacccgaggtccgttccggtcccccg

SEQ ID NO: 396749 - DNA, 508 bp, Homo sapiens
  misc_feature: GZ8MTXP01EBFPI.9.53.E09.1.454.CMB.2.raw
  modified_base (301)..(301): a, c, t, g, unknown or other
  modified_base (428)..(428): a, c, t, g, unknown or other
  modified_base (431)..(431): a, c, t, g, unknown or other
  modified_base (433)..(433): a, c, t, g, unknown or other
  modified_base (436)..(436): a, c, t, g, unknown or other
  modified_base (440)..(440): a, c, t, g, unknown or other
  modified_base (442)..(442): a, c, t, g, unknown or other
  modified_base (457)..(457): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggatttatgaccttgtctcctggtaccaacagcaccaggcaaagcccccaaatcatcatttangagtcactaagcggcctctaggggtttctattcgtccttctctggctccaaaagtctgacaacacggcctccctgacaatctctggctcaggctaggagacgtaggctagattatactgctgccttnatngnagngtgncncgtcgtgttgtcggnggacggacgaggttcgacgtcgtagtcgacgccgacgtccgttccgtcccg

SEQ ID NO: 396750 - DNA, 575 bp, Homo sapiens
  misc_feature: GZ8MTXP01AQSZS.9.53.E09.1.454.CMB.2.raw
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctctgcactggaaccagcagtgattggttgggattatgtaccttgtctcctggtaccaacacgcacccaggaccaaacgcccccaaactcatcatttatgagtcactaagcgcctcgtagggttctatcgtccttctctgctcaaagtctgacaacgaccgcctcctagacaatctctgggctccgaggctaggaggacgaggctgtattattactgggctgtcctactatatgacagtacgtggtacgacctcgttcccggttaggttacgtttcgggacgggtaacgggaccgttaaggggttccgacccggttaaccgtacggtaaccgaccggtacccgaacggtcccgttccgtccccccg

SEQ ID NO: 396751 - DNA, 692 bp, Homo sapiens
  misc_feature: GZ8MTXP01A52ZH.9.53.E09.1.454.CMB.2.raw
  modified_base (225)..(225): a, c, t, g, unknown or other
tcagtgatacgtctcacgaccggtgctcgatttagagagagtgtgttggggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcatcacatctcctgcactggaaccngctagtgagttggtaggtattatcgtacttcgtctcgtacgaaccaacacgaccaccgacgaccaaaccgaccccaactctatactaattagtagtacgtactaacgtacgccgtaccgtacgttacggtttactacgttcgtcccttcgtcgtcgtacctaccgtaaacgttctaacgaaccaaacccgtacccgtccctaccgtacgaactaactccgtacgtcggtcctacggacggtcgtacgggaacgggtacgtacggtacgttagttaacttacgtttacgtcggtcgttacgtactacgtaagttagtcgtacgtagtacgtacggtacgtaccgtaccgttaaccggttacggttacggttacgggacgggtaacgggtaacggttaacgggttacggttaccggttaaccggtacggtaaccgaccggtaccggttaccggtccgttcccgtccccg

SEQ ID NO: 396752 - DNA, 527 bp, Homo sapiens
  misc_feature: GZ8MTXP01BZV3M.9.53.E09.1.454.CMB.2.raw
  modified_base (226)..(226): a, c, t, g, unknown or other
  modified_base (298)..(298): a, c, t, g, unknown or other
  modified_base (434)..(434): a, c, t, g, unknown or other
tcagtgatacgtctcacgaccggtgctcgatttagagagagtgtgttgggtttgggggggtcacaagaggcagcgctctcgggactctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgacttgtctctggaccaacagcaccagcaaacgccccaaactcatcatttangagtcactaagcgcctcgtagggtttctattcgccttctctgctcaaagtctgacaacacggcctcctgacatctcgtcggctcgaggctaggacggacgaggctgtattattactggggctgtctacatagtcgngagtatggtacgactacgtccggtgttacgttcgggcgggagggccttaagggttcgaccgtcgtacggtcacgccgaggccttccgtccccg

SEQ ID NO: 396753 - DNA, 617 bp, Homo sapiens
  misc_feature: GZ8MTXP01AWLOV.9.53.E09.1.454.CMB.2.raw
  modified_base (330)..(330): a, c, t, g, unknown or other
  modified_base (334)..(334): a, c, t, g, unknown or other
  modified_base (359)..(359): a, c, t, g, unknown or other
tcagtgatacgtctcacgaccggtgctcgatttagagagagtgtgttgggtttggggatactttctgagactcatggacctcctgcacaagaacatgaaacacctgtggttcttcctcctgctggtggcagctccagatgggtcgtgtccaggtgcagctgcaggagtcgggcccaggactggtgaagccttcggagaccctgtccctctcctgcactgtctctggtgctccatcagtacttactactggacctggatccggcacgccgcgggaaggctggagtgggtggcgttattttagcaggtgggacacaactacacgccctcctnaagngtcgagtccacatgtcagtaacacncgtacaaagaaccagactctacctgaacgtctcgacctgtcgtcgaccgcgcgacgacggcgtgtaattcgtgggtcgacggtaagtaccgtttacccaaaatcgttaacggaccaaacgtagggtccttaacgggttaactaacttttaccgtttttagggaacttacggttagggttacgggggaacccgaaagggggttacctaaaggttcgggtaacctaacccggtcttccggtttaaccaacggttcccccg

SEQ ID NO: 396754 - DNA, 670 bp, Homo sapiens
  misc_feature: GZ8MTXP01C0G19.9.53.E09.1.454.CMB.2.raw
  modified_base (311)..(311): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcacccctcctcactcaggacacagggtcctgggcccagtctgccctgactcagcctgcctccgtgtctgggtctcctggacagtcgatcaccatctcctgcactggaaccagcagtgatggttgggattatgaccttgtctcctaggtaccaacagacacccaggaccaaacgaccccaaactcatctatttangaagtacacgtaaacgcggccgtgttacggggtttctagttccgtccttctctggtctacctaaagtcgtcgaaccaaacccgtaccgggtcccctaccccgtagtaaccaaacttcctacgttcgggcctacccggaggtccgtagggacgggtacgacggtacgttagtaactttacttaccgtgggtcttacggacttacgtaattagtagtagtaaacgttcggtaacgtaccgtacccgttccggtaagggttacggttccggggacgggaaacgggtaaccgtacgggttacgttcccggttacgtaacggtccaacgacccggtacggccctcccggttaaccccgttccgg

SEQ ID NO: 396755 - DNA, 602 bp, Homo sapiens
  misc_feature: GZ8MTXP01C787I.9.53.E09.1.454.CMB.2.raw
  modified_base (304)..(304): a, c, t, g, unknown or other
  modified_base (342)..(342): a, c, t, g, unknown or other
tcagtgatacgtctcacgaccggtgctcgatttagagagagtgtggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggacttatgtaccttgtctcctaggtaaccaacagccaccaggacaaacgccccaaatcatcatttangagtcactaagcgcctgtagggtttcattcgcttcctntggctaccaagtctagaacaacacgcctccagaacatctcgtggcctaccgaggcaggaacggacgtacggctagtatttaacgtaccttggcctgtacctataattaagtgacgaagtagtcgtacgtaccgtaccggttccggttaaggttacggttcggggaaccgggaacgggtaaccgtaacgggttaccggttaccgttaccggtaacggtaccgaaccgtacccggtacggttcccgtcccggttccccgtcg

SEQ ID NO: 396756 - DNA, 604 bp, Homo sapiens
  misc_feature: GZ8MTXP01BS30N.9.53.E09.1.454.CMB.2.raw
  modified_base (493)..(493): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggatttatgtaccttgtctcctggaccaacagccacccaggaccaaacgacccccaaatcatctatttatgagtcaacgtaagccggtcctagtacgggtttctattcgtccttctcgtggtcctcctaaaagtcctaaggaacaaaccgaccggtcccctacccgtacgaactaaactcctcgtgggcctccgaaggtctaggacggacgaggctagtattattactggctgtcctatatactgataagngtcggtacaccgtaccgtccggttaggttacggtcggggacgggaacggtaacgttagggttccgttaccgtcgtaggccgacggacccgacggtccgttcccggtccccg

SEQ ID NO: 396757 - DNA, 560 bp, Homo sapiens
  misc_feature: GZ8MTXP01A9G6A.9.53.E09.1.454.CMB.2.raw
  modified_base (299)..(299): a, c, t, g, unknown or other
  modified_base (379)..(379): a, c, t, g, unknown or other
tcagtgatacgtctcacgaccggtgctcgatttagagagagtgtgtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggatttatgacttgtctctggtaccaacagcacccaggacaaacgccccaaactcatcatttangacggtacactaacgccggcccttcgaggggtttctattcgcttctctggctccaagtctgaacaacaccggccctcccngacaatctcgtgggctccgagggcctggacggacgaggtctagtacttattactgcgtgctcaagtatgcagtacgtggtagaccacgtcccggtggtacgttcgggacgggaggggaaccgaagggttcgaccggttccgtaagggcaacggcccgtaaggcccgtccgcccccgttcgg

SEQ ID NO: 396758 - DNA, 584 bp, Homo sapiens
  misc_feature: GZ8MTXP01DMPJG.9.53.E09.1.454.CMB.2.raw
  modified_base (230)..(230): a, c, t, g, unknown or other
  modified_base (290)..(290): a, c, t, g, unknown or other
  modified_base (308)..(308): a, c, t, g, unknown or other
  modified_base (409)..(409): a, c, t, g, unknown or other
  modified_base (433)..(433): a, c, t, g, unknown or other
  modified_base (565)..(565): a, c, t, g, unknown or other
  modified_base (567)..(568): a, c, t, g, unknown or other
  modified_base (570)..(572): a, c, t, g, unknown or other
  modified_base (574)..(584): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacacgcccctcctcaagagtcgagtcaccatgtcagtagacacgtccaaagaaccagatctccctgaagctgacctntgtcgacccgccgcggacacggccgttgtattactggtgcgagtacgttacccaaaatanagacaacagctggtactntttctttgatagtggtgggggaccaaagggacaagtggtaccaccgtctcttcacgccctaccaacccgaacgggcctagtcccggttcccttccccccgnggcccgccctcgccctccgaggcnccacccgtccgagacgccacgacggcccggcccgtgggctcggccgttaggacaaacggtaccttaccgttaccgaagtaaccgtactccgacgtggacggtcgggaccgtggaccgaagggccgaataagngnngnnngnnnnnnnnnnn

SEQ ID NO: 396759 - DNA, 521 bp, Homo sapiens
  misc_feature: GZ8MTXP01EL960.9.53.E09.1.454.CMB.2.raw
  modified_base (227)..(227): a, c, t, g, unknown or other
  modified_base (301)..(301): a, c, t, g, unknown or other
  modified_base (359)..(359): a, c, t, g, unknown or other
  modified_base (409)..(409): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgtgggattatgacttgtctcctggtaccaacagcaccaggcaaacgccccaaactcatacatttangagtcactaagcgcctcagggttctattcgtccttctctgctccaaagtctgacaacncgcctcccgacactctctggctcgagctgaggacgaggctagattatacngctgctcatatgcagagtgtgacacgtccgtggtagttcggcgggacgggacgtaaggacggttccgttaccgtaacggtcgaacgaccgaacggcgtccgccccgtcccgg

SEQ ID NO: 396760 - DNA, 557 bp, Homo sapiens
  misc_feature: GZ8MTXP01D2SKK.9.53.E09.1.454.CMB.2.raw
  modified_base (312)..(312): a, c, t, g, unknown or other
  modified_base (353)..(353): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttggggatttatgaccttgtctcctggtaccaacagcaacccaggaccaaacgcccccaaatcatctatttangaaggtcactaagcgcctgtagggtttctattcgccttctntggctccaaagtctgacaacaccggcctcctgacaatctctcgggctcgaggctggaggtacgaggctgtattattactgggtctgtctcatagtgcagtatggtagactaccgtcccggttggttagttcggggacggtacgggaacgaagggttcgttaccgtccgtaggtccacggacccgaaggtcccgttcgtcccccg

SEQ ID NO: 396761 - DNA, 596 bp, Homo sapiens
  misc_feature: GZ8MTXP01CLT5R.9.53.E09.1.454.CMB.2.raw
  modified_base (283)..(283): a, c, t, g, unknown or other
  modified_base (571)..(571): a, c, t, g, unknown or other
  modified_base (580)..(581): a, c, t, g, unknown or other
  modified_base (583)..(596): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaaagaaccagatctccctgaagctgacctctgtgaccgccgcggacacggccgtgtattactgtgcgagagttacccaaatanagcaacagctggtacatttcctttgattatggtggggaccaaagggacaatggtcaccgtctcttcacgccctaccaccccgaacgggcccagtcccgggtcccttcccccccgtgggcccgcccctagcctcccgagggacgccaccctcccgagacgccacgacgcccggccccgtggggcctcggcccgttggtaccgaaacgggtaccttaaccgtttccgaacgggtaccgttaactacccgaaccgtggaacggccggggcttcggggaccgaagggcccgngaattaggnngnnnnnnnnnnnnnn

SEQ ID NO: 396762 - DNA, 616 bp, Homo sapiens
  misc_feature: GZ8MTXP01ERMT6.9.53.E09.1.454.CMB.2.raw
  modified_base (222)..(222): a, c, t, g, unknown or other
  modified_base (301)..(301): a, c, t, g, unknown or other
tcagtgatacgtctcacgaccggtgctcgatttagagagagtgtggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccngcagtgatggttgggattatcgacttgtctccgtggtaccaacagcaccaggacaaacgaccccaaatcatctatttanagaggtacacgtaacgccggtcccttcgtagggtttctacttcgtcttcctctcggctcctaagtcctacgaaccgtaaccgaccggtccctccctagacctattcctcgtgggcctacccgagggtccgtagggaacggaccggtaggtcttagtacttaattacgtcgtcttcgtcttactaattgtcgactaggtaaagttcggggtactaccgtaccgttcccggtaaggttacgttcggggacgggttacgggaccgtaaggttcgccgttcggtgacgcgacccgaggttcctcccgttccccgtccgg

SEQ ID NO: 396763 - DNA, 547 bp, Homo sapiens
  misc_feature: GZ8MTXP01BI8BT.9.53.E09.1.454.CMB.2.raw
  modified_base (304)..(304): a, c, t, g, unknown or other
  modified_base (439)..(439): a, c, t, g, unknown or other
  modified_base (445)..(445): a, c, t, g, unknown or other
  modified_base (450)..(450): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgcccccaaactcatcatttangaggtcactaagcggcctcgtagggtttctattcgtccttctctgctccaaagtctgacaacaccggcctccctgacaatctctcgggctccgaggctaggagggacgagggctgattacttactgctgctcatntgcagntggtnactaccgtcccgtgggttagtccgggcgggtacgggacgaacgggttcgacccggtcctaagggtccacggccccgaagggtccttccggtcccccg

SEQ ID NO: 396764 - DNA, 494 bp, Homo sapiens
  misc_feature: GZ8MTXP01EL6EX.9.53.E09.1.454.CMB.2.raw
  modified_base (413)..(413): a, c, t, g, unknown or other
  modified_base (420)..(420): a, c, t, g, unknown or other
tcagtgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacttgtctctggtacaacagcaccaggcaaacgccccaaactcatcatttatgagtcactaagcggcctcgagggtttctattcgcttcctctgctcaagtctgaacacacgcctcctgacatctctggctcaggctgaggacgaggctgattatactgctgctcatatgnagatgtnactactccgtgtagttcgggcggaggacgaaggttcgccgttcgtaaggcaagcccaggcctcgccccgttcgg

SEQ ID NO: 396765 - DNA, 490 bp, Homo sapiens
  misc_feature: GZ8MTXP01C0WUM.9.53.E09.1.454.CMB.2.raw
  modified_base (228)..(228): a, c, t, g, unknown or other
  modified_base (318)..(318): a, c, t, g, unknown or other
  modified_base (339)..(339): a, c, t, g, unknown or other
  modified_base (367)..(367): a, c, t, g, unknown or other
  modified_base (409)..(409): a, c, t, g, unknown or other
  modified_base (419)..(419): a, c, t, g, unknown or other
  modified_base (422)..(422): a, c, t, g, unknown or other
  modified_base (425)..(425): a, c, t, g, unknown or other
  modified_base (428)..(428): a, c, t, g, unknown or other
  modified_base (436)..(436): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttggggattatgaccttgtctctggacaacagcaccaggcaaacgccccaaatcatctattatgagtcacgtaagcgcctntagggtttctattcgccttcntgctcaaagtctgacacacggcctcctnacatctctgggctcgagcaggacgacgagtctgattattacnggtctgctanatntgnagngtgtcgcnctcgtgttgtcggcggacggacgacgcgcgtctcgtcgcgcgacgtcgcgtccg

SEQ ID NO: 396766 - DNA, 598 bp, Homo sapiens
  misc_feature: GZ8MTXP01AB88N.9.53.E09.1.454.CMB.2.raw
  modified_base (266)..(266): a, c, t, g, unknown or other
  modified_base (367)..(367): a, c, t, g, unknown or other
  modified_base (464)..(464): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctctggtaccaanagcacccaggcaaacgccccaaactcatcatttatgaggtcactaagcggcctcgtaggggtttctattcgtccttctctcggctccaaagtctgacaacncggcctcctgacatctcaggctcgagctggacggacggaggcttaggtaattacgttactcggggtctcggtcctacgtaataagtggcctaaaggngttgggttacgaccgtaaccggttccccggtagggttaccggttcggggacgggtaacggggaaccgttacgggttcggttaaccggtccgttaggggccacggacccgttaacggtccgttccggtccccccg

SEQ ID NO: 396767 - DNA, 641 bp, Homo sapiens
  misc_feature: GZ8MTXP01C1LGG.9.53.E09.1.454.CMB.2.raw
  modified_base (316)..(316): a, c, t, g, unknown or other
  modified_base (507)..(507): a, c, t, g, unknown or other
tcagtgatacgtctcacgaccggtgctcgatttagagagagtgtggtttggggggtcacaagaggcagcgctctcgggacgtctccaccatggcctgggctctgctgctcctcaccctcctcactcaggacacagggtcctgggcccagtctgccctgactcagcctgcctcgtgtctgggtctccgtggacagtcgatcacatctctgcactgaaccagcagtgtagtggttgggtaattatcgtaccttcgtctccgtaggtaaccaacagcccaaccgaaggaccaaaccgacccccaaatcaatctatttancgagtacacgtaacgccggtcctagtagggtttctagttcgtctttcccgtctggtcctacgaagttcctacgaaccaaccaccgggtcccttacccgtagaactaactccgtagttcggcctaccgaggtcctagggacgggaacgacggtctagttataacttcgtcgtactcgtacttcagttaacgngtacgagtacgtcgtacgaccgtccggttccggtaagggtacggttcggggaacggacgggtaaccgtaacggttccgttccgttacggaacgtaccgaaccggtaccgcggttcccgtcccgttccccgttcg

SEQ ID NO: 396768 - DNA, 550 bp, Homo sapiens
  misc_feature: GZ8MTXP01ASRNL.9.53.E09.1.454.CMB.2.raw
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgtaccttgtctctggaccaacagcacccaggacaaacgccccaaatcatcatttatgagtcactaagcggcctcgtagggtttctattcgccttctctggctccaaagtctcgacaacaccggcctccctagacatctcgtcggctccgaggctagaggacgaggctagatttatactggctgctcatatgcagatggtacgaccgacgtcccggtggttacgttccgggcgggtaacgggaccgttaagggttcgttaacccggtcctagggtccacggcccgaggtcccgttccgtcccccg

SEQ ID NO: 396769 - DNA, 565 bp, Homo sapiens
  misc_feature: GZ8MTXP01CQK6N.9.53.E09.1.454.CMB.2.raw
  modified_base (298)..(298): a, c, t, g, unknown or other
  modified_base (467)..(467): a, c, t, g, unknown or other
  modified_base (470)..(470): a, c, t, g, unknown or other
  modified_base (474)..(474): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccatctcctgcactggaaccagcagtgatgttgggattatgaccttgtctcctgaccaacagcaccaggcaaacgccccaatcatctattangagtcacgtaacgcgcctagtagggtttctagttcgtcccttctcgtcggtcctaccgaaagttcctaagaacctaaccgaccgggtccctcccgtagaccaacttcgtacgtcgggctccgaggctaggacggacgaggcttagtattatactggctgctacatatgnagngtgngacctcgtccggtggttagtcgggcggtaacgggccgttagggttcgacccgtgtacggtcacggacccgacgggtccttccggtcccccg

SEQ ID NO: 396770 - DNA, 633 bp, Homo sapiens
  misc_feature: GZ8MTXP01EM39Z.9.53.E09.1.454.CMB.2.raw
  modified_base (232)..(232): a, c, t, g, unknown or other
  modified_base (328)..(328): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcaccatctcctgcactggaaccngcagtgattggttagggagttatgtaccttgtcctctacggtaccaacacgaccaacccgacggaccaaaaccgcccccaaactcaatctatttangtacgtacactaacgccgtaccctgtagggtttctacttcgtctttctctcggtactaccgaagtctacgaaccaccgaccggtccctaccgtacaactactctcgtcgggcctaccgaggcgtaggacgggacgaggtcttagtactttactacgtcggtctcggtctacgtatagtagcgtaggtagtcgggtcgaaccttccggttccgggttggttaacgggtcgggaacggggttacgggacggttaacgggtcggtacccgtaacgttacggaccgaccggtaacccgaacggtccccg

SEQ ID NO: 396771 - DNA, 785 bp, Homo sapiens
  misc_feature: GZ8MTXP01EGD6I.9.53.E09.1.454.CMB.2.raw
  modified_base (772)..(772): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgactattaggtaattaactatgtctcctaggtaaccaaacaactaccccggacaaaaccgcccccctaaaacttccttgtcttttaatcgaattgtactagtttatccggtcccctacgtagggtacttttcgtgtacttccgtctttcctcgttacggtccctacctaacggttcccgtacgggccctaacccgtacccgggtcccccttaccccgttacgaccctagttcccttcgtcggggtccctcccggaggtccgttagggaacgggacgtaacgggtcctaggttaactttacttttcgacggtacgtaaacggttaaccttaaaacgaaaaaacggtaacgttacccgtccccgtttcggttaccgggggttttcggggtttacccggggggaccggggggtaaccgaacgggggttccgtaaccccggttacgtaaacggttccgaaaccggtaccccggttaagggttcccgttacccggtcccccgtttgggtaacccctccgttcccgttcccggtttaacccccnccccggtttcccg

SEQ ID NO: 396772 - DNA, 514 bp, Homo sapiens
  misc_feature: GZ8MTXP01BCPDN.9.53.E09.1.454.CMB.2.raw
  modified_base (295)..(295): a, c, t, g, unknown or other
  modified_base (313)..(313): a, c, t, g, unknown or other
  modified_base (353)..(353): a, c, t, g, unknown or other
  modified_base (361)..(361): a, c, t, g, unknown or other
  modified_base (381)..(381): a, c, t, g, unknown or other
  modified_base (390)..(390): a, c, t, g, unknown or other
  modified_base (410)..(410): a, c, t, g, unknown or other
  modified_base (418)..(418): a, c, t, g, unknown or other
tcagtgatacgtctcacgaccggtgctcgatttagagagagtgtgttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccagcagtgatgttgggagttatgacttgtctctggtaccaacagcaccaggcaaacgcccccaaactcatcatttangagtcactaagccgcctntagggtttctattcgcttcctctgctcaagtctgaacacncggctccngacatctctgggctccgagntggagacgnggctgattatactgctgctnatatcganagatgtacgactaccgtccgtggtaacgttcgggacggaggactaagggttcgaacgttccgaaggtcaacgtcccgaggcctccgccccgttcgg

SEQ ID NO: 396773 - DNA, 603 bp, Homo sapiens
  misc_feature: GZ8MTXP01BRYDR.9.53.E09.1.454.CMB.2.raw
  modified_base (227)..(227): a, c, t, g, unknown or other
  modified_base (265)..(265): a, c, t, g, unknown or other
  modified_base (297)..(297): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcacatctcctgcactggaaccngcagtgatggttgggattatgtacttgtctctgacaanagcaccagacaaacgccccaatcatcatttangaggtcactaacgccgccctgtagggtttctattcgccttctctggcctcaaagtctgacaacgaccgcctcctagacatctcgtgggcctcgaggctaggaggacgaggcttagtaattattacgtggacttgtcctactatacgtgactaaggtatgggtactacccgtaccggttccggttagggttaacggttccggggacgggtaaacggggtaccgttaaacggggttccgttaacccgggttccgttaagggtccgaccgggacccgttaacgggtcccgttccccggtaaccccccgg

SEQ ID NO: 396774 - DNA, 782 bp, Homo sapiens
  misc_feature: GZ8MTXP01DFOJT.9.53.E09.1.454.CMB.2.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcatcaccatcctcctgccactggaaccagcagtgagtggttgggattatgtaccttgtctcctaggtaccaaacacgccaacccgaaggaccaaaaccgcccccaaactcatactatttaatgaacggtacaacgtaacggccggtacccgtgttacggggtttctagttccgtccctttcgtctcggtcctaccgaaagttctcggaaaccaacccgtaccggtcccctaccctagaactaaacttccgtcgtcgggcctaccggacgggtacgaacgggacgggaacgggtacggtacgttaaggtaattttaaaccgtttacgttcggggtcttacggttaaccttacctaaagttaaggttccgaacggttaaagtacggtttacggggtaaccgtaaccccgttaacccggggtttccccgggttaaggggtttaccggggtttaccgggggaaaccgggggttaaaccgggggaaaccggttaaacggggttccgttaaaacccccgggtttggaaaaccgggttccgaacccggtaccccgggaacggttccccggttccccggttccccccgg

SEQ ID NO: 396775 - DNA, 603 bp, Homo sapiens
  misc_feature: GZ8MTXP01CBZCY.9.53.E09.1.454.CMB.2.raw
  modified_base (227)..(227): a, c, t, g, unknown or other
  modified_base (265)..(265): a, c, t, g, unknown or other
  modified_base (296)..(296): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgtgggattatgacttgtctcctggaccaangcaccaggcaaacgccccaatcatcatttangagtcactaagcgcctgagggtttcattcgtccttctctggctcaaatctgacaacgcggcctccagacatctcgtgggctccgaggctaggaggacgtagctagtattattactggcttgctacatagtcgctaagagttggacgtacctaccggttcccggttagggttaccggtttacggggcgggtaaaccggggtaccgttaaaagggggttccggttaaaccccgggttcccggttaaaggggttcccgaaaccgggtaccccggttaaacggggtccccgttcccgggttccccccccgg

SEQ ID NO: 396776 - DNA, 571 bp, Homo sapiens
  misc_feature: GZ8MTXP01CUHJW.9.53.E09.1.454.CMB.2.raw
  modified_base (262)..(262): a, c, t, g, unknown or other
  modified_base (284)..(284): a, c, t, g, unknown or other
  modified_base (400)..(400): a, c, t, g, unknown or other
  modified_base (555)..(559): a, c, t, g, unknown or other
  modified_base (561)..(571): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacacgcccctccctcaagagtcgagtcaccatgtcagtagacacgtccaaagaaccagatctccctgaagctgacctctgtgaccgccgcggacacggcctgtattacngtgcgagacgttacccaaatanagcaaacagctagtacatttctttgatagtggtggggaccaagggacaagtggtaccaccgtctcttcacgtcctaccaaccccgaacgggcccagtcccggtcccttccccccgnggccctccctcgcccgtaccgaggcacccacccgtacgagacgaccacgacggcccggccgtcgggcctcgccgtacggaacgaacgtaccttacggtaccgaacgtaactacgaccacgtggacggcggcgtcggacgaacggcgtaacagagnnnnngnnnnnnnnnnn

SEQ ID NO: 396777 - DNA, 733 bp, Homo sapiens
  misc_feature: GZ8MTXP01AEEE5.9.53.E09.1.454.CMB.2.raw
  modified_base (226)..(226): a, c, t, g, unknown or other
  modified_base (313)..(313): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacgagggtcctgggcccagtctgccctgactcagcctgcctccgtgtctggtctcctggacagtcgatcacatctcctgcactggaaccngcagtgagttggttgggatttatgtaccttgtctcctaggtacccaacacgaccaccgaggaccaaacgccccaatcatctatttangacgtcacgtaacgcggtccctgtacgggtttctacgttccgtccttaccgtcgtcggtcctacccgaaaagttcctaacggaaacctaaacccggaacccgggtccccttaccccgttagaacctaaacgttcccgttacccgttcggggcccttaccccggaagggttccgtacggggaaacggggaaccggtaggggttaccttaacgggttaattttaaacgtttaccgttcgggggtacctttacggtccccttaacgtaatttaaaccgggtacgtacggtaacggtacggttacgggtaccgtaacccgttacccggttccgggtacgggttacggtccggggacgggtaacgggtaacgttacggttcgttacccgtcgtacgccgaccgccgacgtcccgttcccgtcccg

SEQ ID NO: 396778 - DNA, 833 bp, Homo sapiens
  misc_feature: GZ8MTXP01ALEOR.9.53.E09.1.454.CMB.2.raw
  modified_base (228)..(228): a, c, t, g, unknown or other
  modified_base (251)..(251): a, c, t, g, unknown or other
  modified_base (320)..(320): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctcgtgtctgggtctctggacagtcgatcaccatctcctgcactaggaaccngcagtgagttggttagggattancgtaccttgtctcctacggaaccaacacgccaccgacggacaaacgacccccaaactcatactatttancgacggttacaacgtaacggcccggtccctacggttacggggttttactacgtttccggtcctttccgtcgtcgggtaccctacccgtaaaaaggttcccttaaggaaacccgaaacccgtaccccggggtcccctttaccccgtaggtaaaccctaaacgttcccgttaccgggtacgggggtcccttaccggaacggggtccgttagggaacggggtaaccggagggtaccgttaggtaactttaactttacgtcggggtctttcggtaccttacctaacgttaacgttggaccgtaaaagggtaccgtttcggggggtaacctacccgtaaacccgggttttccccggtagggggtttaaaccggttccggggggaccggggaaaccgggggtaacccgggttaaaacggggttccggggttaaaccccgttaaccggggtttaccggtaacccgaacccgggggacccccgttaaacggggtccccgttcccccgggttcccccccggg

SEQ ID NO: 396779 - DNA, 540 bp, Homo sapiens
  misc_feature: GZ8MTXP01AJ6HR.9.53.E09.1.454.CMB.2.raw
  modified_base (240)..(240): a, c, t, g, unknown or other
  modified_base (263)..(263): a, c, t, g, unknown or other
  modified_base (297)..(297): a, c, t, g, unknown or other
  modified_base (449)..(449): a, c, t, g, unknown or other
  modified_base (454)..(454): a, c, t, g, unknown or other
  modified_base (457)..(457): a, c, t, g, unknown or other
tcagtgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccagcagtgatggttgggattangaccttgtctcctggtaccaacngcaccaggacaaacgcccccaaatcatcatttangagtcactaagccgcctcgtagggtttctattcgctttcctctggtctacccaagtctagaacctaaaccgaccggccctaccctgaactaaactcctcgtgggcctccgaggcctaggaggacgaggctagtattacttactgcttgcctnattanganagagtggtcactccgtcggtgtcgttcgggacggaggacgtaggttcgccgttacgtaagtcgcgccgagcctccgcccgtcg

SEQ ID NO: 396780 - DNA, 632 bp, Homo sapiens
  misc_feature: GZ8MTXP01ANLNJ.9.53.E09.1.454.CMB.2.raw
  modified_base (222)..(222): a, c, t, g, unknown or other
  modified_base (240)..(240): a, c, t, g, unknown or other
  modified_base (296)..(296): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctcgtgtctgggtctcctggacagtcatcaccatctctgcactgaaccngcagtgatgttggattangtacttgtctctggaccaacagcaccaggacaaacgcccccaaatcatctatttangacggtcaactaacgccggtcccgtgtacgggtttctacttcgtcccttcgtctggtcctcaaagtctaacgacaaacgacggccctcctgactaactcctcgtacggggtcctaccgagggtcgtaggaacgggacgtaaggccgttaggtaatttacttaacgtcggggtctcggtcctactaattagcgtaccgtaaggtacgtacgggtacgtaccgtcccgttcccgggtagggttacggttacgggacgggtaaacgggaacggttaacgggttccgttacccgtaaccgtaggtccgacggaccgaacggtccgttccgtaacccccgg

SEQ ID NO: 396781 - DNA, 520 bp, Homo sapiens
  misc_feature: GZ8MTXP01BR28R.9.53.E09.1.454.CMB.2.raw
  modified_base (299)..(299): a, c, t, g, unknown or other
  modified_base (339)..(339): a, c, t, g, unknown or other
tcagtgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattatgaccttgtctctggtaccaacagcaccaggccaaacgcccccaaactcatcatttangagtcactaagcggcctcgtagggtttctattcgcttccnctgctccaagtctgcacacggcctccctgacatctctgggctcgaggctgaggacgaggtctgattattacgtgctgctcatatgcagtagtgtgacctacgtcccggtggtacgttcgggcgggagggtaccgaaggttcgccgttcgtaaggtcaacggccaggcctcgccccgttcgg

SEQ ID NO: 396782 - DNA, 535 bp, Homo sapiens
  misc_feature: GZ8MTXP01BH7KG.9.53.E09.1.454.CMB.2.raw
  modified_base (227)..(227): a, c, t, g, unknown or other
  modified_base (266)..(266): a, c, t, g, unknown or other
  modified_base (301)..(301): a, c, t, g, unknown or other
  modified_base (319)..(319): a, c, t, g, unknown or other
  modified_base (396)..(396): a, c, t, g, unknown or other
  modified_base (429)..(429): a, c, t, g, unknown or other
  modified_base (437)..(437): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgacttgtctctgtaccaacngcaccaggacaaacgccccaaatcatactatttangagtcactaagcgtcctntagggttctattcgtcttctctgctccaaagtctgactaacacgcctcctgacatctctggctcagcgtgacggagnggcttgaatttattaccgtgctgtctacatagngacgagtntggtactaccgtccgtccggtggttacggtcgggacgggaacggaacgttacggttcgttaccgtcgacgtcgaccgacgacgtccgttcccgtcccg

SEQ ID NO: 396783 - DNA, 598 bp, Homo sapiens
  misc_feature: GZ8MTXP01BO86B.9.53.E09.1.454.CMB.2.raw
  modified_base (310)..(310): a, c, t, g, unknown or other
  modified_base (461)..(461): a, c, t, g, unknown or other
  modified_base (482)..(482): a, c, t, g, unknown or other
tcagtgatacgtctcacgaccggtgctcgatttagagagagtgtgttggggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcactatctcctgcactggaaccagcagtgatggttgggattatgtaccttgtctcctggaaccaacacgcaacccaggacaaacgccccaaactcatctatttangaggtcactaacgccggcctgtacgggtttcagtttcgccctttctctcggcctccaaaagtctgacctaaaccgccggccctccgtagactaactctctgggcctcgaggctaggacggacgaggtctagtaattattacctggggtctntcctatatagtcgactaggtntcgggtacaccgtacggtccgttgggttaacgttccggggacgggtaacgggacccgttagggttcgacccggttcgtaggtcgaaccggccgaacggtcccgttccgtcccccgg

SEQ ID NO: 396784 - DNA, 615 bp, Homo sapiens
  misc_feature: GZ8MTXP01D1S4Y.9.53.E09.1.454.CMB.2.raw
  modified_base (243)..(243): a, c, t, g, unknown or other
  modified_base (301)..(301): a, c, t, g, unknown or other
tcagtgatacgtctcacgaccggtgctcgatttagagagagtgtgtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattangacttgtctcctggtaccaacagccaccaggacaaacgcccccaaatcatctatttangaggtacactaacgccggccctgtaggggtttctagttcgtcttcctcgtggtctccaagtctagaacaacaccggccctccctagactaactctcgtggctcgaggtctaggaacggacgaggctagtaattattacgtcgtctgtctactaatagtgacgagtaagtcggtacgtaccgtaccgttcccggttaaggttacgttcggggacgggttaacgggaaccgtaacggggttaccgttacccggttaccgtaacgggtccaaccggtaccccgaacgggttcccgtcccggttcccccgtttccggg

SEQ ID NO: 396785 - DNA, 585 bp, Homo sapiens
  misc_feature: GZ8MTXP01AZ7TU.9.53.E09.1.454.CMB.2.raw
  modified_base (293)..(293): a, c, t, g, unknown or other
  modified_base (423)..(423): a, c, t, g, unknown or other
  modified_base (445)..(445): a, c, t, g, unknown or other
  modified_base (458)..(458): a, c, t, g, unknown or other
  modified_base (463)..(463): a, c, t, g, unknown or other
  modified_base (567)..(567): a, c, t, g, unknown or other
  modified_base (569)..(570): a, c, t, g, unknown or other
  modified_base (572)..(574): a, c, t, g, unknown or other
  modified_base (576)..(585): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgttatttttagcaggtggggacaccaactacacgccccctccctcaagagtcgagtcaccatgtcagtagacacgtccaaagaacccagatcctccctgaagctgacctctgtcgaccgccgcggacacggccgtgtattacgtgtgcgagtacgttacccaaaatnagacaacagcttaggtactattttcctttagattagtggtcgggggacctaaagggggactaagtggtcccaccgttctcttcacgtcccctaccgacccgaacgggcctagtcccgtcccttcccccgnggccctccctgcctccgaggcnccaccgtcgagcncacgngccgcccgtgggctcggccgtggtacaacggtcttaccgttccgaaggtaccgtactccaacggtggacgggccgggcgtacgggcgaacgggcgaacgtaagngnngnnngnnnnnnnnnn

SEQ ID NO: 396786 - DNA, 535 bp, Homo sapiens
  misc_feature: GZ8MTXP01DU0TG.9.53.E09.1.454.CMB.2.raw
  modified_base (306)..(306): a, c, t, g, unknown or other
  modified_base (346)..(346): a, c, t, g, unknown or other
  modified_base (430)..(430): a, c, t, g, unknown or other
  modified_base (436)..(436): a, c, t, g, unknown or other
  modified_base (440)..(440): a, c, t, g, unknown or other
  modified_base (446)..(446): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggacaaacgcccccaaatcatcatttangagtcactaagcgcctgtagggtttctattcgtccttctntgctcaaagtctgacaacacggcctcctgacatctcgtggctccgaggctaggaggacgaggctagattatactggctgcctanatatgnaagntgggtnactaccgtccggtggttagttcgggacgggagggaccttaagggttcgaacccgtcgtagggcacgccgaaggtccttccggtcccccg

SEQ ID NO: 396787 - DNA, 623 bp, Homo sapiens
  misc_feature: GZ8MTXP01DL43D.9.53.E09.1.454.CMB.2.raw
  modified_base (231)..(231): a, c, t, g, unknown or other
  modified_base (291)..(291): a, c, t, g, unknown or other
  modified_base (454)..(454): a, c, t, g, unknown or other
  modified_base (577)..(577): a, c, t, g, unknown or other
  modified_base (608)..(608): a, c, t, g, unknown or other
  modified_base (611)..(623): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagccccctcctcaagagtcgagtcaccatgtcagtagacacgtccaaagaaccagatcctccctgaagctgacctntgtcgacccgccgcggacacgggccgtgtattactgtgcgagtacgttaccccaaaatanagacaaacagtcgtaggtaactattttccttttagaattagtgggtacgggggaaccctaaaagggggacctaaagttcgggtaccctacccgttcttaccttcacgtcccctacccaaaccccgaaccggggccctaagtcccggttccccttccccccggnggcccctccctcgccctaccgagggaccacccacccgtacgaagacgaccgaccgacggtcccggcccgtgggcctccggccgtacggtaaccaacgtaccttaccggtacgaacgtactacncacgtggacggcggcgtcggacgacggcaanagnnnnnnnnnnnnn

SEQ ID NO: 396788 - DNA, 708 bp, Homo sapiens
  misc_feature: GZ8MTXP01BUP3Y.9.53.E09.1.454.CMB.2.raw
  modified_base (229)..(229): a, c, t, g, unknown or other
  modified_base (314)..(314): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcaccatctcctgcactggaaccngcagtgattggttgggattatgtaccttgtctcctggtaccaacacgcaacccaggaccaaaccgacccccaatcatctatttangtagtacacgtacgcgtcctagtagggtttctgttctccttctcgtcgcctacctaaacgttctaacgaccaaaccgtccggtccctccctagaacctactccgtcgtcgggctacgaggtctacgggacgggacgtaagggtcttaggtaactttagttaccgtgggtccttgtacccttactaattacgttacgacggtaagttacggttagggtaccgtaaccgttacccgggttccccgggtttaagggggttaacggtttcccgggggaccgggggaaacgggtaaccccggttaacggggttcccgggttacccggttcccggtaacgggttaacccgaaccggtaccccgggttaacgggtccccgttaaccccggttccccccggg

SEQ ID NO: 396789 - DNA, 637 bp, Homo sapiens
  misc_feature: GZ8MTXP01CQ7ER.9.53.E09.1.454.CMB.2.raw
  modified_base (227)..(227): a, c, t, g, unknown or other
  modified_base (305)..(305): a, c, t, g, unknown or other
  modified_base (334)..(334): a, c, t, g, unknown or other
  modified_base (357)..(357): a, c, t, g, unknown or other
  modified_base (372)..(372): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatcctctgcactggaaccngcagtgagttggttgggattatgaccttgtctcctggtaccaacagccaccaggacaaacgccccaaatcatcattangagtcactaagccgcctgtagggtttctnttctccttctgtgctcaaagtcngacacgcggcctccngacactctcgtacgggtctccgaggcgtaggacgggacgagggccttaggtaactttaaacgtttccgtacggtcgttacggtccttaccgtaattagttaccggacgtaacggtagttacggggtaccgtaacccgttacccgggttaaccccgggtttgggttacgggttaccgggggcgggtaaaccggggtacgttaacgggttccgttacccgtaacgtacgtccgacggacccgttaacggtccgttcccgtcccccgg

SEQ ID NO: 396790 - DNA, 640 bp, Homo sapiens
  misc_feature: GZ8MTXP01BKXYL.9.53.E09.1.454.CMB.2.raw
  modified_base (231)..(231): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctcgtgtctgggtcctcctggacagtcgatcaccatctcctgcactggaaccngcagtgatggttgggagttatgtaccttgtctcctaggtaccaacacgaccacccagaccaaacgacccccaaactcatactatttatgtaggtacacgtaacgccgcccttgtacggggtttctacgttctcttctctcggacttaccaagtctacgacaaccgtaccggccctacctagacctaatcctcgtcgggcctaccgaggtcgtgggacggacggagacttaggtacttacgttacttcgtctacgtcctatagtagtacgacgtaagtacgttaggtccaacgttccgttccggggttaggttacggttccggggaacggggttaacgggttaccggttaacgggtccggtaccggttccgtaacgggtcttaacccggaacccggttaacgggtccccg

SEQ ID NO: 396791 - DNA, 598 bp, Homo sapiens
  misc_feature: GZ8MTXP01BNFW4.9.53.E09.1.454.CMB.2.raw
  modified_base (471)..(471): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtacaacagccaccaggcaaacgccccaaactcatctatttatgaggtcactaacgcgtcctcgtaggggtttctattcgtccttctctggtcctacccgaaagttctcgtacaaaccgaccgggtccctccctagactaactcctcgtgggctccgaacggctacggaggacgagggcttagacttattactcgggcttcggctcattngcagtgtggtcgactacgttcccggtgggttacgttcggggcgggacggggaacccgttaaggggttcgttacccggtccgttacggtccgacggccccgaagggtcccgttcccggttccccccgg

SEQ ID NO: 396792 - DNA, 675 bp, Homo sapiens
  misc_feature: GZ8MTXP01CU0X8.9.53.E09.1.454.CMB.2.raw
  modified_base (228)..(228): a, c, t, g, unknown or other
  modified_base (307)..(307): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgagtgttgggattatgaccttgtctcctaggaccaacacgcaacccaggaccaaacgccccaaatcatcattangagtcactaagcgcctgtacgggttctattcgtccttctctcggctaccaaagttctgacaaaccgaccggtccctccacgaactaatcctacgtcgggctccgaggtctaggacggacgacgggtctagtaattagttacctggtactgtctactattagtcgactaagagtcgggtacgtaacccgtccggttaaccccgggttagggttacgggtttaccgggggaacggggtaaccgggggtaaacccgttaaacgggggttccggttaaccccgggtttaaccgtaaccggggttaacccgaacccggggaccccgggttaaccgggggtccccgttaaccccgggtttaaccccccccgggg

SEQ ID NO: 396793 - DNA, 580 bp, Homo sapiens
  misc_feature: GZ8MTXP01ETCWO.9.53.E09.1.454.CMB.2.raw
  modified_base (216)..(216): a, c, t, g, unknown or other
  modified_base (257)..(257): a, c, t, g, unknown or other
  modified_base (290)..(290): a, c, t, g, unknown or other
tcagtgatacgtctcacgaccggtgctcgatttagagagagtgtgttggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcatcaccatctctgcactgaaccngcagtgagtggttgggattatgacttgtctctgtaccaacngcaccagacaaacgaccccaatcatctatttangtagtacacgtaacgccgtcctcgtagggtttctattcgtcttcctcgtggcctactaacgtctacgaaccaacgaccggtccctcctagactactctcgtgggctccgaggtctaggacggacgagtctagtaacttattactgcttgccttatatagtgacgtagtagttggtacgacctaccgttcccggtaagggttcgttcggggacgggacgggaccgtaacgggttcgttacccggttacgtaacggtcaaccggtcccgaggcccgtccgttccccgttcgg

SEQ ID NO: 396794 - DNA, 714 bp, Homo sapiens
  misc_feature: GZ8MTXP01A3XVL.9.53.E09.1.454.CMB.2.raw
  modified_base (228)..(228): a, c, t, g, unknown or other
tcagtgatacgtctcacgaccggtgctcgatttagagagagtgtgttgggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaaccngcagtgattggttgggtattatcgtacttcgtctccgtacggaccaacgacgaccaccgacggaccaaaccgaccccaaactctactactattagtagacgtacacgtacgccggtaccgtcgttacgggtttctacgttcgtccttctcgtcgtcctaccgaaacgttctaacgaaccaaccgtaccggtccctaccgtacgtaactaacttccgtcgtcgggtcctccgacggtcgtagggaacgggtacggtacggtacgttagttaactttaacgttacgtcggtcgttcgtctacgtattacgtagacgtaaggtcggttacgggtacgtaaccgtacccggttaaccgggttacgggttaccgggttaccgggggaacggggtaacggggtaaccggttaacgggttccggttacccggttaacccggtacgggtaaccgacccgggtacccggttaccggtcccgttcccggtcccccg

SEQ ID NO: 396795 - DNA, 717 bp, Homo sapiens
  misc_feature: GZ8MTXP01BN0W5.9.53.E09.1.454.CMB.2.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtcctccgtggacagtcgatcaccatcctcctgcacgtggaaccagcagtgagttggttgggatttatgtaccttgtctcctggtaaccaacacgccaacccgaggaccaaacgacccccaaatcctatactatttagtagaggtacaacgtaacgccggtacccttcgtacggggtttctagtttccgtcctttctcgtcggcctaccgtaaaacgttctaacgaccaaaccgtacccggtccctaccccgtacgaactaaacgttcctcgtcggggtccttcccggaaggtcccgtagggacgggaccggagggtcttaggtatttaacgttaccgtggggtcttcggtaccttacctaagttaagcgtacgtaagtacggttcggtaccgtaccgtccggttccgggttagggttaccggttaccggggacggggtaaccgggtaaccggttaacgggttccgttacccggttaacggtacggtaacccgaaccggacccgttaccggtcccgttccccgtccccg

SEQ ID NO: 396796 - DNA, 729 bp, Homo sapiens
  misc_feature: GZ8MTXP01DQROI.9.53.E09.1.454.CMB.2.raw
  modified_base (215)..(215): a, c, t, g, unknown or other
  modified_base (232)..(232): a, c, t, g, unknown or other
  modified_base (256)..(256): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacgagggtcctcgggcccagttctcgccctgactcagcctgcctccgtgtcgtggtctccgtggacagtcgatcaccntctctgcacgtgaaccngctagtgattggttagggtattangtaccttgtctccgtaggtaccaacacgccaaccgaggaaccaaacccgacccccaaactacctactacctaattttacgaggtaacggtaccaacgtaacggtcccggtccttcggttacgggttttctacgtttccgtcctttccgtcgtcggtacctaccgtaaacggttctaacgaaccaacccgtacccggtcccttaccgtagacctaacttccttcgtacgggtcctaccggacggtcttacggggacggtaacggacggtcttagttaactttacgttaccgtcggggtcttcgtactactaagttaccgtcgtacgtaagtacgtcggtaccgtaccgttccggttccgggttagggttaccgggtaccggggttacgggtaaaccgggtaaccggttacgggttccgttacccggtaacggtacgaaccgaccggtaccgttaccgtcccgttccccgtcccg

SEQ ID NO: 396797 - DNA, 590 bp, Homo sapiens
  misc_feature: GZ8MTXP01DZKHA.9.53.E09.1.454.CMB.2.raw
  modified_base (471)..(471): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacgagggtcctgggcccagtctgccctgactcagcctgcctccgtgtctgggtctcctggacagtcatcaccatctctgcactggaaccagcagtgattgttgggattatgtaccttgtctctggtaccaacagcaccgaggacaaacgccccaaatcatcatttatgaggtcaacgtaacgccggacctcgtacggggtttctagttccgtccttctcgtggtcctcaaaagtctcgacaaccgacgccctcctgaactaacttctcgtcggtctcgaggcgtagaaggacgaggctgtaactttatacttgggcttcgtcctataatgttcgnaagtagtggtaccgaccgtccgttcccggttgttacggtttcgggacggaacgggacgttaaacgggttcgaccgtccggttagtccgacggacccgaacggtcccgttccgtcccccg

SEQ ID NO: 396798 - DNA, 564 bp, Homo sapiens
  misc_feature: GZ8MTXP01A2JUG.9.53.E09.1.454.CMB.2.raw
  modified_base (311)..(311): a, c, t, g, unknown or other
  modified_base (436)..(436): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctctgcactggaaccagcagtgatggttgggagttatgaccttgtctcctaggtaccaacagcacccaggaccaaacgcccccaaactcatcatttangaggtcactaagccgcctgtacggggtttctacttcgcttctcgtggtacctccgaagtctagaccaacgaccggtcctcctagacaactcctcgtcgggctccgacggctaggacgggaacggngtctagtattagttactgtctgctcatactggcagtacgtggtcgaacctccgttcccggtggttacgtcggggacggacgggacttacgggtcgaccgtccgaggtccgacggcccgaaggtccccg

SEQ ID NO: 396799 - DNA, 534 bp, Homo sapiens
  misc_feature: GZ8MTXP01BD3TO.9.53.E09.1.454.CMB.2.raw
  modified_base (403)..(403): a, c, t, g, unknown or other
tcagtgatacgtctcacgaccggtgctcgatttagagagagtgtggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacttgtctctggtacaacagcaccaggacaaacgcccccaaactcatctatttatgaggtacactaagcggccctcgtaggggtttctagttcgtcttcctctggctcaagtctgaacacaccgcctcctgacatctctgggctcgagctggaggacgngctagattatactgcgtgctacatatgactagatggtcactaccgtccggtggtacgttcggggacggttacgggaccaagggttcgccggttcgtaacggcaacgtcccgaggccgtccgccccgttcgg

SEQ ID NO: 396800 - DNA, 700 bp, Homo sapiens
  misc_feature: GZ8MTXP01BSUCV.9.53.E09.1.454.CMB.2.raw
  modified_base (576)..(576): a, c, t, g, unknown or other
tcagtgatacgtctcacgaccggtgctcgatttagagagagtgtggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccagcagtgagttggttgggatttatcgtacctttggtccttccgtacggtaacccaaacacgaccaacccaaggaccaaaaccgaccccccaaaactcaactactaattttagtcggtaacggtacaaccgtaaacggcccggtacccgttacggttagggggttttccttagttccgtctttccctcgtcggtctacctaaagttcctacgaaccaaaccgacccgggtcccttaccccgtagtaacctaacttccgttccggtcggggtacccttcccggagggtccgtagggaacgggaccggtaagggtccttaggtactttacttaacgtcgcgttagtccttataagttntcgagtaaggtagttcggtaccgtaactcccgttccggtaaggtcgttcgggggacggttacgggacgtacggttcgttaccgttcgaaggtccaacgccgacgccgtaaccgccccgtaaccg

SEQ ID NO: 396801 - DNA, 736 bp, Homo sapiens
  misc_feature: GZ8MTXP01AYVGG.9.53.E09.1.454.CMB.2.raw
  modified_base (230)..(230): a, c, t, g, unknown or other
  modified_base (327)..(327): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtcgtggtctccgtggacagtcgatcaccatcctctgcactggaaccngctagtgagttggttagggattatgtaccttgtctccgtaggaccaacgacgaccaacccaggaccaaaccgacccccaaatctactactaatttanagagtacaacgtaacgccggtacccttaggtacgggtttactacgtttccgtcctttcctcgtcggtcctaccgtaaacgttacctaacggaaaccaaacccgtacccgggtaccccctacccgtacggaaaccttaacgttcccgtaccggttcgggacccgttaccccggtaaagggccgttaacggggaaacgggacccggtaaagggtccttaagttaaactttacgttaaccggtcggggtaacttcggtacctttaaacgtaacgttagtacgacgtaaggtcgttacggtacgtaccgtcggtccggttacggttacgggtcgggacgggtaacggtaacgttacgggttccgttaccggtcgtacgtaaccgaccgacccggacgtcccgttcccgtcccg

SEQ ID NO: 396802 - DNA, 565 bp, Homo sapiens
  misc_feature: GZ8MTXP01AV794.9.53.E09.1.454.CMB.2.raw
  modified_base (228)..(228): a, c, t, g, unknown or other
  modified_base (307)..(307): a, c, t, g, unknown or other
  modified_base (424)..(424): a, c, t, g, unknown or other
  modified_base (437)..(437): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttgggattatgaccttgtctcctaggtaccaacagcacccaggcaaacgcccccaaactcatcattangagtcactaagcgcctgtagggtttcattcgtcttctctgctcaaagtctgacacacggcctcctgacatctcgtgggctccgagcgtagacggtacgagggctgtaattattaccngggtctggcctanattagcgagtagtacgtggtacgtaccgtacgttccggttaggttacggtcgggacgggtaacgggtaaccgagggttccgaccgtaacgtacggtccgacggaccgttacgtccgttcccgtccccg

SEQ ID NO: 396803 - DNA, 687 bp, Homo sapiens
  misc_feature: GZ8MTXP01E1K08.9.53.E09.1.454.CMB.2.raw
  modified_base (229)..(229): a, c, t, g, unknown or other
  modified_base (267)..(267): a, c, t, g, unknown or other
  modified_base (303)..(303): a, c, t, g, unknown or other
  modified_base (373)..(373): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccngcagtgatgttgggattatgacttgtctctggaccaangccaccaggccaaacgcccccaaatcatctatttangagtcactaagcggtcctgtagggtttctacttcgtccttctctggtactccaaaagttctgaccaaacnccgggccctaccccgacaactcctcgtcgggcctacccgagtccgtaggaacggggacgtacgggtaccttaggtaactttaacgtttacctcgggtaccttaggtcccttacgttaattaaccgttagacccgtaaggtaacgtacgggttacggtaacctaacccggttcccgggtttaagggttacggtttcggggaaccgggttaacggggaaaccgtaacgggttccggttaaacccggttcccgttaagggtcccgaaccgggaccccgaacgggttccccgtcccggttccccccggtttaaccggg

SEQ ID NO: 396804 - DNA, 524 bp, Homo sapiens
  misc_feature: GZ8MTXP01DXICB.9.53.E09.1.454.CMB.2.raw
  modified_base (224)..(224): a, c, t, g, unknown or other
  modified_base (371)..(371): a, c, t, g, unknown or other
  modified_base (419)..(419): a, c, t, g, unknown or other
  modified_base (426)..(426): a, c, t, g, unknown or other
  modified_base (435)..(435): a, c, t, g, unknown or other
  modified_base (441)..(441): a, c, t, g, unknown or other
  modified_base (445)..(445): a, c, t, g, unknown or other
  modified_base (447)..(447): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccatctcctgcactggaaccngcagtgatgttgggatttatgaccttgtctcctggtaccaacagcaaccaggcaaacgcccccaaatcatcattatgagtcactaagcggcctgagggtttcattcgccttctctggctccaaagtctgacaacaccggacctcccngacaatctctgggctccgaggctagacggacagggcttgattattacnggtctgntacatacgngcaagntggncncgtccgtgttacgtcgggcggaggaccgaggttcgttaccgtcgtaggtccacgccgacggtccgttccggtccccg

SEQ ID NO: 396805 - DNA, 697 bp, Homo sapiens
  misc_feature: GZ8MTXP01EQ8CE.9.53.E09.1.454.CMB.2.raw
  modified_base (258)..(258): a, c, t, g, unknown or other
  modified_base (329)..(329): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcacctattctcctgcacgtaggaaccagcagtgagttggttgggattangtaccttgtctccgtaggtaccaacacgccaacccgaggaccaaaccgacccccaaatcaatactatttangtacggtacaacgtaacgcgtcctggtacgggtttctacttccgtcttcgtcgtcggtaaccttaccgtaacgtcgtaacgaacctaaccgacccgggttccctaccgtagtaacctaacgtccgtacggttcgggaccttacgagggtcctagggaacggtacggacggtactaagttaactttacgggttactggtactcgacttcgaattagacgtagagtaagttcggaacgtaacctaaccggtttcccggggtaaggttacgggttccggggaaccgggttaggggttaaacccgttaggggtaacccggtacccgttcgttaaacgggtccgttaaccggaacccgttaacggggtccccg

SEQ ID NO: 396806 - DNA, 618 bp, Homo sapiens
  misc_feature: GZ8MTXP01BOAJP.9.53.E09.1.454.CMB.2.raw
  modified_base (229)..(229): a, c, t, g, unknown or other
  modified_base (312)..(312): a, c, t, g, unknown or other
  modified_base (488)..(488): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgtcctgactcagcctgcctccgtgtctggtctcctggacagtcatcaccatctcctgcactggaaccngcagtgatggttgggagttatgtacttgtctcctggtaccaacacgcacccaggaccaaacgacccccaaactcatctattangagtacactaagccgcctgtacgggtttctacttcgtcttctcgtcgacctaccgaagtcctagaaccaaccgtaccggccctacccacgtaactaactccgtcgtcgggccttcgaaggtcgtaggacggacgagggtctagtaactttagttactggtctgtccttagagtagngtacgtagtacgtcggtctaaccgtacgttcggtaggttacggtacgggacgggttaacgggttaccggttaacgggtaaccggtaccgtaaccggtacggtaccgaccggtaacccgttaacggtcccg

SEQ ID NO: 396807 - DNA, 740 bp, Homo sapiens
  misc_feature: GZ8MTXP01AD3L7.9.53.E09.1.454.CMB.2.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtcctgccctgactcagcctgcctcgtgtctgggtctcctggacagtcgatcaccatctcctgacacgtcggaaccaggcaggtgagttgggttgggtattatgtaccttcgtctctacggaaccaacacgaccaccacggaccaaaccgacccccaaatcatctatttaagtggagtaccacgtaacgccggtccttaggttacggtttctacgtttccggtacctttcgtcgtcgggtccttaccctaaaaggttcctaagaaacccgaaacccgtaccgggtcccccttacccgtagaaacctaacttccgtcggttcggacccgtaccgtagggtccggtaagggacgggaaccgtagggtaccttaggtaactttacgttcgacggggttctcgtacttactaagttgacgacgttaaagacgttcggggtaacctaccgtcccgtttaacccgggttgggttacggttaccggggacggggaaaccggggtacgttaacgggttccggttaccccgggtttaacggtacgtaaccgggacccgtaaccggaccggttccccgttcccgggttcccccgg

SEQ ID NO: 396808 - DNA, 522 bp, Homo sapiens
  misc_feature: GZ8MTXP01B60U1.9.53.E09.1.454.CMB.2.raw
  modified_base (227)..(227): a, c, t, g, unknown or other
  modified_base (246)..(246): a, c, t, g, unknown or other
  modified_base (301)..(301): a, c, t, g, unknown or other
  modified_base (430)..(430): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattangaccttgtctcctggtaccaacagcaccaggcaaagcccccaaatcatcatttangaggtcactaagcggcctgaggggtttctattcgccttctctggctccaaagtctgacaacacggcctcctgacaatctctgggctccgaggctaggaggacgaggctgattatactggctgctcaatntgcagatggtgaccacgtcccgtggttacgttcgggcggtacgggaccaagggttcgacccgtctaggtcacggcccaggccttcgcccccg

SEQ ID NO: 396809 - DNA, 524 bp, Homo sapiens
  misc_feature: GZ8MTXP01EEF9R.9.53.E09.1.454.CMB.2.raw
  modified_base (227)..(227): a, c, t, g, unknown or other
  modified_base (244)..(244): a, c, t, g, unknown or other
  modified_base (260)..(260): a, c, t, g, unknown or other
  modified_base (292)..(292): a, c, t, g, unknown or other
  modified_base (339)..(339): a, c, t, g, unknown or other
  modified_base (346)..(346): a, c, t, g, unknown or other
  modified_base (357)..(357): a, c, t, g, unknown or other
  modified_base (416)..(416): a, c, t, g, unknown or other
  modified_base (422)..(422): a, c, t, g, unknown or other
  modified_base (431)..(431): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatcctcctgcactggaaccngcagtgatgttggattngacttgtctctgacanagcaccagacaacgccccaaatcatcatttangagtcactagcgcctgtaggtttcattcgcttctgtgctcaaagtcngacaacncgcctccgtanactactctcgtggctcgaggctaggaggacgaggctagtattatacgtggtctgcctanatatgnagtagtggntaccacgtcccgttggttacggtcgggacgggacgggtaccttagggttcgttaccgtcgtaggtccgacggccgaagtccgttccgtccccg

SEQ ID NO: 396810 - DNA, 669 bp, Homo sapiens
  misc_feature: GZ8MTXP01DAYJN.9.53.E09.1.454.CMB.2.raw
  modified_base (224)..(224): a, c, t, g, unknown or other
tcagtgatacgtctcacgaccggtgctcgatttagagagagtgtggttgggggggtcacaagaggcagcgctctcgggacgtctccaccatggcctgggctctgctgctcctcaccctcctcactcaggacacgagggtcctgggcccagtctcgccctgactcagcctgcctcgtgtctgggtctcctggacagtcgatcaccatctcctgcacgtggaaccngctagtgagttggttcggggtaattatcgtaccttcggtcttccgtacggtaccaacacgaccaacccgaggaccaaaccgacccccaaaactcaactactatttagtgacgtacacgtacggccggtccctgtagggtttcttacgtcgtcttcctctggtctacgaacgtctacgaacaacgacccggtccctacctagactactctcgtggctacgacgcgtagaggacgtaggtctagtattacgtacgtcgtcgtacgtcttactagtacgtcgtagtaggtacgttacgggtactaacccggtaccggttcccgggttaacggttacggttaccgggggaacggttaaccgggaaaccgggtacggttaccggccggttaccggtaacggtaccgaaccgggaccgtaccggttccgtcccggttaaccccggtttccg

SEQ ID NO: 396811 - DNA, 735 bp, Homo sapiens
  misc_feature: GZ8MTXP01E1H1Y.9.53.E09.1.454.CMB.2.raw
  modified_base (282)..(282): a, c, t, g, unknown or other
tcagtgatacgtctcacgaccggtgctcgatttagagagagtgtgttggggtttgggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcacgtcggaaccagcagtgagtggttgggtattatgtaccttgtcctaccgtaggaaccaacncgaccaacccgacggaaccaaaccgacccccctaaaatcaattactaatttagacggaacggttaccaaacgtaacggcccggtaccccgttacgggttaggggttttccttacgtttccgtcccctttccgtcgtcggtacccttacccgtaaaacggttcctaacggaaacccaaacccggtacccgggtaccccttaccccgtaggtaaaccttaacgttccgtttacggggccctaccggagggcctagggaacgggtaaccggtaggtcttaaggtaactttacgtacgtcggacttcggtacctagtaatagtcgacgtaaggtaccggtggtacgaccgtaccggttccgggtaaggttacggttccgggggacggttaacgggaccgtaaggttcgttaccgttcgtaaggcaaccgtcccggagcccgtcccgttccccggtcg

SEQ ID NO: 396812 - DNA, 804 bp, Homo sapiens
  misc_feature: GZ8MTXP01DN3KQ.9.53.E09.1.454.CMB.2.raw
  modified_base (230)..(230): a, c, t, g, unknown or other
  modified_base (283)..(283): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcacgtcggaaccngcagtgagttggttagggattatcgtaccttgtcctccgtacggtaaccaacncgaccgaacccgaacggaccaaaaccgacccccctaaaactctaatactaattttaacgtgtaacggtacctaacgtaaccggccggtaccccttacggttacggggtttctacttccgtccctttctcgtcggtcctaccctaaagttctcggaaacctaaacccgtacccgggtcccttccccgtacgaaacttaaacttcccttacggtcgggtcccgttaccgaacgggtccgtaaggggaacgggtaccgggtaaggttccttaagttaactttaacgtttaccgtcgggggttacccgtttacgttaaccgttaacgttaagttacgtacggtacgtaacgggttacggttacgggtaccgttaacccgttcccggtttaacccgggttagggttaccgggttaccgggggacgggtaaaccgggtaacggttaacgggttccggttaccccggttaaccggtaacggtaacccgaccggtacccggttacccggtccccgttccccggtccccg

SEQ ID NO: 396813 - DNA, 582 bp, Homo sapiens
  misc_feature: GZ8MTXP01B37RE.9.53.E09.1.454.CMB.2.raw
  modified_base (209)..(209): a, c, t, g, unknown or other
  modified_base (224)..(224): a, c, t, g, unknown or other
  modified_base (310)..(310): a, c, t, g, unknown or other
  modified_base (366)..(366): a, c, t, g, unknown or other
  modified_base (388)..(388): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccntctctgcatgaaccngcagtgattggttggggattatgtaccttgtctcctaggtaccaacagccacccgaggaccaaacgcccccaaatcatcatttagngagtcacgtaacgcggtcctgtagggtttctattcgtccttctctgctcaaagtcngacacacgcctcctgacactcncgtcgggctcgagctaggaggtacgaggtctagtattacttacgtggtcttgaccttcatagtcgcgtaagtgtggtacgacctaccggtcccggttgggttacgttcgggacgggtacgggaaccgacggggttcgacccggttccgtacgggtaacccacggccccgttaacggtccgttcccgtcccccgg

SEQ ID NO: 396814 - DNA, 629 bp, Homo sapiens
  misc_feature: GZ8MTXP01CDLBR.9.53.E09.1.454.CMB.2.raw
  modified_base (248)..(248): a, c, t, g, unknown or other
  modified_base (271)..(271): a, c, t, g, unknown or other
  modified_base (307)..(307): a, c, t, g, unknown or other
  modified_base (344)..(344): a, c, t, g, unknown or other
  modified_base (376)..(376): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacgagggtcctgggcccagtctgccctgactcagcctgcctcgtgtctgggtctccgtggacagtcatcaccatctcctgcactaggaaccagcagtgatggtggattangtacttgtctctaggaaccaacngaccaccaggacaaaccgaccccaatcatctattangagtacacgtacgcgcctgtaggttctatcgtcttcngtcgctacaaatctgacaacgcgtcctcgtanacactctcgtcgggctaccgaggtcgtaggacgggtacgtacggtacttacgtaatttacgttacgtggtacgttcgtacctagtagtacgtgacgtagtacgttcggtacgtacctacccggttcccggttggttacgggttccggggacgggtaaacgggtaccgttaaacggggttccgttaacccggttaaccgttacggtaacccgaaccggtacccgttaacgggtccccgttcccggttcccccgg

SEQ ID NO: 396815 - DNA, 570 bp, Homo sapiens
  misc_feature: GZ8MTXP01EPOXI.9.53.E09.1.454.CMB.2.raw
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacacgcaacccaggaccaaacgcccccaaatcatctatttatgaggtcactaacgcggtcctcgtagggtttctattcgtccttctctgtctcaaagtctgacaacacgcctcctgacactctcgtcgggctccgaggctaggaggtacgaggctagattattactggtctgctcatactgcagagttgggtacaccgtaccgtcccggttgggttacgttcggggacgggagggtaaccgttaaggggttcgaacccggttcgtacgggtccacggccccgaaggtcccgttccgtcccccgg

SEQ ID NO: 396816 - DNA, 658 bp, Homo sapiens
  misc_feature: GZ8MTXP01EB883.9.53.E09.1.454.CMB.2.raw
  modified_base (229)..(229): a, c, t, g, unknown or other
  modified_base (324)..(324): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttgggatttatgtaccttgtctcctggtaaccaacacgccaacccgaacggaccaaaccgcccccaaaactcatctaattttancggagtacactaacggccgtacctgtacggggtttctattcgtccttctcgtggactccaaaacgttctaagacctaaacgaccgtcctaccacgaactacttctcgtcgggctccgaggccgtaggacggtacgacgtcgtagtaatttacttacgtcgggtcttagtctactaagttagtcgagtaggtacgtcggtacgtaccgtcccggttaaccgggttacgggttacgggtaccggggaacggtaacgggtaaccggttaacgggttccggttacccggttaacggtacggtccgaccggtacccgacggtccccgttcccgtccccg

SEQ ID NO: 396817 - DNA, 678 bp, Homo sapiens
  misc_feature: GZ8MTXP01ET44D.9.53.E09.1.454.CMB.2.raw
  modified_base (231)..(231): a, c, t, g, unknown or other
  modified_base (275)..(275): a, c, t, g, unknown or other
  modified_base (314)..(314): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcaccatctcctgcacgtggaaccngcagtgtattggttagggattatgtaccttgtctctagaccaanacgcaaccagaccaaaccgcccccaaatcatactattangagtacactaacgcgtccctagttacgggtttctacgttcgtcccttctcgtcggtacctacccgtaaaagttcctaacgaacccaaaccgtcccgtccccttaccctagaactaactccgtcgtcgggcctccgaaggccgtaggaacgggtacgacggtacttagttaatttaacttaccgtgggtccttgtacctaacgtaataacgttgacgttaaaggtcgtgggttaccaaacccgttcgttaacccggtttaggttaacggttcggggaacgggaacggggtaaccgttaacgggttccgacccggtttaaggacgtaacccgaacgtccccggaacgtcccgttcccggtcccccg

SEQ ID NO: 396818 - DNA, 590 bp, Homo sapiens
  misc_feature: GZ8MTXP01DJS2A.9.53.E09.1.454.CMB.2.raw
  modified_base (235)..(235): a, c, t, g, unknown or other
  modified_base (254)..(254): a, c, t, g, unknown or other
  modified_base (290)..(290): a, c, t, g, unknown or other
  modified_base (298)..(298): a, c, t, g, unknown or other
  modified_base (533)..(533): a, c, t, g, unknown or other
  modified_base (577)..(590): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgttatttttagcaggtggggacaccaaactacacgcccctccctcaagagtcgagtcaccatgtcagtagacacgtccaaagaaccagatcctccctgaagctgacctntgtcgacccgccgcggacncggccgtgtattactgtgcgagacttcccaaaatanagacaacngcttggtactatttccttttagattagtggtcgggggaccaaaggggactaagtcggtcctaccgtctcttcacgccctaccaaccccgaacggggccctagttcccggtcccttcccccccgtgggccccgtccctcggccctacccgaagggcgaccaccccgtccgagacgcacgcggccggccgtgggctcgccgtcgggtcaaaggtccttacgttaccagtaaccgtanccgacgtggacggccgggtgtcgggacaacggcgaacagttggnnnnnnnnnnnnnn

SEQ ID NO: 396819 - DNA, 626 bp, Homo sapiens
  misc_feature: GZ8MTXP01DFQ4E.9.53.E09.1.454.CMB.2.raw
  modified_base (228)..(228): a, c, t, g, unknown or other
  modified_base (304)..(304): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactggaaccngcagtgatggttgggattatgacttgtctctggaccaacagcaacccaggaccaaacgccccaaactcatcattangaggtcactaacgcgcctcgtagggtttctattcgtccttctctcgctcaaagtctgacaacacggcctccctagacaactctcgtgggcctcgaggcgtaggacgggtacgacggtactagtaactttacttacgtcggtccgttgtacctacgtaatacgtgtacgaagtaggttacggtacgtacccgttaccggttcccggttagggttacggttccggggacggggtaacgggtaaccgttaaacgggttccgttaacccggttaacgttaaccggcgtacccggacccgttacggtcccgttcccggtccccccgg

SEQ ID NO: 396820 - DNA, 666 bp, Homo sapiens
  misc_feature: GZ8MTXP01AVW5B.9.53.E09.1.454.CMB.2.raw
  modified_base (224)..(224): a, c, t, g, unknown or other
  modified_base (273)..(273): a, c, t, g, unknown or other
  modified_base (315)..(315): a, c, t, g, unknown or other
tcagtgatacgtctcacgaccggtgctcgatttagagagagtgtggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctccgtggacagtcgatcaccatctcctgcactaggaaccngcagtgagttggttgggagtttatgtaccttgtctcgtaggtaaccaancgaccaacccgaggaccaaaccgccccaaatcatctatttangacgtacactacggcgacctgtaggtttctagtcgtcttcctcgtgctcaagtctacgaacacgtacccgcctcccgtagacctatccgtacgtgggccttacggcgggtcgtaggaacgggcggtagggtactaggttatttaacgttacgtgaccttgtaccttcaagttgcgacgtaaggtcgtacgggtactacccggtaccgtttcccgggttaaggggttaccggttcggggggaccgggttaacggggaacccgttaacgggggttccgttcccggttaccggtaacgggtacctaaccggggtaccccgaccgggttcccgtccccggttccccgtttcccgg

SEQ ID NO: 396821 - DNA, 630 bp, Homo sapiens
  misc_feature: GZ8MTXP01DCJEV.9.53.E09.1.454.CMB.2.raw
  modified_base (200)..(200): a, c, t, g, unknown or other
  modified_base (229)..(229): a, c, t, g, unknown or other
  modified_base (268)..(268): a, c, t, g, unknown or other
  modified_base (281)..(281): a, c, t, g, unknown or other
  modified_base (326)..(326): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtcgtggtctcctggacngtcgatcaccatctcctgcacgtgaaccngcagtgattggtgggattatgtcttgtctctggacacancaccagacaaccnccccaatcatctattatgagtcactacgcgcctcgtaggtttctnttcgtccttctctcgtctactaaagtctcgacaccaccggtccctcctagtacctaactccgtcgtcgggtacctccgaggtccgtagggacgggtacgtacgggtacgttagtaatttaacgttccgtcgtcgttactccttaacgtattacgttggacgtaaggtcggttcggtacgtaaccttcccggttaacccgggttagggttaccggttcggggaccggggttaaacgggaccggttaacgggttcgttacccggtcgtacgccgaaccggccgaacggtcccgttcccgtccccgg

SEQ ID NO: 396822 - DNA, 705 bp, Homo sapiens
  misc_feature: GZ8MTXP01AWYGD.9.53.E09.1.454.CMB.2.raw
  modified_base (229)..(229): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacgagggtcctgggcccagtctgccctgactcagcctgcctcgtgtctggtctccgtggacagtcatccacctatcctctgcactggaaccngcagtgattggttagggattatgtaccttgtctcgtacggaccaacacgccaaccgacggaccaaaccgcccccaaactcatactatttatgacggtacacgtaacgccgtccgtagtacgggtttctacgttcgtccctttcgtcgtcggccttaccgaaagttccgtaagaaccaaccgtacccggccctacctacgaactaacttcctcgtcggctcgaggtcgtaggacggacgtaggtcttagtactttagttactcggtctcggtctactagttacgcgtacgaacgtaggtggttaccgtaccgttacccggttcccgggttaggttaccggggtttacccggggaccgggtaaaccgggggtaacccgttaacggggttaccggttaccccgttaaccgggttaacgggttaaccccgtaaccggaccccggttaaacgggtccccgttcccgggttaacccccccgg

SEQ ID NO: 396823 - DNA, 600 bp, Homo sapiens
  misc_feature: GZ8MTXP01B2ZCU.9.53.E09.1.454.CMB.2.raw
  modified_base (228)..(228): a, c, t, g, unknown or other
  modified_base (249)..(249): a, c, t, g, unknown or other
  modified_base (384)..(384): a, c, t, g, unknown or other
  modified_base (440)..(440): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttgggattangtaccttgtctcctggaccaacagcacccaggcaaacgcccccaaatcatcatttatgagtacactaaggccggtcctgtaggggtttctagttcgtccttctctcggtctccaaagtctgacacgacgcctccngacatctctggctcagctaggaggacgaggctagtacttattcgtaggtctgcctntatcgtgactaggatgggtacgacctccggttccgggttgggttacggtttccgggacgggtaacgggggtaaccttaaacgggggttcgttaacccgggttccgttagggtaaccgaccgggtacccgaacggggttcccttaacccgggttccccccg

SEQ ID NO: 396824 - DNA, 591 bp, Homo sapiens
  misc_feature: GZ8MTXP01AKG6P.9.53.E09.1.454.CMB.2.raw
  modified_base (224)..(224): a, c, t, g, unknown or other
  modified_base (267)..(267): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctggtctcctggacagtcgatcaccatctctgcactggaaccngcagtgagttggttgggattatgtacttgtctctggaccaacngcaccaggacaaacgccccaatcatcattatgagtcactaacgcgcctgtacgggttctagttcgtcttctcgtcggtcctactaaagttctcgaaccaaccgaccgggcccctaccccgaactaactccgtcgtcgggcctccgaggctaggacgggacgaggtcttgtattattacgtgcttgtcttctattagtcgacgtaggtaacgttggtacgaccgtaccgttcccggtaagtacgttcgggcggaacggtacgaaggttccgaccgcccgtaaggtcgaaccgtcccgaacggttccctaaccgttccccgttccg

SEQ ID NO: 396825 - DNA, 590 bp, Homo sapiens
  misc_feature: GZ8MTXP01BFB6J.9.53.E09.1.454.CMB.2.raw
  modified_base (228)..(228): a, c, t, g, unknown or other
  modified_base (303)..(303): a, c, t, g, unknown or other
  modified_base (364)..(364): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccngcagtgatgttgggattatgaccttgtctcctggaccaacagccaccaggacaaacgccccaaatcatcatttangaggtcactaagcggcctgtagggtttctattcgccttctcgtgctcaaagtctgacaacncggctcctgacatctcgtgggctcgaggctaggaggacgaggctgtattatactggctgctacatagtgacagtagttcggtacgtaaccgtccgttcccgggttaggttacggtttccggggacggggtaacggggtaacccgaacggggttcggaccccggttaaccggtacgggttaaccgaccgggtacccgaaacggggtcccttcccgggtcccccccgg

SEQ ID NO: 396826 - DNA, 638 bp, Homo sapiens
  misc_feature: GZ8MTXP01CQ5YZ.9.53.E09.1.454.CMB.2.raw
  modified_base (285)..(285): a, c, t, g, unknown or other
  modified_base (291)..(291): a, c, t, g, unknown or other
  modified_base (303)..(303): a, c, t, g, unknown or other
  modified_base (306)..(306): a, c, t, g, unknown or other
  modified_base (308)..(308): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtcgtgggtctccgtggacagtcatcaccatctctgcactggaaccagcagtgtagtgtggactattataccttgtctctgatacaacacgaccagacaaccnccccanactacttaattngananacacacgcgtcctgtacgggttctcggtctcccgttctctcgtccctacgtaaacgtcgtaacggaccaaccgacccggtccctaccgacgaactacgttcttcgcgggcctacgcgtcgtagacggacgagtctataactttagtaacgtcgacgtagtcctagtaaattgtcggtactttaacgggttttccgttaccctttagttaaacctaaaggtaacgttacgggttccggggacggggttaaccgaccggtacggttccgttccgttaaccggttcgacggtcgaccgacccggttacccgaacgggttcccttaacccccgg

SEQ ID NO: 396827 - DNA, 635 bp, Homo sapiens
  misc_feature: GZ8MTXP01AKS4U.9.53.E09.1.454.CMB.2.raw
  modified_base (197)..(197): a, c, t, g, unknown or other
  modified_base (315)..(315): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctcgtgtctgggtctctggacngtcgatcacatctcctgcacgtggaaccagcagtgagttggttggggatttagtgacctttgtctcctaggtaccaacacgacacccaggaccaaacgcccccaaactcatctattangagtcaactagccggtcctcgtagggtttctacgttcgtcctttctctggtcctacgtaaagtctcgaaccaaccgaccgggtcccctacccggacaaacttcctacgtcggcctccgagggccgtaggacggtaccgagtcctagtactttactacgtgtcctgcctactagttatgactagtacgtcggtacaccgtcgttccggttaaggtacggttaccggggacgggttacgggtaaccgtacgggttaccgttccggttacgtaacggtaccgtaaccggacccggtacggttcccgtcccggttccccgttcg

SEQ ID NO: 396828 - DNA, 533 bp, Homo sapiens
  misc_feature: GZ8MTXP01ERZ9U.9.53.E09.1.454.CMB.2.raw
  modified_base (229)..(229): a, c, t, g, unknown or other
  modified_base (312)..(312): a, c, t, g, unknown or other
  modified_base (351)..(351): a, c, t, g, unknown or other
  modified_base (371)..(371): a, c, t, g, unknown or other
  modified_base (394)..(394): a, c, t, g, unknown or other
  modified_base (406)..(406): a, c, t, g, unknown or other
  modified_base (418)..(418): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttggggattatgacctttgtctcctggtaccaacacgcaacccaggccaaacgcccccaaatcatcatttangagtcactaagcgcctcgtagggtttctattcgcttctntggctcaaagtctgacaacncgcctcctgacatctctggctcngctagaggacgngctgattatacnggctgctacgatatgcaagtctggtcaactccgtccggtgttacgtcgggcggtacggaccgaaggttccgaccgtccgtaggtccgacgacccgaaggtcccgttccgcccccg

SEQ ID NO: 396829 - DNA, 695 bp, Homo sapiens
  misc_feature: GZ8MTXP01BA1Y7.9.53.E09.1.454.CMB.2.raw
  modified_base (199)..(199): a, c, t, g, unknown or other
  modified_base (229)..(229): a, c, t, g, unknown or other
  modified_base (302)..(302): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacngtcgatcaccatctcctgcacgtggaaccngcagtgatggttgggattatgacttgtctctggaccaacagccaccaggccaaacgccccaatcatcatttangagtcactaacgcgcctgtagggtttctacgttcgtcctttctactcggcctaccgaaaacgttcctaacggaaccaaacccgtacccgggacccttccccgtacggaaacctaaacttcccgtttcgtcgggggaacccttccgggaggtacgtacggggaaggtacccggagggtacctagttaatttagttacgtcgggttacttgcttaccgtaatcgttaggaccgtaagtagtcggtacgtaaccgtcccggttcccggttagggttacggttcccggggacgggggaaaccgggtaaccggttaaagggttcccggttaccggttaacccggtacggtcccggaacgacccgggttaacgggtcccttaaccccggggtccccccg

SEQ ID NO: 396830 - DNA, 624 bp, Homo sapiens
  misc_feature: GZ8MTXP01AYIYK.9.53.E09.1.454.CMB.2.raw
  modified_base (589)..(589): a, c, t, g, unknown or other
tcagtgatacgtctcacgaccggtgctcgatttagagagagtgtggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcatcaccatctcctgcactggaaccagcagtgagttggttgggattatgtaccttcgtctccgtaggtaaccaacacgccacccgaggaccaaaccgacccccaaatcatctattatgagtcacgtaagccgcctggtaggttctacgttcgtcttcctctcggctactaacgtctacgaaccaaacctaccgggtccctacccgtagtactaactccgtaccgtgggacctccgaaggtctaggaacggacggagcttaggtaactttacgttacgtcggtctcgtactacctaataccgtgacgtaaggtacgttcggtacgtaaccgtccgttcccggttggtacggttcggggacggacgggtaaacgtaacggttcggacccgttacgnggtccaacgccgtacgccgtcccgcccgttaaccg

SEQ ID NO: 396831 - DNA, 502 bp, Homo sapiens
  misc_feature: GZ8MTXP01CTW51.9.53.E09.1.454.CMB.2.raw
  modified_base (292)..(292): a, c, t, g, unknown or other
  modified_base (332)..(332): a, c, t, g, unknown or other
  modified_base (484)..(484): a, c, t, g, unknown or other
  modified_base (489)..(502): a, c, t, g, unknown or other
tcagtgatacgtctcacgaccggtgctcgatttagagagagtgtgttgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagacgttacccaaatatagacaacagctggtactatttccttttgattagtggtggggaccaagggacaagtcggtccaccgtctcttcacgcccnccacgaacgggcccagtccggtcccttcccccgtggcccncccctgcctccgaggcgccacccgtccggagacgccgaccgacggcccggtcccgttcggggcccttcggccgtgggtaccaaacgggtaacccttaaccttcccgaaggtaaccgtatcgacgtggacgggcgggctgggacagggccganatagnnnnnnnnnnnnnn

SEQ ID NO: 396832 - DNA, 670 bp, Homo sapiens
  misc_feature: GZ8MTXP01A7SKW.9.53.E09.1.454.CMB.2.raw
  modified_base (248)..(248): a, c, t, g, unknown or other
  modified_base (292)..(292): a, c, t, g, unknown or other
  modified_base (302)..(302): a, c, t, g, unknown or other
tcagtgatacgtctcacgaccggtgctcgatttagagagagtgtgttgggtttggggggggtcacagaggcagcgctctcgggacgtctccaccatggcctgggctctgctgctcctcacccctcctcactcaggacacagggtcctgggcccagtctgccctgactcagcctgcctccgtgtctgggtctcctggacagtcgatcaccatctcctgcactcggaaccagcagtgatggttgggattntgtacttgtctctggacacacgcaccaggacaaacgccccaaancatctatttnagacgtacacgtaacgccgtcctacgttacgggtttctacgttcgtccttcctagtcgcctaccaagtcgtcgaacacctccggcctaccgtgaactactccgtcgtacgggtcctacgaggcgtacgggacggtacgtaacggcttaggttaactttacgttacgtcggggttaccttcggtaccctactaaagttcggtccgaacggtaaacgtgggtttaccgggtaccgttaccccgtaacccgggtttccggttcggggttacggttacccgggggacgggaacgggtaacccgttacggggttcgttaacccggtcgttacggccgacggaccccgacggtcccgttaaccccggtcccccg

SEQ ID NO: 396833 - DNA, 635 bp, Homo sapiens
  misc_feature: GZ8MTXP01DKX41.9.53.E09.1.454.CMB.2.raw
  modified_base (199)..(199): a, c, t, g, unknown or other
  modified_base (216)..(216): a, c, t, g, unknown or other
  modified_base (228)..(228): a, c, t, g, unknown or other
  modified_base (273)..(273): a, c, t, g, unknown or other
  modified_base (309)..(309): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtcgtggtctcctggacngtcgatcaccatctccngcactggaaccngcagtgagttggtagggtattatgtaccttgtctctggtaccaancgaccaccaggacaaaccgccccaatcatctattangagtacacgtaacgtcgccttgtacgggtttctagttccgtccttctcgtggtcctaccgtaaagttcctgaaccctaaacgcccggtcccctacccgtgaaactaacttccgtacgtccgggcctaccggaggtcgtagggaggacgaggtcttagtactttagttacctggggtctgtacctatatttagcggactagtacgtggtaacgtctaacccggttccggttgggttcggttaccggggacggtaccgggtaacgttaacgggcggttaacccgtcggttacgccacgggacccttacggtccgttcccggtcccccg

SEQ ID NO: 396834 - DNA, 657 bp, Homo sapiens
  misc_feature: GZ8MTXP01EC0R6.9.53.E09.1.454.CMB.2.raw
  modified_base (226)..(226): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcatggaaccngcagtgatgttgggattatgacttgtctctgacacagcaccaggcaaacgccccaaatcatctattatgagtcacgtaacgccgtcctgtacgggtttctacttcgtcccttctcgtcggcctacaaacgttctcgaaccaacaccggcctcccgtagaactactcgtcgtcgggtctccgaggcgtaggacggacgtacggtctagtaatttaagttcgtggggtctagtccttacgtataacgtcgacgtaggtagttacggacgtaacccgtaaccgttcccgggttaggttaacgggtttaccggggacggggtaaaacggggaacccgttaaaacggggttccgttaaaccccggttaaccggtaaccgggttaaccgtaaccggtaccccggaaacggtccccgtttcccggtaacccccccggg

SEQ ID NO: 396835 - DNA, 554 bp, Homo sapiens
  misc_feature: GZ8MTXP01BRSMM.9.53.E09.1.454.CMB.2.raw
  modified_base (225)..(225): a, c, t, g, unknown or other
  modified_base (244)..(244): a, c, t, g, unknown or other
  modified_base (261)..(261): a, c, t, g, unknown or other
  modified_base (291)..(291): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcacatctcctgcatggaaccngcagtgatgttgggattangacttgtctctggacanagcaccagcaagccccaaatcatcatttangaggtcactaagcgcctcagggtttctagttcgccttctctagctcaaagtctgacaacacggcctcctgacaatctctgggctccgaagctagacggacgaggctagtatttatactgggtctgtctacattaagcgacgagtagtcgtacgtaccgtccgttccggtaggttacggtaccgggacggaacgggtaacgttacgggttccgttaccggtaacgtacggaaccgaccgaccgttacgtcccgttcccgtcccg

SEQ ID NO: 396836 - DNA, 756 bp, Homo sapiens
  misc_feature: GZ8MTXP01AGJAA.9.53.E09.1.454.CMB.2.raw
  modified_base (228)..(228): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctcgtgtctggtctcctggacagtcatcaccatctcctgcactggaaccngcagtgagtggttgggagttatgtacttgtactacgtacggtaaccaacgacgaccgaacccgaaggacccaaaaccggaacccccccaaaacttccgaacttacctaattttaagtacggtaacggtacaaccgtaaacggcccggtaccccgttacggtacgggggtttttccttaccgtttccggtctttaccgtccgttcgggtaaccttacccgtaagttcctaccgaaacctaaaccccgtccgggtcccctacccgtacgaacctaacgttccgttcggtcgggtacccttccgaacgggtcgtagggaacgggaacgaggtaccttaggttaattttaacggttacgtcgttcgtcgttacctaccgtagttatcggaacgtagtaggtccggtacgtaacctacccggttaccggtggttacggttacgggggaccgggttaacgggttaaccggttacgggtccggtacccgttaacggtaccggtaccgaccggttaacccggaacggttcccccgg

SEQ ID NO: 396837 - DNA, 665 bp, Homo sapiens
  misc_feature: GZ8MTXP01AZIDQ.9.53.E09.1.454.CMB.2.raw
  modified_base (231)..(231): a, c, t, g, unknown or other
  modified_base (462)..(462): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtcgtgggtctccgtggacagtcgatcaccatctcctgcactggaaccngcagtgagttggttagggtatttatcgtaccttgtcctccgtaggtaaccaacgcgaccaacccgaggaaccaaaccgacccccaaatcaatctagtttagacgagtacacgtaacggccggtccgtagttagggtttctagttccgctttcctgtcggactaccgtaaagtctaacgaacaacccgtaccggtcccctcctagaactacttccgtcgtacgggctaccgngggactaggaacgggacgagtcgttagttattattaccgtgggtactcgtactactaagtgtagcgtaaagttcgtacgtaccgtaccgtacccggttcggttagggttacggttccggggacgggtaacggtacccggttaaggttccggttaaccgtcggttaagccgtaacgaccgttccggtccgttccccggtccccg

SEQ ID NO: 396838 - DNA, 685 bp, Homo sapiens
  misc_feature: GZ8MTXP01EZSLI.9.53.E09.1.454.CMB.2.raw
  modified_base (310)..(310): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattatgaccttgtctcctggaccaacacgcacccaggaccaaaccgcccccaaatcatcatttangagtcactaacgcgtcctgtagggtttctattcgtccttctctggctccaaagttctgaccaacgccggccctcctagactaactcctcggtcgggactccgaggtcgtaggacgggtacgacggtcttagtaatttagttaaccgtggggtcttcggccttaccagttacgtacgtacgaaggttacgttggggtacccgtaaccgtacccgggtttccccgggttggggttttaaaccgggttccgggggaacggggtaaaccggggtaaccggttaacggggttccggttaccccggtttaacccgggtaaacgggttcccgtaaccggggaccccgaaacggggttccccgttccccgggtcccccccggg

SEQ ID NO: 396839 - DNA, 939 bp, Homo sapiens
  misc_feature: GZ8MTXP01DZOMS.9.53.E09.1.454.CMB.2.raw
  modified_base (238)..(238): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccagcagtnagttggttagggagttatcgtacctttgtcctccgtaggtaacccaaacgacgaccaaccccgaaggaaccaaaaccggaccccccctaaaactctaacttaccgtaagttttagtacgtaacgggttacccaaaccggttaaacgggcccggttcccccgttaacggttacgggggtttttaccttaacgtttcccggttcctttacgttcccgttcggggtaacccttaaccgtaacggttccgttaacgaaacccgtaaaccccgaacccggggttcccccttaccccgtaaaggtaacccttaaacgtttcccgtacgggtacgggggtccctttaaccccgggaagggtacccgttaggggtaaacggggaacccgggtaagggtaccttaagggttaaacttttaaacgggtttaaccccgtttaggggtacccttcggtacccctttaacggaacttaggtttaccggaaccgtaaagggttgtttacgggggacctaaaaccccggttcccggtttccccgggggtttaaagggtttaaaccgggttaccggggggtaaccggggaaaacccgggggttacccgttaaaaacggggggtttccccggtaaaccccgggttaacccggttttaacggggggtaccccttaaacccgggtaacccccgggttaaaacgggggttttccccccccg

SEQ ID NO: 396840 - DNA, 642 bp, Homo sapiens
  misc_feature: GZ8MTXP01E1IJS.9.53.E09.1.454.CMB.2.raw
  modified_base (228)..(228): a, c, t, g, unknown or other
  modified_base (246)..(246): a, c, t, g, unknown or other
  modified_base (263)..(263): a, c, t, g, unknown or other
  modified_base (294)..(294): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctcgtgtctgggtctccgtggacagtcgatcaccatctctgcactggaaccngcagtgatgtgggattangacttgtctctgacacngcacagacaaacgccccaaatcatcatttangaggtcacgtaacgcgtcctagtacgggtttctattcgtccttctctaggctaccgaaaagttctcggaaccaaaccgaacccgggccccttaccccggactaactcctacgtgggcctccgagcgtaggaacggacgacggtctagttattaacgttacgtcgtctcgtcgtactattaaagtgacgtagagttaacggtcggtacctacccgttccggttaacgggttacggttacggggacgggaaacgggtacccgggtaaggttaccgggttaccgttacggtaacgggttccgaaccggtaaccccggaagggttcccgtcccggttcccccgttaaccggg

SEQ ID NO: 396841 - DNA, 683 bp, Homo sapiens
  misc_feature: GZ8MTXP01AEWJJ.9.53.E09.1.454.CMB.2.raw
  modified_base (276)..(276): a, c, t, g, unknown or other
  modified_base (316)..(316): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgactcacatcctctgcacgtacggaaccagcagtgagttggttagggattatgtaccttgtctcctggaccancgaccaccaggaccaaccgaccccaaatcatacgtattangagtacacgtacgccggtcctgtagggtttctagttccgtccttacgtgtacggtctaccgaagtctaacgaacctaccgaccgtcccctcgtagaaccttaactctccggtgggtaccctccgaagggtcgttaaagggacgggtaccgtaagggtccgttacgttaatttacttacccggtggtacgtacgtactacgtaacgtacgtacgtacgtacgtacggtacggtaccgtaccgtaccggttaaccggttcgggttacgggtacgggacgggtacgggtaaccggttaccggttaccggttaccggtaaccggtacggtaaccgaccgtacccggttaccggtcccgttcccggtccccg

SEQ ID NO: 396842 - DNA, 737 bp, Homo sapiens
  misc_feature: GZ8MTXP01AMJJQ.9.53.E09.1.454.CMB.2.raw
  modified_base (237)..(237): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacgagggtcctgggcccagtctgccctgactcagcctgcctcgtgtcgtggtctccgtggacagtcgatccacctatctcctgcacgtacggaaccngacagtgtagttggttagggtattatcgtaccgttgtacctccgtacggtaacccaacgacgaccaacccgacggaaccaaaccgacccccaaatcaactctatttagacggtacgtaccaacgtaacggcccggtaccttacggtacgggttttactaccgttcgtcttcgtccgtcgtaccttacaacgtctacgaccaacgtccgccctacacgactactcgtcgtcggcctacgagtcgtaggacggacgtagtacgtagttacgttaacgttcgtcgttcgtacgttacctacgtaaagttcggtaccgtaggtaacggttacggtacgggtacccgtaacccggttaacccggtttcccggggttagggttacccgggttaccgggggaacggggacccggggttaaaccggttaacgggttaaccccgggtaaaccgttccgggttaacccggtaccgggacccgggtcccggttaaacccggttcccccggg

SEQ ID NO: 396843 - DNA, 502 bp, Homo sapiens
  misc_feature: GZ8MTXP02GV2ZU.9.53.E09.1.454.CMB.2.raw
  modified_base (427)..(427): a, c, t, g, unknown or other
tcagtgatacgtctcacgaccggtgctcgatttagagagagtgtgtttggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagccccaaactcatcatttatgaggtcactaagcggccctcaggggtttctattcgcttcctctggctccaagtctgcaacacggcctccctgacaatctctggctcaggctgagacaggctgattattactgctgctcatatgcagatggtnacactcccgtggtatttcgggcggagggaccaagggtcgaccgtcctaaggtcaagcccaaggctcgcccctcgg

SEQ ID NO: 396844 - DNA, 558 bp, Homo sapiens
  misc_feature: GZ8MTXP02HCDD1.9.53.E09.1.454.CMB.2.raw
  modified_base (369)..(369): a, c, t, g, unknown or other
tcagtgatacgtctcacgaccggtgctcgatttagagagagtgtgttgggtttgggggtcacagaggcagcgctctcgggacgtctccaccatggcctgggctctgctgctcctcaccctcctcactcagacacagggtcctgggcccagtctggccctgactcagcctgcctccgtgtctgggtctcctggacagtcgatcaccatctcctgcactggaaccagcagtgatgttgggattatgaccttgtctctggtaccaacagcaccaggcaaagccccaaatcatcatttatgaggtcactaagcggcctcaggggtttctattcgccttctctggctcaagtctgacaacaccggcctccctanactactctcgtggctcgagctagacggacggagcgtagtattaattacttcgtcgttcgtctactatagtagacgagtagtaggtacgtacgtaccgtaccgttcggttacggtacggtacgggaacgggacgtaacggtacggtaccgtaaccgtacggtacgacgaccgacgtaccgtaccgtcccg

SEQ ID NO: 396845 - DNA, 490 bp, Homo sapiens
  misc_feature: GZ8MTXP02JZZK7.9.53.E09.1.454.CMB.2.raw
  modified_base (480)..(490): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtattttagcagtggggacaccaactacagcccctccctcaagagtcgagtcaccatgtcagtagacacgtccaagaaccagatctcccctgaagctgacctctgtgaccgccgcggacacgggccgtgtattactgtgcgagagttcccaaatatagcaacagctggtacattcctttgatatgtggggccaagggacaatggtcaccgtctcttcagcctccacccaagggcccatcggtctccccctggccgccctgctccaggagcacctccgagagcacagcggccctggggctgcctggtcaaggctactccagacgtatcactgagcgggctggcaaggcgcatagnnnnnnnnnnn

SEQ ID NO: 396846 - DNA, 529 bp, Homo sapiens
  misc_feature: GZ8MTXP02HYEOL.9.53.E09.1.454.CMB.2.raw
  modified_base (294)..(294): a, c, t, g, unknown or other
  modified_base (311)..(311): a, c, t, g, unknown or other
  modified_base (386)..(386): a, c, t, g, unknown or other
  modified_base (421)..(421): a, c, t, g, unknown or other
tcagtgatacgtctcacgaccggtgctcgatttagagagagtgtgtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagccccaaatcatcatttangagtcactaagcgcctnagggtttctatcgcttcctctgctcaagtctgcaacacggccctccctgacaatctctggctcagctgaggacgngctgattatactgctgctcatatgacagatggtanacgtaccttcccggtggtactttcggggacgtaggggacccgtaaagggtcggacccgttccgtaagggtccaacggccccgaaaggccttcggaccccccgttcggg

SEQ ID NO: 396847 - DNA, 519 bp, Homo sapiens
  misc_feature: GZ8MTXP02IHOR2.9.53.E09.1.454.CMB.2.raw
  modified_base (226)..(226): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcaccaggcaaagcccccaaatcatcatttatgagtcactaagcggcctcgaggggtttctatcgccttctctgctcaagtctgacaacacggcctccctgacaatctcgtcggctccgaggctgaggacgaggctgattattactgctgctcatatgcagagtggtgacactcccgttaggtacgttcgggacggacgggaccgaaaggttcgaccggtctaggtcacgacccgaaggcctcgcccccg

SEQ ID NO: 396848 - DNA, 519 bp, Homo sapiens
  misc_feature: GZ8MTXP02J2R0P.9.53.E09.1.454.CMB.2.raw
  modified_base (227)..(227): a, c, t, g, unknown or other
  modified_base (303)..(303): a, c, t, g, unknown or other
  modified_base (440)..(440): a, c, t, g, unknown or other
  modified_base (444)..(444): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaaacagcacccaggcaaagcccccaaatcatcatttangaggtcactaagcggcctcgaggggtttcattcgccttctctggctcaagtctgacaacacggcctccctgacaatctctgggctccgaggctggaggacgaggctgattatactgctgctacatatgcagatggtnaacnctcccgtggtactcgggcggagggaccaaggtcgaccggtccgtaagggtcacggacccaaggcctcggcccccg

SEQ ID NO: 396849 - DNA, 505 bp, Homo sapiens
  misc_feature: GZ8MTXP02FXK2H.9.53.E09.1.454.CMB.2.raw
  modified_base (225)..(225): a, c, t, g, unknown or other
tcagtgatacgtctcacgaccggtgctcgatttagagagagtgtgttgggtttggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttggggattatgaccttgtctcctggtaccaacagcacccaggcaaagcccccaaactcatcatttatgaggtcactaagcgcctcaggggtttctattcgcttctctgctcagtctgacaacacgcctcctgacaatctctggctcagctgagacgaggctgattatactgctgctcatatgacagatggtgacacttcccgtggttattcgggacggacggaccaagggtcgaccgtcgtaaggtcacgcccgaaggcctcggcccccg

SEQ ID NO: 396850 - DNA, 612 bp, Homo sapiens
  misc_feature: GZ8MTXP02GO3LI.9.53.E09.1.454.CMB.2.raw
tcagtgatacgtctcacgaccggtgctcgatttagagagagtgtgttgggtttggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagccaacccgaggaccaaacgcccccaaaactcatctatttatgagtacactaacgcggtcctgtaggggtttctattcgcttctctcggcctacagtctagaacaccaccgtcctaccctgaactatcctcgtcggcctccgaggctaggacggtacgaggtctagtattattaccgtgctcgctactagtatgacagattggacgtaaccgtaccgttcccggttaggttacggttaccggggaccgggtaaacggggtaacccgtaaacggggttccgtaaccccggttaccgttaacgggtacccgaacggtacccccggtaaagggttcccccg

SEQ ID NO: 396851 - DNA, 506 bp, Homo sapiens
  misc_feature: GZ8MTXP02J0PCB.9.53.E09.1.454.CMB.2.raw
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgcccccaaactcatcatttatgaggtcactaagcggcctcaggggtttctattcgccttctctggctcaagtctgacaacacggcctcctgacatctctggctccaggctgaggacgagctgattattactgctgctcatatgcagatggtgacactcccgtggtatcgggacggagggaccaggtcgaccgtcgtaggtcacggcccaaggcctcgtcccccg

SEQ ID NO: 396852 - DNA, 522 bp, Homo sapiens
  misc_feature: GZ8MTXP02JB6EQ.9.53.E09.1.454.CMB.2.raw
  modified_base (510)..(522): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatggtggggaccaaagggacaatggtcaccgtctcttcagccctccaaccccgagggccccagtccggtcctcccccgtggcccgccctgcctccgagggacgccacccgtccgagacgcacgacgcccggccctggggctcgcctggtcaaaggcctacttccgagacgtatcacgtgaggcggctggacaggcgcagtgnnnnnnnnnnnnn

SEQ ID NO: 396853 - DNA, 515 bp, Homo sapiens
  misc_feature: GZ8MTXP02G8CZD.9.53.E09.1.454.CMB.2.raw
  modified_base (428)..(428): a, c, t, g, unknown or other
  modified_base (431)..(431): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcaccaggcaaagcccccaaatcatcatttatgaggtcactaagcggcctcgaggggtttcattcgccttctctgctccaagtctgacaacacggcctcctgacaatctctggctccgaggctgagggacgaggctgattattactgctgcttcattagnganagtgtggtacgactcgttccgtaggtacgtcgggacggacggacgacggtcgaccgtcgtacggcacgccgacgcctccgcccg

SEQ ID NO: 396854 - DNA, 513 bp, Homo sapiens
  misc_feature: GZ8MTXP02FZHMC.9.53.E09.1.454.CMB.2.raw
  modified_base (226)..(226): a, c, t, g, unknown or other
  modified_base (232)..(232): a, c, t, g, unknown or other
  modified_base (303)..(303): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtnatgttggggattatgaccttgtctcctggtaccaacagcacccaggcaaacgcccccaaatcatcatttangaggtcactaagcggccctcaggggtttctattcgccttctctgctccaagtctgacaacacgcctccctgacatctctggctccgaggctgaggacgaggctagatttagttactgctgcttcatatgcagatggtgacactccgtggtagttcggcggacgggaccaaggtcgaccgtcgtaggtcacgcccgaaggcctcgcccccg

SEQ ID NO: 396855 - DNA, 506 bp, Homo sapiens
  misc_feature: GZ8MTXP02GC1F9.9.53.E09.1.454.CMB.2.raw
  modified_base (317)..(317): a, c, t, g, unknown or other
  modified_base (417)..(417): a, c, t, g, unknown or other
  modified_base (421)..(421): a, c, t, g, unknown or other
  modified_base (423)..(423): a, c, t, g, unknown or other
  modified_base (430)..(430): a, c, t, g, unknown or other
tcagtgatacgtctcacgaccggtgctcgatttagagagagtgtgttggggggtcacaagaggcagcgctctcgggacgtctccaccatggcctgggctctgctgctcctcatcctcctcactcaggacacagggtcctgggcccagtctgccctgactcagcctgcctccgtgtctgggtctcctggacagtcgatcaccatctcctgcactggaatcagcagtgatgttgggagttatgaccttgtctcctggtaccaacagcacccaggcaaagcccccaaactcatcatttatgaggtcactaagcggccctnaggggtttctattccgcttctctggctccaagtctgacaacacgcctcctgacaatctctgggctccagctgagacgaggctgattagtactgctgctanatangnagagtgngactacgtccgtggtacgtcgggacggacgggacgaacggtcgaaccgtcgtacggtacacgaccgacggcgtccg

SEQ ID NO: 396856 - DNA, 565 bp, Homo sapiens
  misc_feature: GZ8MTXP02I6NIW.9.53.E09.1.454.CMB.2.raw
  modified_base (226)..(226): a, c, t, g, unknown or other
  modified_base (303)..(303): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaacgcccccaaactcatcatttangaggtcactaagcggcctcgtaggggtttctagttcgtccttctctggctcaagtctgacaacacgcctcctgacaatctctggcctcgaggctagaggacgagtctagatttattacgtgtctgctcatatggacagagtggtacaccgaacgttcccggtaggttaacgttcggggacgggaaacgggtacccgtaaaagggtccgaaccggtaaccgtaggtaccgacggacccgtaacggcccgtaccgtccccccgg

SEQ ID NO: 396857 - DNA, 515 bp, Homo sapiens
  misc_feature: GZ8MTXP02GYWCH.9.53.E09.1.454.CMB.2.raw
  modified_base (226)..(226): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcaccaggcaaagccccaaatcatcatttatgaggtcactaagcggcctcaggggtttcattcgcttctctgctcaagtctgacacacggcctccctgacatctctggctcaggctgaggacgaggctgtattatactgcttgcttcatatgacagatgtgacactccgtcggtagttcggtcgggacgggaccgaacggtcggaccgtaaccgtacggtacgacgaccgaacggcgcgtcccccgg

SEQ ID NO: 396858 - DNA, 503 bp, Homo sapiens
  misc_feature: GZ8MTXP02I8GAZ.9.53.E09.1.454.CMB.2.raw
  modified_base (299)..(299): a, c, t, g, unknown or other
tcagtgatacgtctcacgaccggtgctcgatttagagagagtgtgttgggtttggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaatcatcatttangaggtcactaagcggccctcaggggtttcattcgcttctctgctcaagtctgacaacacggcctccctgacaatctctggctccaggctgaggacgaggctgattattactgcttgctcatatgcagatggtgacactcccgtggtacttcgggcgagggaccaaggtgacccgtcgtaaggtcacgcccaaggctcgcccccg

SEQ ID NO: 396859 - DNA, 522 bp, Homo sapiens
  misc_feature: GZ8MTXP02IDUSH.9.53.E09.1.454.CMB.2.raw
  modified_base (226)..(226): a, c, t, g, unknown or other
  modified_base (298)..(298): a, c, t, g, unknown or other
  modified_base (378)..(378): a, c, t, g, unknown or other
  modified_base (420)..(420): a, c, t, g, unknown or other
  modified_base (428)..(428): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcaccaggcaaagccccaaatcatcattangagtcactaagcggcctgaggggtttcattcgccttctctggctcaagtctgacaacacgccctaccctgactaatctcnggcctccaggctgaggacgaggctgattattactgctgctanatatcganagtgtggtcacgtccgtccggtagttacggtcggacgggacggaacgtaacggtcgaccgtcgtacggacgaccgaccgacggcctccgccccg

SEQ ID NO: 396860 - DNA, 507 bp, Homo sapiens
  misc_feature: GZ8MTXP02F9784.9.53.E09.1.454.CMB.2.raw
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaatcatcatttatgaggtcactaagcgccctgaggggtttcattcgccttctctggctccaagtctgacaacacggcctccctgacaatctctgggctccaggctgaggacgaggctgattattactgctgctcatatgcagatggtgacactcccgtggtattcggcggacggaccaaggtgaaccggtctaggtcacggacccaaggcctcgcccccg

SEQ ID NO: 396861 - DNA, 518 bp, Homo sapiens
  misc_feature: GZ8MTXP02GH2LS.9.53.E09.1.454.CMB.2.raw
  modified_base (301)..(301): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaactcatcatttangaggtcactaagcgccctcagggttctattcgcttctctgctcaagtctgacaacacgcctcctgacaatctctggctcaggctgaggacgaggctagatttatactgctgctcatatgcagatggtagacactcccggtggttacgttcggacgggaacgggacccgtaaaggtcgaaccgtcgtaacggtcacgccccgaaggcctcgtcccccg

SEQ ID NO: 396862 - DNA, 505 bp, Homo sapiens
  misc_feature: GZ8MTXP02G8DEJ.9.53.E09.1.454.CMB.2.raw
  modified_base (224)..(224): a, c, t, g, unknown or other
  modified_base (436)..(436): a, c, t, g, unknown or other
tcagtgatacgtctcacgaccggtgctcgatttagagagagtgtgttgggtttgggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaagcccccaaatcatcattatgagtcactaagcgcctcaggggtttcattcgccttctctggctccaagtctgacaacacgcctcctgacaatctctggctccgaggctagacggacgaggctagattatactgctgcttcatatgcagatggtcaacnctcccgtggtacttcgggacggagggaccaaggtgaaccgtcgtaggtcacgcccaaggctcgcccccg

SEQ ID NO: 396863 - DNA, 549 bp, Homo sapiens
  misc_feature: GZ8MTXP02HJYEA.9.53.E09.1.454.CMB.2.raw
  modified_base (293)..(293): a, c, t, g, unknown or other
  modified_base (349)..(349): a, c, t, g, unknown or other
tcagtgatacgtctcacgaccggtgctcgatttagagagagtgtgttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggattatgaccttgtctcctggtaccaacagcacccaggcaaacgccccaaatcatcatttangaggtcactaagcggccctcagggtttctattcgcttcctctgctcagtctgcacncgcctcctgacaatctctggctccgaggctgaggacgaggctgattattactgtctgctcatatgcagtatggtagacctacgttcccggtggttaacgtttcgggacgggtaacgggtaccgtaaacggggttcgtaacccgttccgtaacgggttccaacggtccccgtaaaggtccctaccggtcccccgtttacgg

SEQ ID NO: 396864 - DNA, 485 bp, Homo sapiens
  misc_feature: GZ8MTXP02HGOXN.9.53.E09.1.454.CMB.2.raw
  modified_base (258)..(258): a, c, t, g, unknown or other
  modified_base (374)..(374): a, c, t, g, unknown or other
  modified_base (392)..(392): a, c, t, g, unknown or other
  modified_base (438)..(438): a, c, t, g, unknown or other
  modified_base (473)..(485): a, c, t, g, unknown or other
tcagtgatacgtctcacgaccggtgctcgatttagagagagtgtgggtttgggagatctggttcttggacgtgtctactgacatggtgactcgactcttgaggaagggactggagtgggttgggcgtattttagcagtggggacaccaactacagcccctccctcaagagtcgagtcaccatgtcagtagacacgtccaagaaccagatctccctgaagctgacctctgtgaccgcgcggacacggccgtgtattacngtgcgagagttcccaaatatagcaacagctggtacattcctttgatatgtggggccaaagggacaatggtcaccgtctcttcagcctccacccaagggcccatcggtcttcccccnggccgcctgctccagacncacctccgagagcacagccgcctgggctgcctgcaaggctactcanacgtatcactgagcgggctggcaaggcgtcatagnnnnnnnnnnnnn

SEQ ID NO: 396865 - DNA, 496 bp, Homo sapiens
  misc_feature: GZ8MTXP02JK68A.9.53.E09.1.454.CMB.2.raw
  modified_base (301)..(301): a, c, t, g, unknown or other
  modified_base (435)..(435): a, c, t, g, unknown or other
  modified_base (490)..(490): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctccttgacagtcgatcaccatctcctgcactggaaccagcagtgatgttgggattatgaccttgtctcctggtaccaacagcacccaggcaaagcccccaaatcatcatttangaggtcactaagcggcctcgaggggtttctattcgccttctctgctcaagtctgacacacggcctcctgacatctctgggctccgaggctgaggacgaggctgattatactgctgctcatatgcaggcacccanaatgtacttcggaagtcggaccacggtcaccgtcaggtcagcccagccaacccgntcgtac

SEQ ID NO: 396866 - DNA, 560 bp, Homo sapiens
  misc_feature: GZ8MTXP02F8PHO.9.53.E09.1.454.CMB.2.raw
  modified_base (364)..(364): a, c, t, g, unknown or other
tcagtgatacgtctcacgaccggtgctcgatttagagagagtgtgttgggtttggggatactttctgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctctcctgcactgtctctggtggctccatcagtacttactactggacctggatccggcacgcccggcgggaaggactggagtgggtggcgtattttagcagtggggacaccaactacacgcccctcctcaagagtcgagtccaccatgtacagtanacacgtccaagaaaccagactctaccctagaacgctacgacctctgtgactccgccgcggacacggccgtagtactacgtgtgacgagtacgtacccaaatactagacaagacgtctaggtaactatttcctttagaacttagtcggtacgggaccaaaggggaacctaagtcggtacaccgttctacttcgaccg

SEQ ID NO: 396867 - DNA, 522 bp, Homo sapiens
  misc_feature: GZ8MTXP02IQK2V.9.53.E09.1.454.CMB.2.raw
  modified_base (301)..(301): a, c, t, g, unknown or other
  modified_base (422)..(422): a, c, t, g, unknown or other
  modified_base (425)..(425): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctctggtaccaacagcacccaggcaaacgcccccaaatcatcatttangagtcactaagcgcctcgaggggtttctattcgccttctctgctcaagtctgacaacacgcctccctgacatctctggctcgagctgaggacaggctagattattactgcttgctcaattnganagtgtgtacgactcgttccggtggtacgtcgggacgggacggaccgtaaggtccgaccggtcgtacggtacgacgaccgacggtccgtcccgccccg

SEQ ID NO: 396868 - DNA, 417 bp, Homo sapiens
  misc_feature: GZ8MTXP02HMG3G.9.53.E09.1.454.CMB.2.raw
  modified_base (412)..(417): a, c, t, g, unknown or other
tcagtgatacgtctcacgaccggtgctcgatttagagagagtgtgttggggttgggcgtattttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattcctttgatatgtgggccaagggacaatggtcaccgtctcttcagcctccaccaagggcccatcggtcttccccctggccgcccctgctccaggagcacctccgagagcacagcggccctgggcctgcctggtcaaggcctacttccagacgtatcactgagcgggctggcaaggcgcagtagnnnnnn

SEQ ID NO: 396869 - DNA, 519 bp, Homo sapiens
  misc_feature: GZ8MTXP02F3F6U.9.53.E09.1.454.CMB.2.raw
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgacttgtctctgtacaacagcaccaggcaaacgccccaaactcatcatttatgaggtcactaagcggcctcaggggtttctattcgccttctctgctcaagtctgacaacacgcctcctgacaatctctggctcagctgaggacgagctgattatactgctgctacatactgcagtagtggtagactacgtcccgtggttacgttcgggacggtaacgggaccgaaagggtcgaaccggtcgtacggtcgacgcccgaacggccgtcgcccccg

SEQ ID NO: 396870 - DNA, 570 bp, Homo sapiens
  misc_feature: GZ8MTXP02ITIRV.9.53.E09.1.454.CMB.2.raw
  modified_base (241)..(241): a, c, t, g, unknown or other
  modified_base (447)..(447): a, c, t, g, unknown or other
  modified_base (554)..(554): a, c, t, g, unknown or other
tcagtgatacgtctcacgaccggtgctcgatttagagagagtgtgttgggtttggggggtcacaagaggcagcgctctcgggacgtctccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcaccaggcaaagtccccaaatcatgatttatgagtcaaatagcgccctgtgggtccctgatccgcttctcctggcctccaagttcctggaccacgaccggtccctcccgtgacccgtctcgtgggcctcgaggctgacgtatgacggtctagtattactactgaccagcttcattancgcaggccaaccccaataagttcgtacgtttaccgggaaagttcggggaaccacgggttaccaccgttccgtaacggtccaacgcccgaaacggacccaaaccccgntacgtccacctttccg

SEQ ID NO: 396871 - DNA, 558 bp, Homo sapiens
  misc_feature: GZ8MTXP02IXN8J.9.53.E09.1.454.CMB.2.raw
  modified_base (269)..(269): a, c, t, g, unknown or other
  modified_base (302)..(302): a, c, t, g, unknown or other
  modified_base (408)..(408): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacngcacccaggcaaagcccccaaatcatcatttangagtcactaagcggcctcgagggtttctattcgcttctctgctcaagtctgacacacgcctcctgacatctctggctccgaggctgaggacgagctgattattacngctgctcatatgacagtagtggttacgacgtaccgttccccggttggttacgtttcgggggaccggaacggggaccccgtaaaagggttcgaaacccggttccgtaacggttaccgacggaccccgaaaggtcccgtacgtcccccccgg

SEQ ID NO: 396872 - DNA, 542 bp, Homo sapiens
  misc_feature: GZ8MTXP02JSX7G.9.53.E09.1.454.CMB.2.raw
  modified_base (226)..(226): a, c, t, g, unknown or other
  modified_base (303)..(303): a, c, t, g, unknown or other
  modified_base (322)..(322): a, c, t, g, unknown or other
  modified_base (337)..(337): a, c, t, g, unknown or other
  modified_base (436)..(436): a, c, t, g, unknown or other
  modified_base (442)..(442): a, c, t, g, unknown or other
  modified_base (448)..(448): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttggggattatgaccttgtctcctggtaccaacagcacccaggcaaacgcccccaaatcatcatttangaggtcactaagcggcctnaggggtttctattcnccttctctggctcaagttctcgacaacaccggcctcctgacatctctgggctcgaggtctggacggacgaggctagtattattactggctgctacatangacagntgggtnactaccgttccggtaggttacgttcgggacgggacgggacctaacgggtcgaccgtcgtacggtccacggacccgaacggccctcggtcccccg

SEQ ID NO: 396873 - DNA, 511 bp, Homo sapiens
  misc_feature: GZ8MTXP02IX45J.9.53.E09.1.454.CMB.2.raw
  modified_base (299)..(299): a, c, t, g, unknown or other
  modified_base (418)..(418): a, c, t, g, unknown or other
  modified_base (434)..(434): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggggattatgaccttgtctcctgtaccaacagcaccaggcaaacgccccaaatcatcattangagtcactaagcggcctgagggtttctattcgcttctctgctcaagtctgacaacacgccctcctagacaatcctctggctccgaggctgacggacgagctagattatactgcttgctnatatgacagatggtanactcgtccgtggtactcgggacggacggaccaaggtcgaaccgttcgtaggtacacgacccgaaggcctcgcccccg

SEQ ID NO: 396874 - DNA, 501 bp, Homo sapiens
  misc_feature: GZ8MTXP02I0P57.9.53.E09.1.454.CMB.2.raw
  modified_base (420)..(420): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctctggtaccaacagcaccaggcaaacgcccccaaatcatcatttatgaggtcactaagccggccctcaggggtttctattcgcttctctgctcaagtctgacaacacggcctcctgacaatctctggctccaggctgaggacgaggctgattagtactgctgcctnatatgcagatggtgacactccgtggtattcgggcgtacgggaccaaggtcgacgtccaggtccagcccaaggctcgccccg

SEQ ID NO: 396875 - DNA, 519 bp, Homo sapiens
  misc_feature: GZ8MTXP02INLSD.9.53.E09.1.454.CMB.2.raw
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgtggagttatgacctgtctcctggtaccaacagcaccaggacaaacgccccaaactcatcatttatgaggtcactaagcggccctcgtacggggtttctacttcgtcttctctgctcagtctagacaacaccggcctcctacgacaatctctcgggctccgagctgagacgagctgtattatactgctgctcatatgcagatggtgacacgttcccggtgtacgttcgggacggtacggacgaaggtcgaccgtacgtacggtcgacgaccgtaagcccg

SEQ ID NO: 396876 - DNA, 550 bp, Homo sapiens
  misc_feature: GZ8MTXP02I0UKT.9.53.E09.1.454.CMB.2.raw
  modified_base (267)..(267): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacttgtctcctggtaccacngcaccagcaaacgccccaaatcatcatttatgagtcactaagccggcctcgtagggtttctattcgtccttctctgctcaagtctgacacacgcctcctgacatctctggctccgaggcctaggacggtacgacggtctagtatttattactgtctgctcatatgacagatggtacgacaccgttcccgtaggttacgttcggggacgggtaacgggaccgtaaaggtcggtaacccgtcgtacggtaccgacggacccgaacgggtcctcccggtcccccgg

SEQ ID NO: 396877 - DNA, 499 bp, Homo sapiens
  misc_feature: GZ8MTXP02GZK3N.9.53.E09.1.454.CMB.2.raw
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgacttgtctcctggtaccaacagcacccaggcaaagcccccaaatcatcatttatgaggtcactaagcggcctcgaggggtttctattcgccttctctgctcaagtctgacaacacggcctccctgacaatctctggctcaggctgaggcgaggctgattatactgctgctcatatgcagatggtgacactccgtggtattcgggcggagggaccaaggtcgaccgtcgtagtcacgcccaaggcctcgcccccg

SEQ ID NO: 396878 - DNA, 504 bp, Homo sapiens
  misc_feature: GZ8MTXP02IJDHY.9.53.E09.1.454.CMB.2.raw
  modified_base (303)..(303): a, c, t, g, unknown or other
  modified_base (378)..(378): a, c, t, g, unknown or other
  modified_base (409)..(409): a, c, t, g, unknown or other
  modified_base (417)..(417): a, c, t, g, unknown or other
  modified_base (420)..(420): a, c, t, g, unknown or other
  modified_base (423)..(423): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggacaaacgccccaaatcatcattangagtcactaagccggcctcgagggtttctattcgccttctctgctcaagtctgacacacgcctcctgacatctcnggctccagctgagacgaggctagattatacngctgctanatnganagtgtgacacgacgtcgtagtacgtcggacggacggacgtacgtcgtaccgtcgtacgacgacgaccgacgcctccgcccg

SEQ ID NO: 396879 - DNA, 507 bp, Homo sapiens
  misc_feature: GZ8MTXP02HMRBS.9.53.E09.1.454.CMB.2.raw
  modified_base (319)..(319): a, c, t, g, unknown or other
  modified_base (423)..(423): a, c, t, g, unknown or other
tcagtgatacgtctcacgaccggtgctcgatttagagagagtgtgttgggtttgggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaatcatcatttatgaggtcactaagcggcctnagggtttcattcgcttctctggctcaagtctgacaacacgcctcctgacatctctgggctccaggctgaggacgaggctgattattactgcttgctcatatganagatgtgacactccgtcgtagttcgtcggacggacgaacggtacgacgtccgtacggtacgacgaccgaacggcgtcgtccccg

SEQ ID NO: 396880 - DNA, 523 bp, Homo sapiens
  misc_feature: GZ8MTXP02HZT5X.9.53.E09.1.454.CMB.2.raw
  modified_base (305)..(305): a, c, t, g, unknown or other
  modified_base (366)..(366): a, c, t, g, unknown or other
  modified_base (425)..(425): a, c, t, g, unknown or other
tcagtgatacgtctcacgaccggtgctcgatttagagagagtgtgctgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcaatttangaggtcactaagcggccctcaggggttctattccgcttctctggctccaagtctgacaacncgcctcctgacaatctctgggctcagctgaggacgagctgattatactgctgctcatangcagatgggacaccgtactcccggttggttaacttcgggcggtaacgggaccgaagggtcgaaccgtcgtaacggtcgacgtcccgaaggctccccgg

SEQ ID NO: 396881 - DNA, 526 bp, Homo sapiens
  misc_feature: GZ8MTXP02FN0GT.9.53.E09.1.454.CMB.2.raw
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgacttgtctcctggtaccaacagcacccaggcaaagcccccaaatcatcatttatgaggtcactaagccggccctcaggggtttctattcgccttctctggctcaagtctgacaacacggcctcctgacaatctctgggctcgaggctgaggacgaggctgattattactgctgctcatatgcagatggtgacacgtcccggtggtacttcgggacgggtacgggacccgtaaggtcgaaccgtccgtacggtacgacgcccgaaggcctcggtcccccg

SEQ ID NO: 396882 - DNA, 502 bp, Homo sapiens
  misc_feature: GZ8MTXP02F8D47.9.53.E09.1.454.CMB.2.raw
  modified_base (416)..(416): a, c, t, g, unknown or other
  modified_base (420)..(420): a, c, t, g, unknown or other
  modified_base (431)..(431): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttggagttatgaccttgtctcctggtaccaacagcacccaggcaaacgccccaaatcatcatttatgaggtcactaagccgcctcgaggggtttctacgttcgcttctctgctcagtctgacacacgcctcctgacaatctctggctcgagctgaggcgaggctagattattacngctnctcatatgacngatggtagacacgttccgtgtacgtcggacggacggacaaggtcgaccgtcgtaggtcacgccaggtcccg

SEQ ID NO: 396883 - DNA, 510 bp, Homo sapiens
  misc_feature: GZ8MTXP02HPXFJ.9.53.E09.1.454.CMB.2.raw
  modified_base (308)..(308): a, c, t, g, unknown or other
  modified_base (325)..(325): a, c, t, g, unknown or other
  modified_base (428)..(428): a, c, t, g, unknown or other
tcagtgatacgtctcacgaccggtgctcgatttagagagagtgtgttgggtttggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcacccaggcaaagcccccaaactcatcatttangagtcactaagcgcctnaggggtttctattcgcttctctggcctcagtctgacacacgcctcctgacatctctggctccagctgaggacgagctaattattactgctgctcatatgcagnttggtgacctacgtcccgttggtacttcgggcggtacgggacctaagggtcgaaccgtctaaggtcagcccaaggctcccgg

SEQ ID NO: 396884 - DNA, 540 bp, Homo sapiens
  misc_feature: GZ8MTXP02IQNH2.9.53.E09.1.454.CMB.2.raw
  modified_base (303)..(303): a, c, t, g, unknown or other
  modified_base (423)..(423): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggggattatgaccttgtctcctggtaccaacagcaccaggcaaacgcccccaaactcatcatttangaggtcactaagcggcctcaggggtttctattcgcttctctgctcaagtctgacaacacggcctccctgacaatctctgggctcaggctgaggacgagctagtattatactgtctgcctnatatgcagtatggtacacgaccgttccggtagggtacgttcgggggacggacggggaccgaaacgggtcgtaaccgtcgtaacggtccgaacgcccgaacggtcccgtcgtcccccg

SEQ ID NO: 396885 - DNA, 512 bp, Homo sapiens
  misc_feature: GZ8MTXP02FK7QP.9.53.E09.1.454.CMB.2.raw
  modified_base (300)..(300): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagccccaaactcatcatttangaggtcactaagcggccctcaggggttctattcgccttctctgctcaagtctgacaacacggcctcctgacaatctctggctcaggctgagacgagctgattatactgctgctcatatgcagatggtacgacacgtcccgtggtacgttcgggacggacgggaccgaaggtcgaaccgtcgtacggtcacgacccaacggctcggtcccccg

SEQ ID NO: 396886 - DNA, 504 bp, Homo sapiens
  misc_feature: GZ8MTXP02J2T53.9.53.E09.1.454.CMB.2.raw
  modified_base (299)..(299): a, c, t, g, unknown or other
  modified_base (319)..(319): a, c, t, g, unknown or other
  modified_base (440)..(440): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgacttgtctcctggtaccaacagcacccaggcaaagccccaaatcatcatttangaggtcactaagcggccctnaggggtttctattcgccttctctggctccaagtctgacaacacggcctccctgacatctctgggctccaggctggaggacgaggctgattatactgctgactcatatgacagatggtgacnctcccgtgtactcgggacgagggaccaaggtcgaccgtctaggcagacccaggcctcgcccccg

SEQ ID NO: 396887 - DNA, 532 bp, Homo sapiens
  misc_feature: GZ8MTXP02G4L9H.9.53.E09.1.454.CMB.2.raw
  modified_base (240)..(240): a, c, t, g, unknown or other
  modified_base (295)..(295): a, c, t, g, unknown or other
  modified_base (315)..(315): a, c, t, g, unknown or other
  modified_base (423)..(423): a, c, t, g, unknown or other
  modified_base (426)..(426): a, c, t, g, unknown or other
tcagtgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattangacttgtctctggtaccaacagcacccaggcaaagcccccaaactcatcatttangaggtcactaagcggccctntaggggtttctatcgcttcctctgctccaagtctgacaacacggcctccctgacatctcgtggcctccaggctgaggacgaggctgattattactgctgctcattagnganagtatggtacacgtacgtcggttacggtacggtcgggacgggacggaacgacggtaccgtaccgtacgtaacggtacgacgaccgacggtccgtcccgcccgtcgg

SEQ ID NO: 396888 - DNA, 538 bp, Homo sapiens
  misc_feature: GZ8MTXP02GE003.9.53.E09.1.454.CMB.2.raw
  modified_base (297)..(297): a, c, t, g, unknown or other
tcagtgatacgtctcacgaccggtgctcgatttagagagagtgtgttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttggattatgaccttgtctctggtaccaacagcacccaggacaaacgcccccaaatcatctatttangaggtcacgtaagccggccctcgtaggggtttctattccgtcttcctctggctccaagtcctagaccaacgaccggccctccctagacaattcctcgtcgggcctccgaggctagacggacgaggctgattattactgctgctacatatgcgagtagtggacacaccgttccgtggtacgttcgggcggtacggacgaaggtcgaccgttcgaagtcgacgaccgagcctcgcccccgtcg

SEQ ID NO: 396889 - DNA, 522 bp, Homo sapiens
  misc_feature: GZ8MTXP02H81K4.9.53.E09.1.454.CMB.2.raw
  modified_base (304)..(304): a, c, t, g, unknown or other
  modified_base (382)..(382): a, c, t, g, unknown or other
  modified_base (412)..(412): a, c, t, g, unknown or other
  modified_base (428)..(428): a, c, t, g, unknown or other
  modified_base (433)..(433): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcatggaaccagcagtgatggttggattatgaccttgtctcctggtaccaacacgcacccaggacaaagccccccaaatccatcatttangaggtcactaagcggccctcgaggggtttctattcgccttctctgctcagtctgacacacgccctcctgacaatctcnggctcaggctgaggacgagctgatattacngctgctcatatgcagntggtnaccgtacgtccgtggttacgtcggacgggacggaccgtaacgggtcgaacccgtcgttacggacgacgacccgaacggcctcgcccccg

SEQ ID NO: 396890 - DNA, 521 bp, Homo sapiens
  misc_feature: GZ8MTXP02FJSYP.9.53.E09.1.454.CMB.2.raw
  modified_base (301)..(301): a, c, t, g, unknown or other
  modified_base (320)..(320): a, c, t, g, unknown or other
  modified_base (437)..(437): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaatcatcatttangaggtcactaagcggcctnaggggtttctattcgcttctctggctccaagtctgacaacacggccctccctgacaatctctgggctccaggctgaggacgaggctgattatactgctgctcatatgcagatgggtnacactccggtggtattcgggacggacgggacccaagggtcgaacccgtcgtaagggtccaacggcccgaaaggcctcgcccccg

SEQ ID NO: 396891 - DNA, 507 bp, Homo sapiens
  misc_feature: GZ8MTXP02HXZL7.9.53.E09.1.454.CMB.2.raw
  modified_base (264)..(264): a, c, t, g, unknown or other
  modified_base (286)..(286): a, c, t, g, unknown or other
  modified_base (419)..(419): a, c, t, g, unknown or other
  modified_base (436)..(436): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacttgtctctgtacaanagcaccaggcaaagccccaaancatcatttatgagtcactaagcggcctcaggggtttcattcgccttctctgctcaagtctgacaacacggccctccctgactaatctctgggctccgaggctgacggacgaggctgattattactgctgcctnatatgcagatggagacncgtaccgtggtacgttcgggacggacggaccaaggtcaccggtcgtaggtcacgcccaacggctcgccccg

SEQ ID NO: 396892 - DNA, 560 bp, Homo sapiens
  misc_feature: GZ8MTXP02I5HDQ.9.53.E09.1.454.CMB.2.raw
  modified_base (225)..(225): a, c, t, g, unknown or other
  modified_base (307)..(307): a, c, t, g, unknown or other
  modified_base (417)..(417): a, c, t, g, unknown or other
  modified_base (421)..(421): a, c, t, g, unknown or other
  modified_base (450)..(450): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactggaaccngcagtgattggtgggattatgtaccttgtctcctggtaccaacacgcaacccaggacaaacgcccccaaatcatctatttanagagtacaactaacgccgtcctcgtagggtttctattcgcttctctgctacaagtctgacaacacgtcctcctagacatctcgtcggctaccgaggcgtagacggaacgnggtntagtattagtactgtctgtactatatagngagtagtacgtgtacgtacgtcgttaccggtaggtacggtacgggacggacggacgtacggtccgtaccgtaacgtacggacgaccgaccgtacggtcctacccgtcccg

SEQ ID NO: 396893 - DNA, 510 bp, Homo sapiens
  misc_feature: GZ8MTXP02GHEH6.9.53.E09.1.454.CMB.2.raw
  modified_base (268)..(268): a, c, t, g, unknown or other
  modified_base (303)..(303): a, c, t, g, unknown or other
  modified_base (436)..(436): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggggattatgaccttgtctcctggtaccaanagcacccaggcaaacgcccccaaatcatcatttangagtcactaagcggcctgagggtttctattcgccttctctggctcaagtctgacacacgcctcctgacatctctggctccgagctgacggacgaggctagattattactgctgctacatagtgcagatggtanactactccgtggtacttcgggacggacggaccaaggtcgaccgtcgtaggtcacgaccgaaggcctcgcccccg

SEQ ID NO: 396894 - DNA, 594 bp, Homo sapiens
  misc_feature: GZ8MTXP02JGJ4L.9.53.E09.1.454.CMB.2.raw
  modified_base (369)..(369): a, c, t, g, unknown or other
  modified_base (497)..(497): a, c, t, g, unknown or other
tcagtgatacgtctcacgaccggtgctcgatttagagagagtgtgttgggtttggggatactttctgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctctcctgcactgtctctggtgctccatcagtacttactactggacctggatccggcacgcccggccgggaaggacgtggaggtgggtggcgttattttagcaggtggggacaccaactacacgcccctcctcaagagtacgagtccaccatgtacagtanacacgtaccaaagaaccagactctccctagaacgctcgaccctctgtacgaccgcccggacggaccgacgggccgtagtaacttacgtgtcgacgtacgtacgttacccaaaatactacgacaaacgngtacgtacgtaactcgtttaccttttagacttaagtggttacgggggacctaaaggggacaaggttcggtacctaccgttctccttaccacgtcccc

SEQ ID NO: 396895 - DNA, 584 bp, Homo sapiens
  misc_feature: GZ8MTXP02IYDZT.9.53.E09.1.454.CMB.2.raw
  modified_base (227)..(227): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttggggattatgaccttgtctcctggtaccaacacgccacccaggaccaaacgacccccaaactcatctatttatgaggtacactaacgccgcctcgtaggggtttctagttcgtccttctctcgctcaagtctgacaacgaccggccctcctagactaactctccgtgggcctccgaggtcgtagacgggacgaggctagatttattacgtgtctgctacgtatagtcgacagtagtcgggtcacctaccgttcccggtggtacgttcgggacgggaacgggaccgtaacgggtccgaccggtaacgtacggaccgacgacccgacggtccctaccggtcccccg

SEQ ID NO: 396896 - DNA, 484 bp, Homo sapiens
  misc_feature: GZ8MTXP02G5WNG.9.53.E09.1.454.CMB.2.raw
  modified_base (472)..(484): a, c, t, g, unknown or other
tcagtgatacgtctcacgaccggtgctcgatttagagagagtgtgttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttacccaaatatagcaacagctggtacatttcctttgattatggtggggccaagggacaagtggtcaccgtctcttcacgccctccaaccgaacgggccccagtccggttccttcccccgtggcccgtcccctgcctcccgaaggacgccaccgtccgagacgcacgacggccgcccgtggggcctcggccgtggtacaaacggtaccttaccttccgagtaccgtatccgacgtggacggccggggcgtgggaccgaaacgggcgacgtaagtagnnnnnnnnnnnnn

SEQ ID NO: 396897 - DNA, 580 bp, Homo sapiens
  misc_feature: GZ8MTXP02GW91X.9.53.E09.1.454.CMB.2.raw
  modified_base (231)..(231): a, c, t, g, unknown or other
  modified_base (303)..(303): a, c, t, g, unknown or other
  modified_base (313)..(313): a, c, t, g, unknown or other
  modified_base (462)..(462): a, c, t, g, unknown or other
tcagtgatacgtctcacgaccggtgctcgatttagagagagtgtgttgggtttggggggtcacaagaggcagcgctctcgggacgtctccaccatggcctgggctctgctgcctcctcaccctcctcactcaggacacagggtcctgggcccagtctcgccctgactcagcctgcctccgtgtcgtgggtcctccgtggacagtcgatcaccatctcctgcactggaaccngcagtgattggttgggattatgtaccttgtctcctggtaccaacagccacccaggacaaacgacccccaaancatcatttangagtcacgtaacgccgcctgtaggggtttctagttcgccttctctggtcctcaagttctgaaccaacgaccggccctccctagactaactcctcgtgggcctacccgaggtcctaggacggacgaggctagatttatactgctgcctanatatgacagatggtacgactaccttcccggtaggttacttccggggacgggaacggaacccgaaggtccgtaccgtcgtaaggtaaccgaccgaacgtccgccgtacccccgtcccgg

SEQ ID NO: 396898 - DNA, 512 bp, Homo sapiens
  misc_feature: GZ8MTXP02IBBO3.9.53.E09.1.454.CMB.2.raw
  modified_base (227)..(227): a, c, t, g, unknown or other
  modified_base (302)..(302): a, c, t, g, unknown or other
  modified_base (319)..(319): a, c, t, g, unknown or other
  modified_base (375)..(375): a, c, t, g, unknown or other
  modified_base (379)..(379): a, c, t, g, unknown or other
  modified_base (419)..(419): a, c, t, g, unknown or other
  modified_base (422)..(422): a, c, t, g, unknown or other
  modified_base (425)..(425): a, c, t, g, unknown or other
  modified_base (428)..(428): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcacccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaagcccccaaatcatcatttangagtcactaagcgcctnaggggtttctattcgcttctctgctcaagtctgacaacaccggcctccctgacaanctcnggctcaggctgaggacgaggctgattattatgctgcttanatnganagngtggcgactacgttccgtggttcgtcggacgggacggacgtacggtcgaccgtcgtacgacgacgaccgacgccgtccgccccg

SEQ ID NO: 396899 - DNA, 505 bp, Homo sapiens
  misc_feature: GZ8MTXP02FHWO0.9.53.E09.1.454.CMB.2.raw
  modified_base (301)..(301): a, c, t, g, unknown or other
  modified_base (321)..(321): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaatcatcatttangaggtcactaagcggccctnaggggtttctattcgcttctctggctcaagtctgacaacacggcctccctgacaatctctggctccaggctgaggacgaggctgattattactgctgctcatatgcagatggtgacactccgtgtattcggcggagggaccaaggcgaccgtccgtaggtcacgcccaaggcctcggtcccccg

SEQ ID NO: 396900 - DNA, 580 bp, Homo sapiens
  misc_feature: GZ8MTXP02H2JQ0.9.53.E09.1.454.CMB.2.raw
  modified_base (227)..(227): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctctggtacaacagcaccaggcaaacgcccccaaatcatctattatgaggtcaactaagccggtccctcgtaggggtttctattcgcttctctgctcaagtctgacaacaccgtcctccctgactatctcgtggctccgaggctggaggacgagctgaattattactgcttgctacgtatatgactagtatggtacgacgtaccgttcccggtaggttacggttaccggggacgggtacgggtaaacccgtacggggtaccgtaacccggttaaccggtacgggtaccgaccggacccgtaaacggtccgtaccggtccccccgg

SEQ ID NO: 396901 - DNA, 555 bp, Homo sapiens
  misc_feature: GZ8MTXP02G4U8E.9.53.E09.1.454.CMB.2.raw
  modified_base (242)..(242): a, c, t, g, unknown or other
  modified_base (300)..(300): a, c, t, g, unknown or other
  modified_base (445)..(445): a, c, t, g, unknown or other
  modified_base (448)..(448): a, c, t, g, unknown or other
tcagtgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattancgacttgtctcctggtaccaacagcacccagacaaacgccccaaactcatctatttangaggtcacgtaagccgccctgtaggggtttctattcgtcttcctctggctctaagtctagaccaacgacggccctcccgagacaatctcgtgggcctaccgaggctggaggacgaggctgtatttattactgtctgctctattancgnagtagtggtagtaaccgcgtcccggtaggttagttacgggcgggtaacggacgaacgggtccgaaccgtcgaacggtcacggaccgagccgtccgaccccgttccgg

SEQ ID NO: 396902 - DNA, 549 bp, Homo sapiens
  misc_feature: GZ8MTXP02FQVCD.9.53.E09.1.454.CMB.2.raw
tcagtgatacgtctcacgaccggtgctcgatttagagagagtgtgttgggtttggggggtcacagaggcagcgctctcgggacgtctccaccatggcctgggctctgctgctcctcaccctcctcactcaggacacagggtcctgggcccagtctgccctgacgcagcctgcctccgtgtctgggtctcctggacagtcgatcaccatctcctgcactggaaccagcagtgatggttgggattatgaccttgtctcctggtaccaacagcacccaggcaaacgccccaaactcatcatttatgaggtcactaagcgcctcaggggttctattcgcttctctggctcaagtctgacaacacggcctcctgacaatctctggctccgagctgacggacgagctagattatactgctgctcatatgcagtatggtagactacgtcccgtaggtacgtttcgggacgggtaacgggtacccgaaagggtcgtaacccggttaaccgtaacgggttccgacggaccccgaaacggtccgtaccggtccccccgg

SEQ ID NO: 396903 - DNA, 531 bp, Homo sapiens
  misc_feature: GZ8MTXP02JJ06O.9.53.E09.1.454.CMB.2.raw
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggccaaacgcccccaaaatcatcatttatgaggtcactaagcgcctcgaggggtttctattcgccttctctgctcaagtctgacaacacggccctcctgacatctcgtggctcgagctgagggacgaggctgatttatactgctgcttcatagtgcagatggtagacgacgtccggttcggttacggttcggcgggacgggacgaacggtacggaccgtccgtacggtacgacggacccgacggcgtcgtccccg

SEQ ID NO: 396904 - DNA, 548 bp, Homo sapiens
  misc_feature: GZ8MTXP02F0SCE.9.53.E09.1.454.CMB.2.raw
  modified_base (360)..(360): a, c, t, g, unknown or other
  modified_base (369)..(369): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctctggtaccaacagcacccaggcaaacgccccaaactcatcatttatgaggtcactaagccggcctcgaggggttctattcgcttctctgctcaagtctgacaacnccgcctccngacaatctctgggctccaggctaggaggacgaggctagatttattactgctgctcatactgcagatggtagactacgtcccggtaggttacgttcggggacgggtaacgggaccgtaaacgggtccgtaaccggtccgtacggtacaacggcccgaaacggtcccgtacgtccccccgg

SEQ ID NO: 396905 - DNA, 586 bp, Homo sapiens
  misc_feature: GZ8MTXP02JSUP8.9.53.E09.1.454.CMB.2.raw
  modified_base (226)..(226): a, c, t, g, unknown or other
  modified_base (303)..(303): a, c, t, g, unknown or other
  modified_base (486)..(486): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcactcaggcaaacgcccccaaatcatcatttangagtcataagcgcctcgtagggttctattcccgcttctcgtcggctcctaaagtctacgaaccaaaccgaccggtcccttaccctagaaactaaacttccgtcgtcggggccttaccgaggtctaggaacggacgaggctagtaatttattactggctgctacatatgactaggtatgggtanaacctcgttacccggtaggttacgttcgggggacggacgggaacccgtaagggtcgtaaccggtaccgtaggtaccgacgacccgtaacggtctccccgg

SEQ ID NO: 396906 - DNA, 549 bp, Homo sapiens
  misc_feature: GZ8MTXP02IHX9G.9.53.E09.1.454.CMB.2.raw
  modified_base (381)..(381): a, c, t, g, unknown or other
  modified_base (465)..(465): a, c, t, g, unknown or other
tcagtgatacgtctcacgaccggtgctcgatttagagagagtgtgttgggtttggggatactttctgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctctcctgcactgtctctggtgctccatcagtacttactactggacctggatcggcagccgcgggaggactggagtggtggcgtattttagcagtggggacacaactacacgcccctcctcaaagagtcgagtcccaccatcgtcagtagacacgtccaaagaaccagactcncctagaacgctgacctctgtcgaccgccgcggacacggccgtgtattactgtgccgagtacgttacccaaaatatagcaaacgngtactagtaacttactttctttagacttagtcggtacgggaaccgtaaggaactaagtcgtactaccgtctcttacgacgtccg

SEQ ID NO: 396907 - DNA, 534 bp, Homo sapiens
  misc_feature: GZ8MTXP02GAECO.9.53.E09.1.454.CMB.2.raw
  modified_base (304)..(304): a, c, t, g, unknown or other
  modified_base (373)..(373): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccagcaaacgcccccaaactcatcatttangaggtcactaagcggcctcgtaggggtttctattcgccttctctgctcaagtctgacaacacgcctccngacatctctggctcgagctagaggacgaggctagattattactgctgctcatatgcagtagtggtacgactaccgtccgtggtacgttcgggacgggacgggaccgaagggtcgaccgtcgtacggtacgacggacccgaacggtccgtaccgtcccccgg

SEQ ID NO: 396908 - DNA, 530 bp, Homo sapiens
  misc_feature: GZ8MTXP02G7GF7.9.53.E09.1.454.CMB.2.raw
  modified_base (228)..(228): a, c, t, g, unknown or other
  modified_base (381)..(381): a, c, t, g, unknown or other
  modified_base (422)..(423): a, c, t, g, unknown or other
  modified_base (426)..(426): a, c, t, g, unknown or other
  modified_base (430)..(430): a, c, t, g, unknown or other
  modified_base (433)..(433): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcaccaggcaaacgcccccaaatcatcatttatgagtcactaagcgcctcgaggggtttctattcgccttctctggctcaagtctgacaacacggcctcctgacaatctcngggactccgaggctgaggacgaggctagattatactgcttnntanatanganagtagtggtacgtacgtaccgtccggtaggtacgtcgggacggaacggacgtaaggtcgacgtcgtacggacgacgaccgacggtccgtccgtcccg

SEQ ID NO: 396909 - DNA, 536 bp, Homo sapiens
  misc_feature: GZ8MTXP02IVFUA.9.53.E09.1.454.CMB.2.raw
  modified_base (227)..(227): a, c, t, g, unknown or other
  modified_base (302)..(302): a, c, t, g, unknown or other
  modified_base (443)..(443): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctctggtaccacagcacccaggcaaacgcccccaaatcatcatttangaggtcactaagcgcctcgtagggtttctattcgccttctctgctcaagtctgacaacaccggccctccctgactaatctctggctccgaggctggaggacgaggctgatttatactgctgctcatatgacagagtggtanacactcccggtagtacgttcgggacggtacggaccgaagggtcgacccgtaacgtacggtaccgacgacccgaacggtctacccggtcccccg

SEQ ID NO: 396910 - DNA, 654 bp, Homo sapiens
  misc_feature: GZ8MTXP02IWGLR.9.53.E09.1.454.CMB.2.raw
  modified_base (226)..(226): a, c, t, g, unknown or other
  modified_base (306)..(306): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgacttgtctcctggtaccaacagccacccaggacaaacgacccccaaatcatactattangagtacactaacgccgcctcgtagggtttctagttcgccttctcgtcggtactaccgtaaagttcctacggaacctaaaccgtacccgggtacccttacccgttacggaaacctaaacttccgtaccgtcgggtcccttacccggaggcccgttaggacgggaacgacgggtcctagtatttaaacttacgtacgtccttgtaccctacgtaagtattcggaccgtagtaagttcggggtactaccgaccgttcccggttaggtaacgttcgggacggtacgggaccgtaacggtcgtacccgtaacgtacggtaccacggccccgaccggtcctacccgtcccccgg

SEQ ID NO: 396911 - DNA, 506 bp, Homo sapiens
  misc_feature: GZ8MTXP02FFSSL.9.53.E09.1.454.CMB.2.raw
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggggattatgaccttgtctcctggtaccaacagcacccaggcaaacgcccccaaactcatcatttatgaggtcactaagcggcctcaggggttctattcgccttctctgctccaagtctgacaacacggcctccctgacaatctctggctccaggctgaggacgaggctagattatactgctgctcatatgcagatggtgacactcccggtggtattcggcggagggaccaaggcgaccgtcgtaggtcacgcccaaggctcgcccccg

SEQ ID NO: 396912 - DNA, 547 bp, Homo sapiens
  misc_feature: GZ8MTXP02IMO0N.9.53.E09.1.454.CMB.2.raw
  modified_base (257)..(257): a, c, t, g, unknown or other
  modified_base (289)..(289): a, c, t, g, unknown or other
  modified_base (388)..(388): a, c, t, g, unknown or other
  modified_base (429)..(429): a, c, t, g, unknown or other
tcagtgatacgtctcacgaccggtgctcgatttagagagagtgtgttggggggtcacaagaggcagcgctctcgggacttctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggattatgacttgtctctgtacaacngcaccagcaaacgccccaaactcatcatttangaggtcactaagccgccctgaggggtttctattcgcttcctctgctcaagtctgacacacggcctccctgacatctcgtggcctcgaggctgacgacgngctagattattactgctagtctactatatgacagtgtaggnacctacgtcccggttaggttacgttcggggacgggtaacgggaaccgtacgggtaccgtacccggttacgtaacggtaccgacgtacccgaaggtcccgtaccggcccccgtttccgg

SEQ ID NO: 396913 - DNA, 502 bp, Homo sapiens
  misc_feature: GZ8MTXP02IBX6S.9.53.E09.1.454.CMB.2.raw
  modified_base (371)..(371): a, c, t, g, unknown or other
  modified_base (409)..(409): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcacccctcctcactcaggacacagggtcctgggcccagtctgccctgactcagcctgcctccgtgtctgggtctcctggacagtcgatcaccatctcctgcactggaaccagcagtgatgttggattatgacttgtctcctggtaccaacagcacccaggcaaagcccccaaatcatcattatgagtcactaagcgcctcaggggtttctattcgcttctctgctcaagtctgacacacgcctcctgacaatctnggctcagctgagacgagctgattatactgctgctcatntgcagatggtgacacgtcccgtaggttactcggcggacggaccgaaaggtcgaccgtccgtaggtcacgacccgaacggccttcgccccccgg

SEQ ID NO: 396914 - DNA, 588 bp, Homo sapiens
  misc_feature: GZ8MTXP02HS0QT.9.53.E09.1.454.CMB.2.raw
  modified_base (226)..(226): a, c, t, g, unknown or other
  modified_base (305)..(305): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcacccaggaccaaagcccccaaactcatcatttangaggtcactaagcggcctcgaggggtttctattcgccttctctggcctacaacgtctgaacaaacacggccccttaccctcgaactaatcctcgtcggggcctccgaggcctaggaggtacgaggctgtatttattactgactgcttacatatgacagtatggtagacaccgttcccggttggtaacggttccgggacgggtaacggggaccgtaacgggtaccggacccggttaaccgtacggtaccgacggacccgaaacggcccttaccggtccccccgg

SEQ ID NO: 396915 - DNA, 509 bp, Homo sapiens
  misc_feature: GZ8MTXP02GWAZ2.9.53.E09.1.454.CMB.2.raw
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggacaaacgcccccaaatcatcatttatgagtcactaagcgcctgagggtttctagttcgccttctctggctccaagtctgacaacacggcctcctgacaatctctggctcaggctgaggacgagctgattatactgctgctcatatgcagatggtagactacgtccgtggtacgttcgggcggacggaccaaggtcgaccgtcgaggtcacgaccgaacgctacgtcccccg

SEQ ID NO: 396916 - DNA, 410 bp, Homo sapiens
  misc_feature: GZ8MTXP02GTJ4T.9.53.E09.1.454.CMB.2.raw
  modified_base (405)..(405): a, c, t, g, unknown or other
  modified_base (408)..(410): a, c, t, g, unknown or other
tcagtgatacgtctcacgaccggtgctcgatttagagagagtgtgttgggttgggcgtattttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattcctttgatatgtgggccaagggacaatggtcaccgtctcttcagcctccaccaagggcccatcggtcttccccctggcgccctgctccaggagcacctccgagagcacagcggccctgggcctgcctggtcaaggctacttccagacgtatcactgagcgggctgggcaaggcgcanagnnn

SEQ ID NO: 396917 - DNA, 510 bp, Homo sapiens
  misc_feature: GZ8MTXP02GZRUU.9.53.E09.1.454.CMB.2.raw
  modified_base (304)..(304): a, c, t, g, unknown or other
  modified_base (433)..(433): a, c, t, g, unknown or other
  modified_base (437)..(437): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggcaaacgcccccaaatcatcatttangagtcactaagcggcctcgaggggtttctattcgccttctctgctcaagtctgacaacacggcctccctgacatctctgggctcgaggctgaggacgaggctgattattactgcttgctcatatgcagngtgngacacgtccgtggtattcgggcggaggaccgaaggtcgaccgtcgtaggtcacgccgaacggctcgtcccccg

SEQ ID NO: 396918 - DNA, 504 bp, Homo sapiens
  misc_feature: GZ8MTXP02JS82Q.9.53.E09.1.454.CMB.2.raw
  modified_base (407)..(407): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaatcatcattatgaggtcactaagcggcctcaggggtttctattcgcttctctggctcaagtctgacaacacggcctcccgacatctctggctcagctgagacgaggctgattattacngctgctcatatgcagatggtgacacgtcccgtggtacttcgggcggagggaccaaggtcgaccgtcgaaggtcacgcccaaggcctcgccccgtcgg

SEQ ID NO: 396919 - DNA, 511 bp, Homo sapiens
  misc_feature: GZ8MTXP02GDXPE.9.53.E09.1.454.CMB.2.raw
  modified_base (443)..(443): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctacttcgcttctctggctcagtctgacaacacggcctccctgacaatctctgggctccaggctgaggacgaggctgattattactgctgctcatatgcagatggtnactactcccgtggtacttcggcgggacggaccaaggtcgaccgtcgtaggtcacgacccaaggtcccg

SEQ ID NO: 396920 - DNA, 519 bp, Homo sapiens
  misc_feature: GZ8MTXP02I9B1X.9.53.E09.1.454.CMB.2.raw
  modified_base (226)..(226): a, c, t, g, unknown or other
  modified_base (264)..(264): a, c, t, g, unknown or other
  modified_base (297)..(297): a, c, t, g, unknown or other
  modified_base (334)..(334): a, c, t, g, unknown or other
  modified_base (420)..(420): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgtgggattatgacttgtctctggtaccaangcaccaggcaaacgcccccaaatcatcatttangagtcactaagcgcctcgagggtttctattcgcttcnctgctcaagtctgacacacgccctcctgacaatctctcggctccgagcctagacgggacgaggtctagatttattactgctgcctnatatgcagatgtgactctcccgtaggtacgttcgggacggtaacgggaccaagggtcgaccgtcgtacggtacaccggcccaaggtccgtcgtcccccg

SEQ ID NO: 396921 - DNA, 542 bp, Homo sapiens
  misc_feature: GZ8MTXP02IDE95.9.53.E09.1.454.CMB.2.raw
  modified_base (226)..(226): a, c, t, g, unknown or other
  modified_base (302)..(302): a, c, t, g, unknown or other
  modified_base (384)..(384): a, c, t, g, unknown or other
  modified_base (430)..(430): a, c, t, g, unknown or other
  modified_base (438)..(438): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaacgcccccaaatcatcatttangagtcactaagcggcctcgaggggtttctattcgccttctctggctcaagtctgacaacaccggcctccctgacaactctcnggctccaggctgaggcgaggctgattattatgcttgcttcatatgnagatggtnactaccgtcccgtggttacgttcggacgggagggaacccgaagggttacgacccggttaaccgtaggttacacggacccgaaacgggtccttacggccccccgg

SEQ ID NO: 396922 - DNA, 545 bp, Homo sapiens
  misc_feature: GZ8MTXP02GYWN7.9.53.E09.1.454.CMB.2.raw
  modified_base (437)..(437): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggagttatgaccttgtctctggtaccaacagcacccaggcaaacgcccccaaactcatcatttatgagtcactaagcgccctcgagggtttctacttcgcttctctggctcagtctgacacacgcctcctgacatctctgggctccgaggctggaggacgaggctagatttattactgttgctacatagtgcagntggtcgactaccgtcccggttaggttacgttcgggacggtacgggaccgtaacgggtacgtaaccggttccgtacggtaccaacggacccgaacggtccgtcccccgg

SEQ ID NO: 396923 - DNA, 517 bp, Homo sapiens
  misc_feature: GZ8MTXP02GQN6U.9.53.E09.1.454.CMB.2.raw
  modified_base (414)..(414): a, c, t, g, unknown or other
  modified_base (422)..(422): a, c, t, g, unknown or other
  modified_base (426)..(426): a, c, t, g, unknown or other
  modified_base (429)..(429): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttggggattatgaccttgtctcctggtaccaacagcacccaggacaaacgcccccaaatcatcaatttatgaggtcactaagcgcctcaggggttctattcgcttctctgctcaagtctgacaacacggcctccctgacaatctctggctccaggctgaggacgaggctagattatacngctgctanatanganagagtgtacgacacgtaccgtcgtagtcggacggacggacgaacggtacgaccgtaacgtacgtacgacgaccgacgacgtccgcccg

SEQ ID NO: 396924 - DNA, 507 bp, Homo sapiens
  misc_feature: GZ8MTXP02GMWCW.9.53.E09.1.454.CMB.2.raw
  modified_base (299)..(299): a, c, t, g, unknown or other
  modified_base (335)..(335): a, c, t, g, unknown or other
  modified_base (363)..(363): a, c, t, g, unknown or other
  modified_base (427)..(427): a, c, t, g, unknown or other
  modified_base (434)..(434): a, c, t, g, unknown or other
tcagtgatacgtctcacgaccggtgctcgatttagagagagtgtgttgggtttggggggtcacagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccagcagtgatggttgggattatgaccttgtctcctggtaccaacagccaccaggcaaacgccccaaatcatcattangagtcactaagcgcctgagggtttctattcgcttcnctgctccaatctgacaacacgcctcccngacaatctcgtcggctccaggcctggacggacgaggctagatttagtactgctgcttcatatgnagatggnacactccgtgtacgtcggacgggaggaccaaggtcgaccgtcgtaacggcacgcccgaaggtcctcgcccccg

SEQ ID NO: 396925 - DNA, 639 bp, Homo sapiens
  misc_feature: GZ8MTXP02JUF97.9.53.E09.1.454.CMB.2.raw
  modified_base (227)..(227): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgacttgtctctgtacaacagcaccagcaaacgaccccaaactcatctatttatgagtcacgtaacgcgtccctcgtaggggtttctattcgtccttctctcgctcaagtctcgacaaacaccggccctacctcgaacctaatcctcgtcggcctccgaggtcgtaggacggacgaggctagtactttagtactgctgtctacattacgtgactaagtgttcggtacgtaccgtaccgttacccgggtgggttaaccggttcggggaaccggggtaacgggtaaacccggtaaacggggttacccggtaaccccggttaaccggttaaccggggttaccgtaaacccggggtaccccgaaaccggggttcccgttaccccggtaccccccccgg

SEQ ID NO: 396926 - DNA, 536 bp, Homo sapiens
  misc_feature: GZ8MTXP02IO0LJ.9.53.E09.1.454.CMB.2.raw
  modified_base (247)..(247): a, c, t, g, unknown or other
  modified_base (259)..(259): a, c, t, g, unknown or other
  modified_base (265)..(266): a, c, t, g, unknown or other
  modified_base (270)..(270): a, c, t, g, unknown or other
  modified_base (275)..(275): a, c, t, g, unknown or other
  modified_base (281)..(283): a, c, t, g, unknown or other
  modified_base (286)..(286): a, c, t, g, unknown or other
  modified_base (288)..(288): a, c, t, g, unknown or other
  modified_base (300)..(300): a, c, t, g, unknown or other
  modified_base (308)..(308): a, c, t, g, unknown or other
  modified_base (336)..(336): a, c, t, g, unknown or other
  modified_base (348)..(348): a, c, t, g, unknown or other
  modified_base (352)..(352): a, c, t, g, unknown or other
  modified_base (355)..(355): a, c, t, g, unknown or other
  modified_base (364)..(364): a, c, t, g, unknown or other
  modified_base (366)..(366): a, c, t, g, unknown or other
  modified_base (405)..(405): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattangaccttgtctcngtacanncacngacanaccacnnnatntngcactagcgccncgtggttntatctctctctgctacagtctgacaacnccgcctcctganaacnctnacggctccngngtcgagggacgtaggctgtaatttacgttactgtcgttntctcaattgtacgacagtagttcggtacgacctaccgttccggttagggttacggtacgggacggggacggtaaccgtaacggtcggtaccgtaacgtacgacgaccgacgtacccggtcttccccgcccg

SEQ ID NO: 396927 - DNA, 603 bp, Homo sapiens
  misc_feature: GZ8MTXP02JO653.9.53.E09.1.454.CMB.2.raw
  modified_base (226)..(226): a, c, t, g, unknown or other
  modified_base (291)..(291): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttggattatgacttgtctctgtacacagcaccagacaacgccccaatcatcattangagtcactaacgccggcctcgtaggggtttctagttcgtccttctcgtggtcctcaagttctcgaaccaacgaccggtccctaccctcgaactaacttccgtcgtcgggtcctccgaggtccgtaggacgggacggtaagggtcttagtaatttaacgttaccgtggaccttcgtcttacgtaattagtcgacgagtaagttggtacgactaccggttccggtaggtacgttccgggacgggtacgggactaacgggtccgtaaccggttccgacggtaccgacggacccgaacggtccctaccgtcccccg

SEQ ID NO: 396928 - DNA, 530 bp, Homo sapiens
  misc_feature: GZ8MTXP02GIFV6.9.53.E09.1.454.CMB.2.raw
  modified_base (227)..(227): a, c, t, g, unknown or other
  modified_base (304)..(304): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcacccaggcaaacgcccccaaatcatcatttangaggtcactaagcgcctcgtaggggtttctattcgccttctctgctcaagtctgacaacacggcctccctgacaatctcgtggctccgaggctagaggacgaggctagattatactgctgctcatatgacagatggtagactaccgttcccggtaggttagttccgggacgggacgggaccgaaaggtcgaccgtcgtaggtcacggccaacggcctcgtcccccg

SEQ ID NO: 396929 - DNA, 532 bp, Homo sapiens
  misc_feature: GZ8MTXP02IC58K.9.53.E09.1.454.CMB.2.raw
  modified_base (391)..(391): a, c, t, g, unknown or other
  modified_base (429)..(429): a, c, t, g, unknown or other
  modified_base (458)..(458): a, c, t, g, unknown or other
tcagtgatacgtctcacgaccggtgctcgatttagagagagtgtgttgggtttggggatactttctgagactcatggacctcctgcacaagaacatgaaacacctgtggttcttcctcctgctggtggcagctcccagatgggtcgtgtcccaggtgcagctgcaggagtcgggccccaggactggtgaagccttcggagaccctgtccctctcctgcactgtctctggtggctccatcagtacttactactggacctggatccggcagcccgcgggaaggactggagtggtggcgtattttagcagtggggacaccaactacagcccctcctacaagagtcgagtccaccatgcagtagacacgtccaagaaccagactctcctgaagcngacctctgtgaccgcgcgacacggccgtgtattactgngcgagacgttacccaaatatagcaaacgngtacgtagtactactttctttgatagtcggtacgggacgaaggactaagtcgtactaccgtctctacacgtccg

SEQ ID NO: 396930 - DNA, 567 bp, Homo sapiens
  misc_feature: GZ8MTXP02G3CTK.9.53.E09.1.454.CMB.2.raw
  modified_base (227)..(227): a, c, t, g, unknown or other
  modified_base (269)..(269): a, c, t, g, unknown or other
  modified_base (302)..(302): a, c, t, g, unknown or other
  modified_base (427)..(427): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaanagcaccaggcaaagcccccaaatcatcatttangagtcactaagccggcctcgaggggtttctattcgcttctctgctcaagtctgacaacacgcctcctgacaatctctgggctccgaggctgacggacgaggctagatttatacctggcttgcctnatatgcagtactgggtacactacgtcccggtggtaacgttcgggacgggtaacgggacccgtaaaggggtccgtaacccggtcccgtttaagggtacccgaacggacccccgaagggtcccctaccggttccccccccgg

SEQ ID NO: 396931 - DNA, 519 bp, Homo sapiens
  misc_feature: GZ8MTXP02HY6MM.9.53.E09.1.454.CMB.2.raw
  modified_base (224)..(224): a, c, t, g, unknown or other
  modified_base (293)..(293): a, c, t, g, unknown or other
  modified_base (310)..(310): a, c, t, g, unknown or other
  modified_base (369)..(369): a, c, t, g, unknown or other
  modified_base (421)..(421): a, c, t, g, unknown or other
  modified_base (424)..(424): a, c, t, g, unknown or other
tcagtgatacgtctcacgaccggtgctcgatttagagagagtgtgttgggtttggggggtcacagaggcagcgctctcgggacgtctccaccatggcctgggctctgctgctcctcaccctcctcactcaggacacagggtcctgggcccagtctgcctgactcagcctgcctccgtgtctgggtctcctggacagtcgatcaccatctcctgcactggaaccngcagtgatgttggattatgactgtctcctggtaccaacagcaccaggcaaagccccaaatcatcattangagtcactaagcgcctnagggtttctatcgcctctctgctcaagtctgaactaacaccgcctccctagacaactcnctgggctccgaggctagaggacgaggctgtattatactgctgcttcattagnganagagtgtacgacgtacgtccgtcggtacgtacggacggacggacgacgtacgtaccgtaaccgtacgtacgacgaccgacgtaccgtccgtcccg

SEQ ID NO: 396932 - DNA, 503 bp, Homo sapiens
  misc_feature: GZ8MTXP02HNJNR.9.53.E09.1.454.CMB.2.raw
  modified_base (300)..(300): a, c, t, g, unknown or other
  modified_base (421)..(421): a, c, t, g, unknown or other
  modified_base (424)..(424): a, c, t, g, unknown or other
  modified_base (426)..(426): a, c, t, g, unknown or other
  modified_base (429)..(429): a, c, t, g, unknown or other
  modified_base (433)..(433): a, c, t, g, unknown or other
  modified_base (436)..(436): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcaccaggcaaagcccccaaatcatcatttangaggtcactaagccggcctcaggggtttctattcgccttctctgctcaagtctgacaacacgcctcctagacaatctctggctccgaggctgaggacgagctgattattactgctgcttanatngnagntgtnacncgtcgtgtacgtcgggacggacggacgacggtcgaccgtcgtacgcacgaccgacgccgtccgcccg

SEQ ID NO: 396933 - DNA, 546 bp, Homo sapiens
  misc_feature: GZ8MTXP02I3WJU.9.53.E09.1.454.CMB.2.raw
  modified_base (244)..(244): a, c, t, g, unknown or other
  modified_base (296)..(296): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggattntgacttgtctctgtaccacagcaccaggcaaacgcccccaaatcatcattangagtcactagcgcctcgagggtttcattcgcttctctgctcagtctgacacacgcctcctgacatcctgtggcctcgaggctagacgggacgaggctagactttattactgctgctcatatgactagagtggtacgactaccgttcccggtaggtacgtttccgggggacgggtaacgggacccgtaaaagggtcgaaccccggtcgtacgggtaccacggacccgtaacggtccgtacccggtcccccg

SEQ ID NO: 396934 - DNA, 534 bp, Homo sapiens
  misc_feature: GZ8MTXP02JW5UU.9.53.E09.1.454.CMB.2.raw
  modified_base (433)..(433): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggacaaacgcccccaaactcatcatttatgagtcactaagcggccctgtaggggtttctattcgcttctctgctcagtctgacacaccgcctcctgacatctctggctcaggctgaggacgagctgattatactgctgctcatatgcagatggtanacctacgttcccggtggtacgttcggggcggtacggggacctaaacgggtcgaacccggtccgtaacggtcgacggcccgaacggtccgtcgtccccccgg

SEQ ID NO: 396935 - DNA, 509 bp, Homo sapiens
  misc_feature: GZ8MTXP02F7OKZ.9.53.E09.1.454.CMB.2.raw
  modified_base (301)..(301): a, c, t, g, unknown or other
  modified_base (319)..(319): a, c, t, g, unknown or other
  modified_base (434)..(434): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaatcatcatttangagtcactaagcggcctnaggggtttctattcgccttctctggctcaagtctgacaacacggcctccctgacaatctctggctcaggctgaggacgaggctgattattactgctgctcatatgcagatggtanactactcccggtggtattcgggacggaggaccaagggtcgaccgtcgtaggcacggcccaaggcctcggcccccg

SEQ ID NO: 396936 - DNA, 522 bp, Homo sapiens
  misc_feature: GZ8MTXP02I23L5.9.53.E09.1.454.CMB.2.raw
  modified_base (306)..(306): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtacaacagccaccaggcaaagcccccaaatcatcatttangaggtacactaagcggccctcaggggtttctattcgcttctctggctccagtctgacacacgcctcctgacatctctggctccagctgagacgaggctgattattactgctgctcatatgacagtatggtgaacctcttcccggtggttagttcgggcgggaacggaccgaaagggtcgaacccggtcgtacggtcgacggacccgaaggtccccg

SEQ ID NO: 396937 - DNA, 668 bp, Homo sapiens
  misc_feature: GZ8MTXP02JDT39.9.53.E09.1.454.CMB.2.raw
  modified_base (226)..(226): a, c, t, g, unknown or other
  modified_base (301)..(301): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttggattatgtaccttgtctctgtaccaacagccaccagaccaaacgccccaaatcatctattangagtcactaacgcgtccctcgtaggggtttctattccgtccttctctcgtcctacaagtctgacaaccgaccgccctccccgaactaactcctcgtacgggcctacccgaggtctaggacggacgacggtcgtagtaagtttacttacgtcgtcttacgtcttacctaatagttcgaccgtaaggtagttaggtcgtaacccgtacccgttacccgggttgggttaacggtttccggggaaccgggggtaaacgggtaaacccggtaagggttaccccggtaaccccggtttaccggttaacgggtacccgaaccggtacccccggaaacgggtccccgttaccccgggtccccccgtttaaccggg

SEQ ID NO: 396938 - DNA, 523 bp, Homo sapiens
  misc_feature: GZ8MTXP02IY03S.9.53.E09.1.454.CMB.2.raw
  modified_base (226)..(226): a, c, t, g, unknown or other
  modified_base (298)..(298): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcaccagcaaacgccccaaatcatcattangagtcactaagcgcctcgtaggggtttctattcgccttctctggctcaagttctgacaacacgcctcctagacaatctcgtggctccgaggctggaggacgaggctagactttagtactgctgctacatatgacagatggtagactacgtccggttggtacgttcggggacggacgggtaccgaaggttcgaaccgtcgtaggcacgccgacggctcgtcccccg

SEQ ID NO: 396939 - DNA, 511 bp, Homo sapiens
  misc_feature: GZ8MTXP02JOYAH.9.53.E09.1.454.CMB.2.raw
  modified_base (267)..(267): a, c, t, g, unknown or other
  modified_base (415)..(415): a, c, t, g, unknown or other
  modified_base (428)..(428): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacngcacccaggcaaagcccccaaatcatcatttatgaggtcactaagcggcctcaggggtttctattcgccttctctggctcaagtctgacaacacgcctccctgacaatctctgggctccaggctgaggacgtaggctagattattacngctgctcatatgntgttggttcttctttctaatatagttacggtcggacggacgacgcgtcgacgtccgtgacgtcgacgaccgaacgacgtcccg

SEQ ID NO: 396940 - DNA, 514 bp, Homo sapiens
  misc_feature: GZ8MTXP02JZTHI.9.53.E09.1.454.CMB.2.raw
  modified_base (295)..(295): a, c, t, g, unknown or other
  modified_base (371)..(371): a, c, t, g, unknown or other
tcagtgatacgtctcacgaccggtgctcgatttagagagagtgtgttgggtttgggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctctgtacaacagcaccaggcaaagcccccaaatcatcatttangaggtcactaagcggcctcaggggtttctattcgccttctctgctcaagtctgacaacacgctccctgacatcctntggctcaggctgaggacgaggctgattatactgctgctcatatgctagatggtgacacgtcccgtggtattccggggagggtacgggaccgaagggtgaacccggtctaagggtccacggccccaaggccttacggccccccg

SEQ ID NO: 396941 - DNA, 544 bp, Homo sapiens
  misc_feature: GZ8MTXP02JRAUA.9.53.E09.1.454.CMB.2.raw
  modified_base (437)..(437): a, c, t, g, unknown or other
  modified_base (441)..(441): a, c, t, g, unknown or other
  modified_base (444)..(444): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggacaaacgcccccaaatcatctatttatgaggtcaactaagccgcctcgaggggtttctattcgccttctctggctcaagtctgacaacaccggcctcccgacactctcgtcggctccgaggctgaggacgaggctagattattactgctgctcattacncganagngtggtacgaccgtccgtccggtacggtacgtcgggacggacggaacgtacggtacgtaccgtacgtaacggtacacggaccgacggtcctccgcccgtcg

SEQ ID NO: 396942 - DNA, 507 bp, Homo sapiens
  misc_feature: GZ8MTXP02I9USA.9.53.E09.1.454.CMB.2.raw
  modified_base (426)..(426): a, c, t, g, unknown or other
tcagtgatacgtctcacgaccggtgctcgatttagagagagtgtgttgggtttggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgctcctggtaccaacagcacccaggcaaagcccccaaatcatcatttatgaggtcactaagcggcctcaggggtttctattcgcttctctgctcagtctgacacacgctccctgacatctctgggctccaggcctgagacgaggctgattatactgctgctcatatgcanatgtgacactccgtcggtagttcgtcggacgggacgaacggtaacggaccgtccgtacggtacgacgaccgaacggtccgg

SEQ ID NO: 396943 - DNA, 517 bp, Homo sapiens
  misc_feature: GZ8MTXP02F3XMT.9.53.E09.1.454.CMB.2.raw
  modified_base (409)..(409): a, c, t, g, unknown or other
tcagtgatacgtctcacgaccggtgctcgatttagagagagtgtgttgggtttggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaactcatcatttatgaggtcactaagcggccctcaggggtttctattcgccttctctgctcaagtctgacacacgcctcctgacaatctctggctcagctgagacgaggctgattagttacngctgctcatatgcagatgtgacactccgtcggtagttcggtcggacgggacgaacggtacggtaccgtaaccgtacggtacgacgacccgaacggacgtcgtcccccg

SEQ ID NO: 396944 - DNA, 496 bp, Homo sapiens
  misc_feature: GZ8MTXP02IWFIZ.9.53.E09.1.454.CMB.2.raw
  modified_base (330)..(330): a, c, t, g, unknown or other
  modified_base (442)..(442): a, c, t, g, unknown or other
  modified_base (450)..(450): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactctaatttatgagtcactaagcggccctcaggggtttcngtcgcttctctgcctcaagtctggcacacgcctccctgacaatctctgggctccagtctgacgacgaggctgattatactgcagctcatatgcagttgttcctctttcaagntattcggnggaggtccaggctgaccgtctgaagtcagcccaggctcgcccctcg

SEQ ID NO: 396945 - DNA, 577 bp, Homo sapiens
  misc_feature: GZ8MTXP02FX8CW.9.53.E09.1.454.CMB.2.raw
  modified_base (308)..(308): a, c, t, g, unknown or other
  modified_base (378)..(378): a, c, t, g, unknown or other
  modified_base (468)..(468): a, c, t, g, unknown or other
tcagtgatacgtctcacgaccggtgctcgatttagagagagtgtggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagccacccaggaccaaacgacccccaaaactcaatctaatttangaggtacaactaacgccggccctcgtaggggtttctattcgtcttcctctgctccaagtcctagacaacncggtcctccctagaacaatctcgtgggctccgaggctgacggacgaggctagtattagttactgctgctactatatcgacagtatggtanaacctaccgtcccggtggttacgttcgggacgggaacggtaaccgaagggtacgacccgttacgtaacggtcaacggacccgaacggtcctaccgtcccccgttaccgg

SEQ ID NO: 396946 - DNA, 549 bp, Homo sapiens
  misc_feature: GZ8MTXP02IUIKQ.9.53.E09.1.454.CMB.2.raw
  modified_base (228)..(228): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtcctcctggacagtcgatcaccatctcctgcactggaaccngcagtgatggttgggattatgaccttgtctcctggtaccaacagcacccaggcaaacgcccccaaactcatcatttatgaggtcactaagccggccctcgtaggggttctattcgccttctctgctcaagtctgacaacaccggcctccccgacaactctctgggctcccgaggctgacggacgaggctgattattactgctgctcatatcgcaaggattggagacctactcccggtggtacgttcggggacgggagggaacccgtaggtaccgaccgtccgtaaggttcgaacgcccgaacggcctcggcccccttccgg

SEQ ID NO: 396947 - DNA, 533 bp, Homo sapiens
  misc_feature: GZ8MTXP02F3ZZI.9.53.E09.1.454.CMB.2.raw
  modified_base (302)..(302): a, c, t, g, unknown or other
  modified_base (406)..(406): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctctggtaccaacagcacccaggcaaacgcccccaaatcatcatttangagtcactaagcggcctcgagggtttctattcgcttctctgctcaagtctgacacacgcctcctgacatctcgtggctcgagctgaggcgagctagattatacngtctgctcatatcgagagtagtggtcgactaccgttccggtaggttacgttcgggacgggacgggaaccgtaacgggtcgtaaccggtcgtaacggtcgaccggcccgtaaggccgtccgtcccccg

SEQ ID NO: 396948 - DNA, 523 bp, Homo sapiens
  misc_feature: GZ8MTXP02HYC99.9.53.E09.1.454.CMB.2.raw
  modified_base (288)..(288): a, c, t, g, unknown or other
  modified_base (298)..(298): a, c, t, g, unknown or other
  modified_base (429)..(429): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctggtctcctggacagtcatcaccatctcctgcactggaaccagcagtgatggttgggattatgaccttgtctctggtaccaacagcaccaggcaaacgccccaaancatcatttangaggtcactaagcgcctgaggggtttcattcgccttctctgctcaagtctgacaacacgccctcctgacaactctctcgggctccgaggctagaggacgaggctgtattattactgctagctacattacgngacagtagtggtacgactccgttcggttaggtacgtcgggacggacggacgacggtcgtaccgtcgtacgacgacgaccgacgcctccgtcccg

SEQ ID NO: 396949 - DNA, 598 bp, Homo sapiens
  misc_feature: GZ8MTXP02JLBBI.9.53.E09.1.454.CMB.2.raw
  modified_base (306)..(306): a, c, t, g, unknown or other
  modified_base (452)..(452): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattatgaccttgtctcctggtaccaacagcacccaggacaaacgacccccaaatcatcattangaggtcactaagccggccctcgaggggtttctattcgccttctctggctcaagtctgaccaacgaccggccctccctagactaactctcgtgggcctccgaggccgtaggacggacggagggctgtaatttacgttacgtgtcgtntctactaatacgtgactagtagtggtcgtactaccgttcccggtggttacggttccgggacggggtacgggaccgtaaacggggtccgtaaccggtaaccgtacgggtaccgacggacccgtaacggtcccgtaccggtccccccg

SEQ ID NO: 396950 - DNA, 509 bp, Homo sapiens
  misc_feature: GZ8MTXP02J3UP1.9.53.E09.1.454.CMB.2.raw
  modified_base (269)..(269): a, c, t, g, unknown or other
  modified_base (301)..(301): a, c, t, g, unknown or other
  modified_base (367)..(367): a, c, t, g, unknown or other
  modified_base (420)..(420): a, c, t, g, unknown or other
  modified_base (423)..(423): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgccactggaaccagcagtgattgttgggattatgaccttgtctctggtaccaacngcaccaggcaaacgccccaaatcatcatttangaggtcactaagcggcctcgaggggtttcattcgcttctctcgctcaagtctgacacacgcctccngacatctcgtggctcgaggctggagacgagctgattcttatgctgctcatacnganagtagtgtacacgtcgtccggtaggtacgtcgggacggacggacgacggtcgaccgtcgtacgcgacgaccgacgcctccgtcccg

SEQ ID NO: 396951 - DNA, 650 bp, Homo sapiens
  misc_feature: GZ8MTXP02F5CET.9.53.E09.1.454.CMB.2.raw
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttggggattatgtaccttgtctcctggtaccaacagcaccaggcaaacgccccaaactcatcattatgagtcactaagcgcctctaggggttctattcgtccttctctgctctaagtctgacaacgacgccctcccgacaactcctactcgggcctccgaggtctaggaggaccgagggtcctagtaacttagttaacttgaccgttcgtccttaccaattagtacggacctaagtaaggttcgggtacgaaacccgtaccgttcccccggttaggttaacggtttccgggggacggggtaaacgggtaaaccggtaaacgggttaccgggacccggttaccggtaaacgggttaccgaaccggtaccccggaaacggtacccgttacccggtccccccgtttaacccgggg

SEQ ID NO: 396952 - DNA, 532 bp, Homo sapiens
  misc_feature: GZ8MTXP02F5AXX.9.53.E09.1.454.CMB.2.raw
  modified_base (227)..(227): a, c, t, g, unknown or other
  modified_base (367)..(367): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctctggtacacagcaccaggcaaacgcccccaaatcatcatttatgaggtcactaagcggcctcaggggtttctattcgccttctctggctcaagtctgacaacacgcctccngacatctctcgggctccaggctaggaggacgaggcttagattatactgctgctacatatgcagatggtagaactcgttcccggtggtacgttcgggcgggtacgggaccgtaaagggtcgaaccgtcgtacggtacacggacccgaacgggcctccggtcccccg

SEQ ID NO: 396953 - DNA, 550 bp, Homo sapiens
  misc_feature: GZ8MTXP02IQBYZ.9.53.E09.1.454.CMB.2.raw
  modified_base (298)..(298): a, c, t, g, unknown or other
  modified_base (347)..(347): a, c, t, g, unknown or other
  modified_base (354)..(354): a, c, t, g, unknown or other
  modified_base (363)..(363): a, c, t, g, unknown or other
  modified_base (370)..(370): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctctggtaccaacagcaccaggcaaacgcccccaaatcatcattangagtcactaagcggcctcgagggtttcattcgcctctctgctcaagtcngacaacncgcctcctnacatctnggctcgagctgagacgaggctgattattactgctgctcatagtgacagtagttcggtagaaccaccgttcccggtaggtttacggttccgggaacggggaacgggaccgaaacgggttacgacccggttaaccgtaacgggtacgaccggacccgaaacggtccgttaccgtccccccgg

SEQ ID NO: 396954 - DNA, 541 bp, Homo sapiens
  misc_feature: GZ8MTXP02HA5MP.9.53.E09.1.454.CMB.2.raw
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttggagttatgaccttgtctcctggtaccaacagcacccaggcaaagcccccaaactcatcattatgagtcactaagcgcctcaggggtttcattcgcttctctggctccagtctgacaacacggcctcctgacaatctctgggctcccaggcctgaggacgaggctgatttatactgctgctcgatatgcagtatggtcgaccgtacgttcccggtaggttacgttccggggacgggtaacggggaccgtaaagggtcgtacccggtccgtacggtaccgacggcccgaaaggtccccg

SEQ ID NO: 396955 - DNA, 591 bp, Homo sapiens
  misc_feature: GZ8MTXP02GR4KW.9.53.E09.1.454.CMB.2.raw
  modified_base (226)..(226): a, c, t, g, unknown or other
  modified_base (303)..(303): a, c, t, g, unknown or other
  modified_base (378)..(378): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccatctcctgcactggaaccngcagtgatggttgggattatgaccttgtctcctggtaccaacagcaccagacaaacgacccccaaatcatcatttangagtcactagcggcctcgtaggggtttctattcgccctttcgtctcggtcctaccaagttctcgaacctaaaccnccggtaccctcccctagtaacctaaacttccctcgtcgggtcctacccgagggtcccgtaggacggggacggtaggccttaggtaatttagttacctgctgcttacgatatcgctagagttggacactaccgttcggtggtagttccgggacggacgggtacgacggtccgaccgtcgtacggtaccgaccgccgacggtcctccgtcccccg

SEQ ID NO: 396956 - DNA, 524 bp, Homo sapiens
  misc_feature: GZ8MTXP02GQTBG.9.53.E09.1.454.CMB.2.raw
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacttgtctcctggtaccaacagcacccaggcaaagcccccaaatcatcatttatgaggtcactaagcggcctcaggggtttctattcgccttctctggctccaagtctgacaacacggcctccctgacaatctctggctccaggctgaggacgaggctagattattactgctgctcatatgacagtagtggtgactacgtcccgtggtagttcgggcgggacggaccgtaaggtcgaaccgtccgtaggtcacggtaccaacggcctcggtcccccg

SEQ ID NO: 396957 - DNA, 531 bp, Homo sapiens
  misc_feature: GZ8MTXP02HNC44.9.53.E09.1.454.CMB.2.raw
  modified_base (226)..(226): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaagcccccaaatcatcatttatgaggtcactaaagccggcctcgaggggtttctatttcgccttctctgctccaagtctgacaacacgccctcctagacaatctctgggctccgaggctggaggacgaggctgattattactgctgctcaatatgcagatggtcgactacctcccggtggttagttcgggacggagggacccaaagggtcgaaccgtccgtaggtccacgccccgtaaggccttcgcccccg

SEQ ID NO: 396958 - DNA, 579 bp, Homo sapiens
  misc_feature: GZ8MTXP02F3WQV.9.53.E09.1.454.CMB.2.raw
  modified_base (240)..(240): a, c, t, g, unknown or other
  modified_base (293)..(293): a, c, t, g, unknown or other
tcagtgatacgtctcacgaccggtgctcgatttagagagagtgtggtttggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccagcagtgatggttggattangacttgtctctgtaccaacagcaccaggacaaacgccccaaatcatcatttangaggtcacgtaagccggcctcgtagggtttctattcgtcttcctctggctccaagtctagacaacacggcctcctagactatctcgtggcctccgaggctggaggacgaggtctagtattacttacgtgcttcgctactattaatcgactagtagttacggtacgaacctaccggttcccggttagggttacggttccggggacgggtaacgggaacgtaaacggggtccgacccgttacgtaaggtaccgacggacccgaaggtccgtcccggacccccgttcgg

SEQ ID NO: 396959 - DNA, 549 bp, Homo sapiens
  misc_feature: GZ8MTXP02FZG8U.9.53.E09.1.454.CMB.2.raw
  modified_base (227)..(227): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccngcagtgatggttggggattatgaccttgtctctggtaccaacagcacccaggccaaacgcccccaaactcatcatttatgaggtcactaagccggccctcgaggggtttctattcgccttctctgctcaagtctgacaacacgccctccctgacaatctctggctccgaggctggacggacgaggctagtattattagtgctgcttcatacgtgacagtatggtagactaccgtcccgtagggttacttcggggacggacgggtaaccgaacgggtcgacccggttcgaggtaccacggcccaaggtcctaccggtcccccg

SEQ ID NO: 396960 - DNA, 509 bp, Homo sapiens
  misc_feature: GZ8MTXP02FGPC2.9.53.E09.1.454.CMB.2.raw
  modified_base (344)..(344): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaatcatcatttatgaggtcactaagcggccctcaggggtttctattcgccttctcnggctccaagtctgacaacacgcctccctgacaatctctggctcaggctgaggacgaggctgattattactgctgctcatatgcagatggtgacacgtcccgtggtacttcggcggacgggaccaaggtcgaacgtccgtaggtcacgcccaaaggctcgcccccg

SEQ ID NO: 396961 - DNA, 551 bp, Homo sapiens
  misc_feature: GZ8MTXP02HKAV2.9.53.E09.1.454.CMB.2.raw
  modified_base (302)..(302): a, c, t, g, unknown or other
  modified_base (360)..(360): a, c, t, g, unknown or other
  modified_base (371)..(371): a, c, t, g, unknown or other
  modified_base (377)..(377): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacttgtctcctggtaccaacagcaccaggacaaacgcccccaaatcatcattangagtcactagccggcctcgtagggtttctattcgccttctctgctcaagtctgacacncgcctcccganactctntcgctcgagctgacggcgagctgattacttatgctcgtctacataacgtgacgtagagtcggtaggacctacgttcccggttggttacggtttcggggaccgggaggggtaccgaagggtcgtaccggtcgtaacggtcgacggcccgaacggtccgtcccgtccccgttccgg

SEQ ID NO: 396962 - DNA, 634 bp, Homo sapiens
  misc_feature: GZ8MTXP02H45SN.9.53.E09.1.454.CMB.2.raw
  modified_base (247)..(247): a, c, t, g, unknown or other
  modified_base (306)..(306): a, c, t, g, unknown or other
  modified_base (352)..(352): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctccttaccctcctcactcaggacacagggtcctgggcccagtctgccctgactcagcctgcctccgtgtctgggtctcctggacagtcatcaccatctcctgcactggaaccagcagtgatggttgggattangaccttgtctcctggtaccaacagcacccaggacaaacgccccaaactcatctatttangaggtcaactaacgcggtccctgtaggggtttctattcgctttccnctcggctcaagttctacgacctaaacgacggtccctacccctagaaccaaattcctcgttcgggcctacccgaggccgtgaacgggacggaaggtcgtaggtattaactttaaccgtgtctgtctactaatagttgacaaggtaagtgggtacgtaactaacccggttcccgttagggtaacgtttcggggaccggtaacgggggaaccgtaacggggtacgtaccggtaccgtaacggtccgaacggcccgaaacggccctaccggtacccccgttcccgg

SEQ ID NO: 396963 - DNA, 539 bp, Homo sapiens
  misc_feature: GZ8MTXP02JV8SF.9.53.E09.1.454.CMB.2.raw
  modified_base (380)..(380): a, c, t, g, unknown or other
  modified_base (444)..(444): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaatcatcatttatgagtcactaagcggcctcgtaggggtttctattcgcttctctggctcagttctgacaacacggcctcctgacaatcncgtggctccgaggctgacggacgaggctgatttagtactgtctgctcatatgacagatgggtanacacgttcccgtagggtacttcggggacggacggggtaccgaagggtcgtaaccgtcgtaggtccacggaccctaacgggcctaccgtcccccgg

SEQ ID NO: 396964 - DNA, 781 bp, Homo sapiens
  misc_feature: GZ8MTXP02G9UMG.9.53.E09.1.454.CMB.2.raw
  modified_base (229)..(229): a, c, t, g, unknown or other
  modified_base (252)..(252): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtcgtgggtctccgtggacagtcgatcaccatctcctgcactggaaccngcgagtgtagttggtaggtattntcgtacttgtcctcgtacgtaaccaagacgaccaccgaacggtaaccaaaccccgaaccccctaaactctaacttacttaagtttaacgtacggtaacgtacctaaacggtaaccgggtccccgttacccggttacgggttacgggttttaccttacgttccgttcccgtttacctccgttccggtaccttaaccgtaacgttccgacgaaacccgtaaccggtaccccggtccccttaccgtacgaaaccttacgttcccgtcggtccgggtaccctaaccgggaggtaccggtaagggaaccgggtacggtacgggttacttaagtttaactttaacgttccgtagttcccggttatccgttataaacggttcgacggaacgtaggttacggtaccggtacgaacccttacccgggttccggggttaggttaccgggaccgggggacgggtaacgtaaccgggtacgtcccggtaaccgtaacggtacgacccaaccggacccgtacgtccccgtcccgttaccccg

SEQ ID NO: 396965 - DNA, 556 bp, Homo sapiens
  misc_feature: GZ8MTXP02FUDYS.9.53.E09.1.454.CMB.2.raw
  modified_base (421)..(421): a, c, t, g, unknown or other
  modified_base (438)..(438): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttggggattatgaccttgtctctggtaccaacagcaccagcaaacgccccaaatcatcatttatgagtcactaagccggcctcgtaggggtttctattcgccttctcgtgtctcaagtctgacaacacgcctcctagacaatctctcggctcaggctagacggacgaggctagtattattacngcctgccttcatatagnagtagtgtacgactaccgtcccggtaggttacgttcggggacgggacggggaaccgtaacgggtcgtaacccggtcgttacggaccgacggtacccaacggtccgtaccggtcccccg

SEQ ID NO: 396966 - DNA, 559 bp, Homo sapiens
  misc_feature: GZ8MTXP02J0TM3.9.53.E09.1.454.CMB.2.raw
  modified_base (231)..(231): a, c, t, g, unknown or other
  modified_base (311)..(311): a, c, t, g, unknown or other
  modified_base (328)..(328): a, c, t, g, unknown or other
  modified_base (457)..(457): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttggagttatgtaccttgtctcctggtaccaacagccacccaggacaaacgcccccaaactcatcattangagtcactagcgcctgngggttctactcgcttctctgcctcagtctagaccacgaccgccctacctgacctaactctcgtcgggtcctccgaggcctaggaacggaccggaggtctagtatttactacgtgcctgtctacattagngacgagtagtacgtactacgtccgtcggtacggttacggtcgggacggacggaccgtacggtccgtaccgtacgtacggtaccgaccgtacccgacgtcccg

SEQ ID NO: 396967 - DNA, 587 bp, Homo sapiens
  misc_feature: GZ8MTXP02INVQV.9.53.E09.1.454.CMB.2.raw
  modified_base (227)..(227): a, c, t, g, unknown or other
  modified_base (304)..(304): a, c, t, g, unknown or other
  modified_base (321)..(321): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcacccaggcaaacgcccccaaatcatcatttangagtcactagcggcctnaggttctctctccgtctctcgtcgtctacgtatcgtacaaccaccgaccgtccctacgacgaactactcgtcggtcggtccctacggacgtcgacgggacggacggacgtcgtagttaactttacttcgcgttcgtctctactaattcgtacgagtaagtgtcggtacaaccgttccggtcggttaggtacgtaccgggggacggtaacgggaacggtaggtccggtaaccgtcgtacgacgaccgacgtacggtcccgtccccgg

SEQ ID NO: 396968 - DNA, 629 bp, Homo sapiens
  misc_feature: GZ8MTXP02IJCM3.9.53.E09.1.454.CMB.2.raw
  modified_base (228)..(228): a, c, t, g, unknown or other
  modified_base (245)..(245): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcacccctcctcactcaggacacagggtcctgggcccagtctgccctgactcagcctgcctccgtgtctgggtctcctggacagtcgatcaccatctcctgcactggaaccngcagtgatgtgggattntgactgtctctggtaccaacagcaccaggcaaacgcccccaaactcatactatttatgaggtcaacgtaacgccggccctcgtaacggggtttctagttcgtccttctctgtctcaagtctgacaacgaccggtccctccctgactaactctcgtcgggctccgaggctggacggacgaggtcgtagtatttaattaccgtgcgttgcttactaattacgtgaccgtaggaattcgggtagtaacccgacccgtttacccgggttagggtttacgttaccgggggaccgggaaacggggtacccgtaaaacgggttccgtaaaccccggtccgtaacggttaccgaccggtaccccgaaacggtcccgtaccggttcccccccg

SEQ ID NO: 396969 - DNA, 528 bp, Homo sapiens
  misc_feature: GZ8MTXP02JGQ68.9.53.E09.1.454.CMB.2.raw
  modified_base (301)..(301): a, c, t, g, unknown or other
  modified_base (416)..(416): a, c, t, g, unknown or other
  modified_base (435)..(435): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagactgcctccgtgtctgggtctcctggacagtcgatcaccatctcctgcactggaaccagcagtgatggttgggattatgaccttgtctcctggtaccaacagcacccaggcaagcccccaaatcatcattangaggtcactaagcggcctgagggtttctattcgcttctctgtctcaagtctgacacacgcctcctgacatctctggctcgaggctgaggacgagctagattatactgtctgtctnatacgtgacagtatggtanacacgttcccgtggtacttcggggacggtaacggacccgtaaagggtcgacccggtcgtaggtccgacggaccaacggtcctccggtcccccg

SEQ ID NO: 396970 - DNA, 528 bp, Homo sapiens
  misc_feature: GZ8MTXP02GNW46.9.53.E09.1.454.CMB.2.raw
  modified_base (226)..(226): a, c, t, g, unknown or other
  modified_base (302)..(302): a, c, t, g, unknown or other
  modified_base (382)..(382): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcaccaggcaaacgcccccaaatcatcatttangaggtcactaagcgccctgagggtttctattcgccttctctggctccaagtctgacaacaccggcctccctgacaatctntcgggctccgaggctgaggacgaggtctgattattactgctgctacatatgacagtatggtagactacgtccgtggtacgttcgggacggtacggaccgaaggtcgaccgtcgtacggtacacgtacccgaaggcctcgtcccccg

SEQ ID NO: 396971 - DNA, 774 bp, Homo sapiens
  misc_feature: GZ8MTXP02JPD9Y.9.53.E09.1.454.CMB.2.raw
  modified_base (327)..(327): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcacgtggaaccagcagtgagtggttgggtagttatcgtaccttgtctccgtaggtaaccaacacgaccacccgaggaccaaaccgacccccaaactcatctatttangacgtacacgtaacgccgtacctcgtacgggtttctacgttcgtcttctacgtcggtcctactacgtcctacgaacctaaaccgccggtaccccttacccgtacgtaaacctaacgttccgttccgtcggggtcccttacccggtaacggccgttacgggaaacggggaaccggtacgggttacctttaaggttaacgttttaaaactttaccgttacggtaccttccggtaccttaaccgtaacttaacgttaggtaaccgaaggtagggtttaaacggccggttaaaacccggtacccggtttaccccggggttagggttaaaccgggtttccgggggaaccggggttaaccgggggaacccggttaaacgggtaacccggtaacccggttaccggttaaccggggtaccgtaaacccgggtaccccggaaacgggttcccccgg

SEQ ID NO: 396972 - DNA, 548 bp, Homo sapiens
  misc_feature: GZ8MTXP02HDH24.9.53.E09.1.454.CMB.2.raw
  modified_base (417)..(417): a, c, t, g, unknown or other
  modified_base (428)..(428): a, c, t, g, unknown or other
  modified_base (436)..(436): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctggtctctggacagtcgatcaccatctcctgcacgtggaaccagcagtgatggttgggattatgacttgtctctggtaccaacagcaccaggacaaacgcccccaaatcatcattatgagtcataagccggcctgagggtttctattcgccttctctggctaccaagtctgacaacacgccctccctgaacaatctcgtggctccgagcgtagacggacgagctagattaattcngtcttgcctanatatcganagagtagtacgtacgtaccgtccggtcggtacggtacggtacgggaacggacggtaacggtacggtaccgtaaccgtacgtacgaccgaccgaccgtaccgtaccgtccccg

SEQ ID NO: 396973 - DNA, 560 bp, Homo sapiens
  misc_feature: GZ8MTXP02HG24O.9.53.E09.1.454.CMB.2.raw
  modified_base (261)..(261): a, c, t, g, unknown or other
  modified_base (394)..(394): a, c, t, g, unknown or other
  modified_base (546)..(560): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattacngtgcgagagttcccaaatatagcaacagctggtacatttccttttgatagtggtggggccaaaggggacaaagtggtaccaccgtctcttcagccctccacccgaacgggccccagtccggtccttcccccgnggcccgccctgcctccgaggacgccaccctccgagacgccacgacggcccggccccgtggggcctcggccgtagggtaccaaagggtaccttaaccgttccgaagaccgtatccacgtggacggcgggctgggacaagggccgtacagtagnnnnnnnnnnnnnnn

SEQ ID NO: 396974 - DNA, 512 bp, Homo sapiens
  misc_feature: GZ8MTXP02HNXE2.9.53.E09.1.454.CMB.2.raw
  modified_base (298)..(298): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggattatgacttgtctctggtacaacagcacccaggcaaacgccccaaactcatcatttangaggtcactaagcgcctcaggggtttctattcgccttctctggctcaagtctgacaacacggcctcctgacaatctctgggctcgagctgacgacgagctgattatactgcttgctcatatgcagatgtgacacgtcccgtggtagttcggacgggacgggaccgaacggtcgaccgttccgtaaggtcacggcccaacggccttacgcccccg

SEQ ID NO: 396975 - DNA, 662 bp, Homo sapiens
  misc_feature: GZ8MTXP02G8OCE.9.53.E09.1.454.CMB.2.raw
  modified_base (223)..(223): a, c, t, g, unknown or other
  modified_base (312)..(312): a, c, t, g, unknown or other
tcagtgatacgtctcacgaccggtgctcgatttagagagagtgtggttggggggtcacaagaggcagcgctctcgggacgtctccaccatggcctgggctctgctgctcctcaccctcctcactcaggacacgagggtcctgggcccagtctgccctgactcagcctgcctccgtgtctgggtctccgtggacagtcgatcaccatctcctgcactggaaccngcagtgatggttgggattatcgtaccttgtcctcctaggtaccaacacgccaacccgaggaccaaaccgccccaaactcatctatttangagtcactagccgtcctgtagggttctagtcgtcttcctcgtgctactaagtctagaccaacgaccgtccctacctagaacaacttcctcgtcgggtccttacccgacggtccgtagggacgggacggtacggtacttaggtaaacgtttaattacccgttgtccgtcggttaccttactacttaacgtcgacgtaacgtaaggtacggttaccgtaaccgtacccgttcccgggttaggttaacgggttccggggacggaaacggggtaaccgaacggggttaccgtacccggtaccgttaacggccgtaaccggcccgaacggtcccgtacccgtccccgttacccgg

SEQ ID NO: 396976 - DNA, 664 bp, Homo sapiens
  misc_feature: GZ8MTXP02FL7UU.9.53.E09.1.454.CMB.2.raw
  modified_base (227)..(227): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgtagtggttaggattagtcgtacttgtcctccgtagtaaccacacgacccaaccgaggaccaaaccgacccccaaaactcattactaatttagtggtacggtacaacgtaacggcccggtccctacggttacgggtttctacgttcgtcccttctcgtcggtcctacgaacgttctacgaaccaaccgaccggtccctccgtagactactctcgtcggcctcgacgcgtaggacggacgtacgtctagtatttaactcgtgtcgtgtctataatacgtagacgtaagtagttacgggttacacccgttacccggttaccggttaggttacgggttaccgggggacggggaaacgggtaaccgtaaacggggtcgttaaccccgtcggttacggaccgacccggtaccgaacgggtccctacccggtcccccg

SEQ ID NO: 396977 - DNA, 515 bp, Homo sapiens
  misc_feature: GZ8MTXP02H2294.9.53.E09.1.454.CMB.2.raw
  modified_base (261)..(261): a, c, t, g, unknown or other
  modified_base (314)..(314): a, c, t, g, unknown or other
  modified_base (384)..(384): a, c, t, g, unknown or other
  modified_base (404)..(404): a, c, t, g, unknown or other
  modified_base (415)..(415): a, c, t, g, unknown or other
  modified_base (501)..(515): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattacngtgcgagagttacccaaatatagcaacagctggtacatttcctttgatagtgnggggaccaaagggacaagtggtcaccgttctctcagcctccacccgaggccccatccggtcctcccccgngccgccctgcctcgaggacncaccctccganacgcacagcggtccctgggctgccgtgtacaaggactaccttcagtacgtatcacgtagcgcgggactcggcgaagggcacagtgnnnnnnnnnnnnnnn

SEQ ID NO: 396978 - DNA, 557 bp, Homo sapiens
  misc_feature: GZ8MTXP02IF1LQ.9.53.E09.1.454.CMB.2.raw
  modified_base (226)..(226): a, c, t, g, unknown or other
  modified_base (302)..(302): a, c, t, g, unknown or other
  modified_base (374)..(374): a, c, t, g, unknown or other
  modified_base (379)..(379): a, c, t, g, unknown or other
  modified_base (435)..(435): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccngcagtgatgttgggattatgaccttgtctcctcggtaccaacagccaccaggacaaacgccccaaatcatcattangagtcactaagcgcctgtagggttctatcgccttctctggctacaagtctgacaacacgcctccctgactanctcgnggcctcgagctaggaggacgaggctgtaattattacgtcgtctcgcttacattagngacagtagtggtacgacaccgttccggtaggttacggttcgggacgggaacgggtaccgtaacgggtccgtaccgtaaccgtaggtaccgacggacccgtaacggccctaccggtccccccg

SEQ ID NO: 396979 - DNA, 560 bp, Homo sapiens
  misc_feature: GZ8MTXP02HRJ40.9.53.E09.1.454.CMB.2.raw
  modified_base (226)..(226): a, c, t, g, unknown or other
  modified_base (305)..(305): a, c, t, g, unknown or other
  modified_base (453)..(453): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccngcagtgattggttggggattatgtaccttgtctcctggtaccaacagcacccaggcaaacgcccccaaatcatcattangagtcactaagcgcctgtagggtttctattcgccttctctggctcaagtctcgaaccaacaccggccctaccctagaacctaactctcgtggcctccgaggcctaggacgggacgagggctagtacgtttattacgtgtctgtacctnaatagtgacgtaagtgtggtgacctacgtccggtaggttacgtcggacgggacggaccgtacggtcgaccgtcgtaggccacggacccgacggcctccggtcccccg

SEQ ID NO: 396980 - DNA, 582 bp, Homo sapiens
  misc_feature: GZ8MTXP02H8DM1.9.53.E09.1.454.CMB.2.raw
  modified_base (412)..(412): a, c, t, g, unknown or other
tcagtgatacgtctcacgaccggtgctcgatttagagagagtgtgttgggtttggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcacatctcctgcactggaaccagcagtgattggttgggagttatgtaccttgtctccgtcggtaccaacagccaccgagaccaaaccgacccccaaactcatactatttatgagtacactaagccggcctacgtaggggtttctacgttcgtcttctcgtggtcttccagtctacgaaccaacgtaccgccctaccctgaacctanccttacgtcgggccctaccgaggtctaggaggaccgaggctagtatttacttacgtgcctgctcatatgacagtatgggtacactacggttcccggtagttacggttcgggacgggacggtaccgaaggtccgacccgtacgtacggtcgaccggaccgtaacggtcccg

SEQ ID NO: 396981 - DNA, 522 bp, Homo sapiens
  misc_feature: GZ8MTXP02GKFR3.9.53.E09.1.454.CMB.2.raw
  modified_base (293)..(293): a, c, t, g, unknown or other
tcagtgatacgtctcacgaccggtgctcgatttagagagagtgtgttggggggtcacaagaggcagcgctctcgggacttctccaccatggcctgggctctgctgctcctcaccctcctcactcaggacacagggtcctgggcccagtctgccctgactcagcctgcctccgtgtctgggtctcctggacagtcgatcaccatctcctgcatggaaccagcagtgatgtgggattatgacttgtctcctggtaccaacagcacccaggacaaacgccccaaactcatcattangagtcactaagcgcctgagggttcatcgcttcctctgctcagtctgacaacacgcctccctgaacacttctcgtggcctccgagcgtgacggacgaggctgattattactgctgctcatatgcagtagtggtcacgtaccgtccgtggttacgtcgggacggacggggtaaccacggtacgtccgtaccgaagtcgacgaccgaacgtccgtcccgtccccgtacccgg

SEQ ID NO: 396982 - DNA, 538 bp, Homo sapiens
  misc_feature: GZ8MTXP02FRA70.9.53.E09.1.454.CMB.2.raw
  modified_base (377)..(377): a, c, t, g, unknown or other
  modified_base (384)..(384): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcaccaggacaaacgcccccaaatcatcatttatgaggtacactaagccgccctcgaggggtttctattcgcttctctggctcagtctgacacacgcctccngacatcncgtggctcagctgagagagctagtattattactgctgctacatactgacagtatggtacgacctacgttcccggtaggttaacgttcggggacgggaacgggaaccaaggggtcgtacccggtaccgttacggcacggacccgtaaggtccccg

SEQ ID NO: 396983 - DNA, 532 bp, Homo sapiens
  misc_feature: GZ8MTXP02JJGJM.9.53.E09.1.454.CMB.2.raw
  modified_base (267)..(267): a, c, t, g, unknown or other
tcagtgatacgtctcacgaccggtgctcgatttagagagagtgtgttggggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgacttgtctcctggtaccaanagcacccaggcaaacgcccccaaatcatcattatgagtcactaagcgcctcaggggtttctattcgcttctctgctcaagtctgacacacggcctcctgacaatctctgggctcgagctgaggacgtaggctgatttatactgctgcttcgatatgactagatggtagactacgttcccggtagtacgttcggggacggacggggaaccaacgggtcgaacccggtcgtacggtccgacgacccgtaacggcctccggtcccccg

SEQ ID NO: 396984 - DNA, 534 bp, Homo sapiens
  misc_feature: GZ8MTXP02GN23S.9.53.E09.1.454.CMB.2.raw
  modified_base (227)..(227): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttggggattatgaccttgtctcctggtaccaacagcacccaggcaaacgcccccaaactcatcattatgaggtcactaagcggcctcgaggggtttctattcgcttctctgctcaagtctgacaacaccgcctccctgacaactctcgtgggctccgaggctaggacggacgaaggtctagatttaacttactgtctgctcatatgcagtagtggtagacacgtcccgtggtagttcgggcgggaacgggaccgacggtgaccgtcgtaggtccacggcccaaggcctcgtcccccgg

SEQ ID NO: 396985 - DNA, 548 bp, Homo sapiens
  misc_feature: GZ8MTXP02G7LRK.9.53.E09.1.454.CMB.2.raw
  modified_base (225)..(225): a, c, t, g, unknown or other
  modified_base (300)..(300): a, c, t, g, unknown or other
  modified_base (363)..(363): a, c, t, g, unknown or other
tcagtgatacgtctcacgaccggtgctcgatttagagagagtgtgttgggtttggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttggattatgaccttgtctctggtaccaacagcaccaggacaaacgcccccaaactcatcatttangagtcactaagcggcctcgtagggtttctattcgcttctctgctcatctgacacacgcctccngacatctcgtggctccgagctgacggtacgaggtctagatttagtactgctgctacatatgcaagtatggtacacgtacgttcccggttagggttaacgttccggggacgggtaacgggaccgtaaacgggtccgtaaccggtaaccgtaggtaccacggacccgaacggccgtccgtcccccgg

SEQ ID NO: 396986 - DNA, 584 bp, Homo sapiens
  misc_feature: GZ8MTXP02JIQB7.9.53.E09.1.454.CMB.2.raw
  modified_base (227)..(227): a, c, t, g, unknown or other
  modified_base (304)..(304): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacagcacccaggcaaacgcccccaaactcatcatttangaggtcactaacgcggcctcgaggggtttctattcgccttctctgctcagtctgacaacacgcctcctgacatctctggctcgagctgaggacgagctgattatactgcttgctcatacgtgactagacttgggtacgaccgtaccgttaccccggttgggttaaacgtttccgggggacgggaaacggggtacccgaaaaggggttccggaacccggttaacccgtacggttaccgaacgggtaccccgaaaacggggtcccttaccggtcccccccgg

SEQ ID NO: 396987 - DNA, 517 bp, Homo sapiens
  misc_feature: GZ8MTXP02FG991.9.53.E09.1.454.CMB.2.raw
  modified_base (410)..(410): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgccccaaactcatcatttatgaggtcactaagcggcctcaggggttctattcgccttctctggctcaagtctgacaacacggcctcctgacaatctctggctcagctgaggacgaggctgattatacngctgctcatatgcagatggtgacacgtcccgtggtattcgggacgggagggacccaaagggtcgaacccggtccgtaaggtcacggcccaaaggcctcgtccccccg

SEQ ID NO: 396988 - DNA, 523 bp, Homo sapiens
  misc_feature: GZ8MTXP02F0OFS.9.53.E09.1.454.CMB.2.raw
  modified_base (300)..(300): a, c, t, g, unknown or other
  modified_base (365)..(365): a, c, t, g, unknown or other
tcagtgatacgtctcacgaccggtgctcgatttagagagagtgtggttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggacaaacgcccccaaaatcatcatttangaggtcactaagcgcctcgtagggtttcattcgcttcctctgctcaagtctgacacacgcctccnacatctctggctcgaggctgaggacgaggctagtattattactgctcgctacatatgcagagtggtcgactaccgtcccggtaggtacgttcgggacggtacgggaccaagggtcgaccgtcgtaaggtcacggcccaaggcctaccgccccgtccgg

SEQ ID NO: 396989 - DNA, 542 bp, Homo sapiens
  misc_feature: GZ8MTXP02G317L.9.53.E09.1.454.CMB.2.raw
  modified_base (225)..(225): a, c, t, g, unknown or other
  modified_base (419)..(419): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactggaaccngcagtgatgttgggattatgaccttgtctcctggtaccaacagcacccaggaccaaacgcccccaaatcatcattatgagtcactaagcgcctcgagggtttctattcgccttctctgctcaagtctgacacacgcctcctgacatctcgcggctccgagcgtgaggacgagctagtattattctgtctgctanatagtgactagtatggtacacgtaccgttccgtagggttacgttcgggacgggtacgggaccgtaaagggtcgtaacccggtcgtacggtacgacggacccgtaacggccgtccggtcccccg

SEQ ID NO: 396990 - DNA, 508 bp, Homo sapiens
  misc_feature: GZ8MTXP02I6IQ7.9.53.E09.1.454.CMB.2.raw
  modified_base (268)..(268): a, c, t, g, unknown or other
  modified_base (302)..(302): a, c, t, g, unknown or other
  modified_base (367)..(367): a, c, t, g, unknown or other
  modified_base (428)..(428): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaanagcacccaggcaaagcccccaaatcatcatttangagtcactaagcggcctcagggtttcattcgcttctctgctcaagtctgacacacgcctcccganatctctggctcaggctgaggacgaggctagattattactgctgctcatactgcagatggtnacgacttcccgtggtacgttcggcgggaggaccgtaagggtcgaccgttcgtaaggtcacgcccaggctcgccccttcgg

SEQ ID NO: 396991 - DNA, 520 bp, Homo sapiens
  misc_feature: GZ8MTXP02J1NU9.9.53.E09.1.454.CMB.2.raw
  modified_base (227)..(227): a, c, t, g, unknown or other
  modified_base (269)..(269): a, c, t, g, unknown or other
  modified_base (301)..(301): a, c, t, g, unknown or other
  modified_base (322)..(322): a, c, t, g, unknown or other
  modified_base (324)..(324): a, c, t, g, unknown or other
  modified_base (331)..(331): a, c, t, g, unknown or other
  modified_base (340)..(340): a, c, t, g, unknown or other
  modified_base (345)..(345): a, c, t, g, unknown or other
  modified_base (352)..(352): a, c, t, g, unknown or other
  modified_base (370)..(371): a, c, t, g, unknown or other
  modified_base (379)..(379): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctcctggtaccaacngcaccaggcaaagcccccaaatcatcatttangagtcacagcgcctgtggttntntctctcntgctcatcnacacncgctccnacatctcgcggctcgagnngagagagngtatattattatgctgtctactatatgacgagtagtggtagtactaccgtccggtacggtacggtacgggacgggacgggaaccgaacggtacgtaccgtaaccgtacgtacgacgacccgaccggaccgtaccgtccccg

SEQ ID NO: 396992 - DNA, 605 bp, Homo sapiens
  misc_feature: GZ8MTXP02GNOH1.9.53.E09.1.454.CMB.2.raw
  modified_base (230)..(230): a, c, t, g, unknown or other
  modified_base (320)..(320): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccngcagtgattggttgggattatgtaccttgtctccgtaggtaccaacacgaccacccgaggaccaaaccgacccccaaatcatctatttangagtacacgtaagccgcctgtagggtttctacttcgtcttctctgcctacagtctacgaacaaccgaccgtccctccctagaacctattcctcgtcgggcctccgaggcgtaggacgggacgaggtctagttaatttacttacgtgtcttgctacattatcgactagacgttgacgaaccgtaccgttccggttaggttacggttacgggaccgggtaaacggtaccgtaaagggtccgtacccggtaccgttacggaccgaccggacccgtaacgggtcccccg

SEQ ID NO: 396993 - DNA, 519 bp, Homo sapiens
  misc_feature: GZ8MTXP02FR8YH.9.53.E09.1.454.CMB.2.raw
tcagtgatacgtctcacgaccggtgctcgatttagagagagtgtgttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaacgcccccaaactcatcatttatgaggtcactaagcggccctcgaggggtttctattcgcttcctctggctcaagtctgacaacacggcctcctgacaatctctgggctccgagctgagacgaggctgattattactgctgctcatatgcagatggtgactaccgtcccgtggtattcgggcggacgggaccaaacgggtcgaccggtcctaaggtcaacgcccgaaggcctcgcccccgttcgg

SEQ ID NO: 396994 - DNA, 505 bp, Homo sapiens
  misc_feature: GZ8MTXP02GO5LV.9.53.E09.1.454.CMB.2.raw
  modified_base (298)..(298): a, c, t, g, unknown or other
  modified_base (415)..(415): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggattatgaccttgtctctggtaccaacagcaccagcaaacgccccaaatcatcatttangagtcactaagcgcctgagggtttctattcgcttctctggctcagtctgacaacacggcctcctgacatctcgtggctcgaggctgacggagaggctagtatttatactgtctgctnatactgactagatggtacgactacgtccgtggtaacttcgggacggacggaccgaggtcgaaccgtcgtagcacgaccaggctcgtcccg

SEQ ID NO: 396995 - DNA, 534 bp, Homo sapiens
  misc_feature: GZ8MTXP02F4UGJ.9.53.E09.1.454.CMB.2.raw
  modified_base (227)..(227): a, c, t, g, unknown or other
  modified_base (304)..(304): a, c, t, g, unknown or other
  modified_base (369)..(369): a, c, t, g, unknown or other
  modified_base (377)..(377): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgtaccttgtctcctggtaccaacagcaccaggacaaacgccccaaatcatcatttangagtcactaagcgcctgtagggtttctattcgccttctctgcctcagtctgacacacgcctcctnacatctcnggctcgagctgaggacgagctagtattatactgtctgctactatatcgagtagagtggtcacgtacgtccggtggtacgttcgggacggggaacgggaccgtaaaggtccgaccgtccgtaacggtccgacggccgtaacggcgtcccgtcccccgg

SEQ ID NO: 396996 - DNA, 540 bp, Homo sapiens
  misc_feature: GZ8MTXP02HCSA6.9.53.E09.1.454.CMB.2.raw
  modified_base (269)..(269): a, c, t, g, unknown or other
  modified_base (300)..(300): a, c, t, g, unknown or other
  modified_base (446)..(446): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggggattatgaccttgtctctggtaccaacngcaccaggcaacgccccaaatcatcatttangagtcactaagcggcctcgaggggtttcattcgccttctctggctccaagtctcgacaacacggtcctccctagacaatctctcgggctccgaggctggacggacgaggctagtattaatctgctgctcatatgacagatgggtanactaccgtccggtaggttacttcggggacggacgggtaccgaaggtccgaaccggtccgtaggtaccgacgcccgaacggtcctccgtcccccg

SEQ ID NO: 396997 - DNA, 518 bp, Homo sapiens
  misc_feature: GZ8MTXP02FMQT3.9.53.E09.1.454.CMB.2.raw
  modified_base (304)..(304): a, c, t, g, unknown or other
  modified_base (323)..(323): a, c, t, g, unknown or other
  modified_base (435)..(435): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggggattatgaccttgtctcctggtaccaacagcacccaggcaaacgcccccaaatcatcatttangaggtcactaagcggcctnaggggtttctattcgccttctctgctcaagtctgacaacacggcctcccgacactctctggctccaggctgagacgaggctgattattactgctgctcatatgcagatggtnactacgtcccgtggtacgttcggacggagggaccaagggtcgaaccgtccgtaaggtcacggccaaggcctcgcccccgtcgg

SEQ ID NO: 396998 - DNA, 546 bp, Homo sapiens
  misc_feature: GZ8MTXP02GUYAH.9.53.E09.1.454.CMB.2.raw
  modified_base (227)..(227): a, c, t, g, unknown or other
  modified_base (436)..(436): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgacttgtctctggtaccaacagcaccaggcaaacgcccccaaatcatctattatgagtacactaagcgcctgtagggtttctattcgccttctctgctcaagtctgacaacaccgcctccctagacaatctctggcctcgaggctgacggacgaggtctagtattagttactgtctgtcttacattaancggtatagtacgtcgtacgtaccgtaccgttccggtaggttacggtcggggacggacggacgtacggtacgtaccgtcgtacgacgacgaccgacggtccgtccgtcccg

SEQ ID NO: 396999 - DNA, 732 bp, Homo sapiens
  misc_feature: GZ8MTXP02H0KNR.9.53.E09.1.454.CMB.2.raw
  modified_base (227)..(227): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccatctcctgcactggaaaccngcagtgagttggttgggtattatcgtaccttgtctcgtcggtaaccaacacgaccaccgacggaccaaaccgacccccaaactacctactactaatttagtaggtacgtaccaacgtaacggccggtcccgttacggttacgggttttacctacgtttccgtccgtttccgtcgttcggtccttaccgtaacgttccgtacgaacctaaaccggtacccgtccccgttacccgtacgtaaacctaccttccgtcggtccggtcccgtaccgacggtcgtagggaacgggtacggtacggtacgttagttaactttaacgttacgttacgtcgttacgtctactagtagtacgacgtagtagtcggtacgtaccgtacccggttacgggttacgggttacggttaccggggacggggtaacgggtaaccggtacgggtaccggtacccggttaaccggtacgggtaccgtaccggacccgtacggtcccgtaccccggtacccccg

SEQ ID NO: 397000 - DNA, 586 bp, Homo sapiens
  misc_feature: GZ8MTXP02IUHYZ.9.53.E09.1.454.CMB.2.raw
  modified_base (226)..(226): a, c, t, g, unknown or other
  modified_base (262)..(262): a, c, t, g, unknown or other
  modified_base (292)..(292): a, c, t, g, unknown or other
  modified_base (361)..(361): a, c, t, g, unknown or other
  modified_base (433)..(433): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcaccatctcctgcactgaaccngcagtgatggtggattatgacttgtctctgtaccanagcaccagcaacgccccaatcatcatttangaggtcactaacgccggcctcgtagggtttctattcgcttctctgctcatctgacaacaccgccctccngacactctcgcggtactccgagcgtaggacggacgtagggctagtactttacgttacttcggactgtacctntaagttactgacagtaagtttcggagtacctacgttcccggtaggttacggttaccggggcgggtaaacgggtaccgaaaacgggttccgtaaacccgtcgtaacggtcgaaacccggtacccgaaacgggttccgtacccggtaccccccgg

SEQ ID NO: 397001 - DNA, 547 bp, Homo sapiens
  misc_feature: GZ8MTXP02F35LR.9.53.E09.1.454.CMB.2.raw
  modified_base (226)..(226): a, c, t, g, unknown or other
  modified_base (245)..(245): a, c, t, g, unknown or other
  modified_base (299)..(299): a, c, t, g, unknown or other
  modified_base (417)..(417): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcacgtggaaccngcagtgatggttgggattntgaccttgctcctggtacaacagcaccagacaaacgccccaaatcatcatttangagtcactaagccgcctcgtagggtttctattcgtccttctcgtgcctacaagtctcgacaacgacgcctccagacatctgtcggctacgagctagacggagagctagtattattacngtcttgctataatacgtgacgagtacgtggtacacgtccgttaccggtggtacgttcgggacggacgggtaacgtaacggtcgtaaccgtcgtacggtacgtacggaccgaacggtcctccggtcccccg

SEQ ID NO: 397002 - DNA, 504 bp, Homo sapiens
  misc_feature: GZ8MTXP02FID39.9.53.E09.1.454.CMB.2.raw
tcagtgatacgtctcacgaccggtgctcgatttagagagagtgtgttgggtttggggggtcacagaggcagcgctctcgggacgtctccaccatggcctgggctctgctgctcctcaccctcctcactcaggacacagggtcctgggcccaatctgccctgactcagcctgcctccgtgtctgggtctcctggacagtcgatcaccatctcctgcactggaaccagcagtgatgttgggattatgaccttgtctcctggtaccaacagcacccaggccaaagcccccaaactcatcatttatgaggtcactaagcgccctcaggggttctattcgccttctctgctcagtctgacaacacgcctcctgacatctctgggctccaggctgaggacgaggctgattattactgctgctcatatgcagatggtagacactcccgtggtacttcgggcggacgggacaacggtgaccgtcgtaggtcacgcccgaaggcctcgccccg

SEQ ID NO: 397003 - DNA, 549 bp, Homo sapiens
  misc_feature: GZ8MTXP02IALDT.9.53.E09.1.454.CMB.2.raw
  modified_base (223)..(223): a, c, t, g, unknown or other
  modified_base (308)..(308): a, c, t, g, unknown or other
  modified_base (360)..(360): a, c, t, g, unknown or other
  modified_base (407)..(407): a, c, t, g, unknown or other
  modified_base (428)..(428): a, c, t, g, unknown or other
  modified_base (437)..(438): a, c, t, g, unknown or other
  modified_base (440)..(440): a, c, t, g, unknown or other
  modified_base (442)..(442): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacgagggtcctgggcccagtctgccctgactcagcctgcctcgtgtcgtggtctctggacagtcatcacatctctgcactggaaccngcagtgagttggtagggattatgacttgtctctagtaaccaacacgccaaccaggaccaaacgaccccaaatcatctaatttagngtaggtacaacgtaacgccggaccttgtagggtttctagttcgccttctcgngacttcgaagttcagaacaaacgccgtcctacctagaacactctcgnggcacgagcgtagagacgagntatattatnntntnctatatatagagagtagtagtacgtacgtacgtacgtacgtacgtacggacggacggacgtacgtacgtacgtaacgtacgacgacgaccgacgtaccgtccgtccg

SEQ ID NO: 397004 - DNA, 564 bp, Homo sapiens
  misc_feature: GZ8MTXP02G88BZ.9.53.E09.1.454.CMB.2.raw
  modified_base (447)..(447): a, c, t, g, unknown or other
  modified_base (455)..(455): a, c, t, g, unknown or other
  modified_base (458)..(458): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccagcagtgatggttggggattatgaccttgtctcctggtaccaacagcacccaggacaaagcccccaaatcatcatttatgagtcaataacgcggcctcgtcggggtcccctgatcccgtcttcctcgtcggctaccaagtctggcaaaccaccggccctccctgacccgttctcgtcgggcctccgagccgtagaccgatcggaagtctagtattattacgngcagctanatncgcgacgaccaaccactaatcgtacgtacggaacgtcggaacctaccgtccgtaccgtacgtaacggtaccgaaccgacccgaaccgaccccaacccgtacgtccg

SEQ ID NO: 397005 - DNA, 522 bp, Homo sapiens
  misc_feature: GZ8MTXP02HD6QO.9.53.E09.1.454.CMB.2.raw
  modified_base (228)..(228): a, c, t, g, unknown or other
  modified_base (269)..(269): a, c, t, g, unknown or other
  modified_base (303)..(303): a, c, t, g, unknown or other
  modified_base (443)..(443): a, c, t, g, unknown or other
  modified_base (450)..(450): a, c, t, g, unknown or other
  modified_base (453)..(453): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctctggtaccaanagcaccaggacaacgcccccaaatcatcatttangagtcactaagccggcctcgtaggggtttctattcgccttctctggctcaagtctgacaacacggccctcctgacaatctctgggctccgagtccgtagagggacgaggtctagtattattactgcttgctactatatgnagatggnacncctcggtgagttcgggcggacggtaccgaaggtcgaccgtcgtaggtcacgcccaggcctccgtccccg

SEQ ID NO: 397006 - DNA, 544 bp, Homo sapiens
  misc_feature: GZ8MTXP02GWPX7.9.53.E09.1.454.CMB.2.raw
  modified_base (246)..(246): a, c, t, g, unknown or other
  modified_base (364)..(364): a, c, t, g, unknown or other
  modified_base (406)..(406): a, c, t, g, unknown or other
  modified_base (414)..(414): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattntgaccttgtctcctggtaccaacagcaccaggacaaacgccccaaatcatcattatgagtcactagcgcctgacgggttctagttcgcttctctgctacagtctgacacacgcctccngacatctcgtggctcgaggctgaggacgagctgattattacngtcgtgtnactatagtgactagacgttgacgacgtaccgttcgtacggttacgtccggggacggtaacggaccgtaaacggtcggtaacccgtcgtaaacggtccgacggacccgaacggtccgtaccgttcccccgg

SEQ ID NO: 397007 - DNA, 638 bp, Homo sapiens
  misc_feature: GZ8MTXP02H7WEV.9.53.E09.1.454.CMB.2.raw
  modified_base (226)..(226): a, c, t, g, unknown or other
  modified_base (299)..(299): a, c, t, g, unknown or other
  modified_base (308)..(308): a, c, t, g, unknown or other
  modified_base (360)..(360): a, c, t, g, unknown or other
  modified_base (366)..(366): a, c, t, g, unknown or other
  modified_base (386)..(386): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgagttggttgggattatgaccttgtctcctggtaaccaacacgcacccaggaccaaacgcccccaaancatcattangagtacactaagcgcctcgtagggttctatcgtcctctctcgctcaagtctnacaacncgcctcctgactactctcgnggctccgaggctgacggacaggctacgtattactctgtcttagctacaattagacgtactagtacgttcgggaacgtaccgtaaccccgttcccgggttaaggtttcggttacccggggtacgggggaaaccggggtaaacccgtaaacgggggttcccggtaaaccccggtttaacccggtaaccgggttaaccccgaaccggtaacccccggtaaacgggcccccgtttaccccgggtaccccccccggg

SEQ ID NO: 397008 - DNA, 539 bp, Homo sapiens
  misc_feature: GZ8MTXP02GG489.9.53.E09.1.454.CMB.2.raw
  modified_base (301)..(301): a, c, t, g, unknown or other
  modified_base (370)..(370): a, c, t, g, unknown or other
  modified_base (378)..(378): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctgaacagtcgatcaccatctcctgcactggaacagcagtgatgttggattatgacttgtctcctggtaccaacagccaccaggacaaacgcccccaaatcatcatttangagtcactaagcggccctcgagggtttctattcgccttctctggtctcaagtctgacacacggcctccngacatctntcggctcgaggctggaggcgaggctagatttattactgtctgctactatactgctagatggtagacctaccgtccggttggtaacgttcgggacgggtacgggaacctaagggtccgtaccggtccgtacggccacggtacccaaggccctccgtcccccg

SEQ ID NO: 397009 - DNA, 584 bp, Homo sapiens
  misc_feature: GZ8MTXP02JHCUR.9.53.E09.1.454.CMB.2.raw
  modified_base (230)..(230): a, c, t, g, unknown or other
  modified_base (312)..(312): a, c, t, g, unknown or other
  modified_base (474)..(474): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtcgtgggtctccgtggacagtcgatcaccatctcctgcactggaaccngcagtgattggttgggattatgaccttgtctcctggtaccaacagccacccaggaccaaacgacccccaaatcatctattangaggtcactaagccgtcctcgtaggggtttcagtttcgccttcgtctggcctacaagttctgacctaacaccggtcctccctagactaactctcgtcgggctccgaggctaggaggacgaggtctagtaatttacgtactggtctcgtctactatagtcganaagtgtacggtacgtacgaccgttccggtaggttacgtcgggacgggaacgggacctaacgggtgaaccgtcgtacggtacgacgacccgacggtccgtaccgtccccgg

SEQ ID NO: 397010 - DNA, 557 bp, Homo sapiens
  misc_feature: GZ8MTXP02F1N93.9.53.E09.1.454.CMB.2.raw
  modified_base (227)..(227): a, c, t, g, unknown or other
  modified_base (308)..(308): a, c, t, g, unknown or other
  modified_base (364)..(364): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgtaccttgtctcctggtaccaacagcacccaggacaaacgcccccaaactcatctatttangagtcactagccgcctgtagggttctattcgccttctctgctcaagtctgacaacncgcctcctgacatctcgtcggctcgaggctggacgacgagctagatttatacgtgctgactacatatgacagtagtggacactaccgtccggtaggttacggttcggggacgggtaacgggaccgtaagggtccggtaacccgttaacgttacggacgaccgggacccgaacggcccgtacccggtcccccgg

SEQ ID NO: 397011 - DNA, 710 bp, Homo sapiens
  misc_feature: GZ8MTXP02IZY0X.9.53.E09.1.454.CMB.2.raw
  modified_base (220)..(220): a, c, t, g, unknown or other
tcagtgatacgtctcacgaccggtgctcgatttagagagagtgtgttggggggtcacaagaggcagcgctctcgggacttctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttggattatgaccttgtctccgtaggtaccaacgagccaacccgaggaccaaaaccgacccccctaaaactccaatacctaattttacgaggtaacggtacctaacgtaaacggcccgggtccccttacggtacggggttttctaacgttccgtcctttccctccgtcggtaccttacctaaggttccttacggacccaaccgtaacccggtccccttaccccgtaagaacctaaacgttccgttaccgtcggggtcccttaccgacgggtcgttacgggaacgggtaccggaggtccgttaggtaatttaacttacgtcggtacttcgtctacgtattagtacgactaggtacgtggtacaacgtccgtcccggttaggttacgtcggggacgggtaacggtaaccgtaacggggtaccgtaccggtaccgtaacggtaccgaacggacccgaaggtcccgtacccgtcccccgttacg

SEQ ID NO: 397012 - DNA, 595 bp, Homo sapiens
  misc_feature: GZ8MTXP02IS0U8.9.53.E09.1.454.CMB.2.raw
  modified_base (227)..(227): a, c, t, g, unknown or other
  modified_base (267)..(267): a, c, t, g, unknown or other
  modified_base (344)..(344): a, c, t, g, unknown or other
  modified_base (396)..(396): a, c, t, g, unknown or other
  modified_base (427)..(427): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggattatgaccttgtctctggtacaacngcaccaggacaaacgcccccaaatcatctattatgagtcactaacgccggtacctcgtaggtttctattcgccttcnctgcctacaagtctagacaacaccgcctcctgacatctcgtggcctcgaggntaggaggacgaggtctagatttatactgctntctactatactggacctaaggtcttagggactaccgtaaccgttacccggtgggtacggtttccggggacggtaacggttacgaaaaccggtacggggttacgtaacccggttaccgtttaacggggacctaaccggtaaccccgaacggggtccctttacccccggg

SEQ ID NO: 397013 - DNA, 647 bp, Homo sapiens
  misc_feature: GZ8MTXP02G3CYV.9.53.E09.1.454.CMB.2.raw
  modified_base (285)..(285): a, c, t, g, unknown or other
  modified_base (437)..(437): a, c, t, g, unknown or other
tcagtgatacgtctcacgaccggtgctcgatttagagagagtgtgttgggtttggggatactttctgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctctcctgcactgtctctggtgctccatcagtacttactactggacctggatccggcacgcccggacgggaggacgnggtagtgggtggtcgttatttgcgtaggtcggacactaactacgacccgtcccctccacgaagtcgtacgacgtccccaactctagactaaggtacgacctaccgtaccaaacgaaccagtactacctcccgagaacgtctacgtacccgtntacggtacccgacccgccggacggaccgacggtccgtagtaacgttcgtgcgacgtacgtacgttaaccaaaagttcgtaacgaaccaacgacgtccgttaagttaccttacgttttaccgtttagtacgttagttcggggaagggtaccgaaagggtaactaaggttacggtccttaacggtccttacgttaccgaccggttacccccg

SEQ ID NO: 397014 - DNA, 528 bp, Homo sapiens
  misc_feature: GZ8MTXP02HR5OV.9.53.E09.1.454.CMB.2.raw
  modified_base (228)..(228): a, c, t, g, unknown or other
  modified_base (303)..(303): a, c, t, g, unknown or other
  modified_base (420)..(420): a, c, t, g, unknown or other
  modified_base (437)..(437): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggtgggattatgacttgtctcctggtaccaacagccaccaggacaaacgcccccaaatcatcattangagtcactaagcgcctgtagggtttcatcgccttctctggctcaagtctgacaacaccgcctccagacaactctcgtggctccgaggctagagacgagctagattatactgctgctnatagtgcagagtggtanaccgaccgttcccggtaggttacgttcgggacgggtacggaaccgagggtccgaaccgtcgtagcgacggacccaggcctaccgtcccccg

SEQ ID NO: 397015 - DNA, 535 bp, Homo sapiens
  misc_feature: GZ8MTXP02JRPXV.9.53.E09.1.454.CMB.2.raw
  modified_base (304)..(304): a, c, t, g, unknown or other
  modified_base (361)..(361): a, c, t, g, unknown or other
  modified_base (369)..(369): a, c, t, g, unknown or other
  modified_base (377)..(377): a, c, t, g, unknown or other
  modified_base (395)..(395): a, c, t, g, unknown or other
  modified_base (397)..(397): a, c, t, g, unknown or other
  modified_base (411)..(411): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggacaaacgcccccaaatcatcattangagtcactaagcggtccctgagggtttcattcgccttctctgctcaagtctgacacncgcctccnacatctcnggctccagctagcgacgngntgattattactcgntcgtctcgaatagtgacaggtatggtagacctaacgtcccgtagggtactcggggcggtaacgggaccgtaagggtcgaccggtcgtacggtcgacggcccgtaacggccgtccggtacccccg

SEQ ID NO: 397016 - DNA, 609 bp, Homo sapiens
  misc_feature: GZ8MTXP02H37HO.9.53.E09.1.454.CMB.2.raw
  modified_base (270)..(270): a, c, t, g, unknown or other
  modified_base (305)..(305): a, c, t, g, unknown or other
  modified_base (354)..(354): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgagttggttgggattatgtaccttgtctctggtaccaanacgcaccaggacaacgcccccaaatcatctattangagtcactagcgtcctagtagggtttcatcgccttctctggctcagtcnaccaacaccggtccctcctagactatcctcgcggcctaccgaggcgtaggacggtacgagggtcctagtaatttacttacgtcgacttcgcttacgatagtcgacagtacgtcggtacgtaccgtaccgttccggtacgggtttacggtaccgggaacgggggtacggaacccggtaaggggtcccgtacccggttaaccggtaacggtccgaaccggacccgtaaacgggtcccgtttaccccggtccccccgg

SEQ ID NO: 397017 - DNA, 548 bp, Homo sapiens
  misc_feature: GZ8MTXP02JM131.9.53.E09.1.454.CMB.2.raw
  modified_base (371)..(371): a, c, t, g, unknown or other
  modified_base (416)..(416): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagcaccaggcaaagcccccaaactcatcatttatgagtcactaagcgcctcgaggggtttctattcgcttctctgctcagtctgacacacgcctccngacatctctggctcgagctgagagagctgattatactgctgcctnatatgcagtagtggtagacctaccgtcccggtgggttaaacgttccggggacggaacggggtaacccgtaaggggtccgtaaacccggttccgtaacgggtaccgaaccggaccccgaaaagggtcccccgg

SEQ ID NO: 397018 - DNA, 689 bp, Homo sapiens
  misc_feature: GZ8MTXP02GOHD8.9.53.E09.1.454.CMB.2.raw
  modified_base (227)..(227): a, c, t, g, unknown or other
  modified_base (312)..(312): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtcgtggtctcctggacagtcgatcaccatctcctgcactggaaccngcagtgagtggttgggattatgtacttgtctcctggtaaccaacagccacccaggaccaaaccgaccccaaatcatctaatttanagacggtcaacgtaacgccggccttcgtaggggtttctagttcgtcctttcgtcgtggcctaccgtaaagttctacgaaccaaaccgtaccggtccctacccgtagaacctaaacgtcctccgttcgggacccttaccgaggtacgtacggacgggacggacggtcttagtaactttaacgttaccgtggtacttcgtaccttactaagttaagtcgtacgtagtaggttcggtacgtaccgtaaccgttcccggttagggttacggttaccggggacggggtaacgggtaacccgtaaggggttaccggtaacccgttaaccggttaacggtaccgaaccggacccgtaaacggtcccgttcccggtaccccccgg

SEQ ID NO: 397019 - DNA, 546 bp, Homo sapiens
  misc_feature: GZ8MTXP02INLR2.9.53.E09.1.454.CMB.2.raw
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggtagttatgtaccttgtctcctggtaccaacagccacccaggaccaaacgcccccaaactcatcatttatgagtacaactaagccggccctgtagggtttctacttcgcttctctggctcagtctacgacaacgaccgcctcctgaactaatcctcgtcgggctaccgaggtctaggacggacgagctagtaatttattacgtgctgctacatagtgacagtagtgtacactacgtcccggtggtacgttcgggacggacggtacaaggtcgaccgtcgtacggcacgaccgaacgtccg

SEQ ID NO: 397020 - DNA, 671 bp, Homo sapiens
  misc_feature: GZ8MTXP02H20T7.9.53.E09.1.454.CMB.2.raw
  modified_base (292)..(292): a, c, t, g, unknown or other
  modified_base (303)..(303): a, c, t, g, unknown or other
tcagtgatacgtctcacgaccggtgctcgatttagagagagtgtggtttggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctctgcactggaaccagcagtgattggttagggattatgtaccttgtctcctaggtaccaacagccaccaggacaaaccgccccaaancatctatttangagtcacgtaagcgcctacgtagggtttctatcgtcttcctcgtcggtcctacgtaagtccgtacgaccgaaaccgaccggtcccctccgtacgactaaacttccgtcgtacgggccttacccgagggtcctaggggaacgggacgtagggtctaagtactttaacttcgtggtaccttggtaccttacctaaagttacgtacgacgtaaggtaggttacggtaaccgtaccgtacccggttaccgggttacggttaccgggtacgggggaacgggtaaccggggtaaaccgtaccggggtaccgtacccggtaccggtaacggtaccgaaccggacccggtacgtccccgtacccgtacccccgtcg

SEQ ID NO: 397021 - DNA, 551 bp, Homo sapiens
  misc_feature: GZ8MTXP02I5JBO.9.53.E09.1.454.CMB.2.raw
  modified_base (227)..(227): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcacccaggcaaacgcccccaaatcatcatttatgaggtcactaagcggccctcgaggggtttctagttcgccttctctggctccaagtctgacaacacggcctcctgacatctctggctcaggctgaggacgaggctagatttagtactgctgctcatatgacagtatggtagactaccgttcccggtagggttacgttccggggacgggacggggaccgtaaacggggtcgacccggtccgtacggttaccacggacccaaggcctaccggtcccccgg

SEQ ID NO: 397022 - DNA, 466 bp, Homo sapiens
  misc_feature: GZ8MTXP02GFKEX.9.53.E09.1.454.CMB.2.raw
  modified_base (341)..(341): a, c, t, g, unknown or other
  modified_base (457)..(466): a, c, t, g, unknown or other
tcagtgatacgtctcacgaccggtgctcgatttagagagagtgtgttggggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacatttccttttgattatggtggggccaagggacaatggtcaccgtctcttcacgcctccaccgaacgggccccagtccggtccttcccccgtggccgcccctgcctccgaggacnccaccctccgagacgcacgagccggcccgtgggccctcgccgtggtaccaacggtaccttacttccgagtacgtatccacgtgacggcggggctgggaccaagggcgtacagtagnnnnnnnnnn

SEQ ID NO: 397023 - DNA, 641 bp, Homo sapiens
  misc_feature: GZ8MTXP02GGTQ2.9.53.E09.1.454.CMB.2.raw
  modified_base (299)..(299): a, c, t, g, unknown or other
  modified_base (313)..(313): a, c, t, g, unknown or other
  modified_base (373)..(373): a, c, t, g, unknown or other
tcagtgatacgtctcacgaccggtgctcgatttagagagagtgtgttggggtttgggggggtctcaggaggcagcgctctcgggacgtctccaccatggcctgggctctgctattcctcaccctcatcactcagggcacagggtcctggacccagtctgccctgactcaacctgcctccgtgtctgggtctcctggacagtcgatcaccatctcctgcactggaaccagcagtgactattggtaattaatatgtctctgtacaacactacccggacaaacgaccccaatctgtctttangatgtctagttacnccggtccctgaggttagttctagtactcgtcttctccgtcggcctacgtagtctcggacncccgtaccgccctccgagaccctcgtcctcgtcgggtcctccgacggtcgtaggacgggacgagtacttagttatttacgtttcacggacaacgtaactaaaacgaaaaacgtacgtaccgttccccgtagtttcggggttacggggtttccggggacgggggtaactacgggtccgtaccgtacgaacgtcgaccggtaccgacggtccctcccgaccccggtgttaccaccgttccgttacccgtacccctacccgtactaaccgg

SEQ ID NO: 397024 - DNA, 585 bp, Homo sapiens
  misc_feature: GZ8MTXP02JQ6JU.9.53.E09.1.454.CMB.2.raw
  modified_base (263)..(263): a, c, t, g, unknown or other
  modified_base (298)..(298): a, c, t, g, unknown or other
  modified_base (399)..(399): a, c, t, g, unknown or other
  modified_base (453)..(453): a, c, t, g, unknown or other
tcagtgatacgtctcacgaccggtgctcgatttagagagagtgtggttggggggtcacaagaggcagcgctctcgggacttctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggattatcgacttgtctcgtgtaccaangcaccaggacaaacgcccctaaatcatctatttangacggtcataacgcgcctgtagggtttctattcgcttcctcgtgctccaagtctagaccacaccggtccctcctagaactactccgtcgtcggctaccggngcgtaggacggacgtagtacgttatattacgtcgtagtctactctactaggtanagtacgtagtagtacgtacgtaccgtacgtacggttacggttacggtacgggacgggaacgggtaaccggtacggtaccggtaccggtacgtaacgtacgaccgaccgaccggtaccgtcccgtcccgtccg

SEQ ID NO: 397025 - DNA, 584 bp, Homo sapiens
  misc_feature: GZ8MTXP02JTC52.9.53.E09.1.454.CMB.2.raw
  modified_base (450)..(450): a, c, t, g, unknown or other
tcagtgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggagttatgaccttgtctcctggtaccaacagcacccaggcaaacgcccccaaactcactcatttatgaggtacacgtaagccggccctcgtaggggtttctattcgcttcctctggctacagtctgcaacaccggcctccagacaatctcgtgggcctcccgaggtcctaggacgggaccgaagggctagtatttacgttatggctgctacattagngacgtagtagtggtacgaccgtaccgtcccggttaggttacggtcggggacgggaacgggtaaccgaacgggtccgtacccgttacggtaacggtccgaaccggaccggacggtcccgtcccggtcccccgtcg

SEQ ID NO: 397026 - DNA, 596 bp, Homo sapiens
  misc_feature: GZ8MTXP02HBUH5.9.53.E09.1.454.CMB.2.raw
  modified_base (307)..(307): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctcgtgtctggtctcctggacagtcgatcaccatctcctgcactggaaccagcagtgattggtggattatgtaccttgtctcctggtaccaacacgaccaccgagaccaaacgacccccaaatcatctaattangagtacacgtaacgccggccctgtagggtttctattcgtccttctcgtcgctacaagttctgaccaacgaccgtccctcccgtagacctaactctcgtcggcctccggaggcgtaggacggacgaggtctacgtaatttacttacgtgtcttgactcgtaatacgtgactagtagttggtacgtacgtaccgtaccggttggttaacggtcgggacgggtaacgggaccgtaacggtcgtaccgtaacgttacggaccgacgacccgacggtcccgtaccggtcccccg

SEQ ID NO: 397027 - DNA, 570 bp, Homo sapiens
  misc_feature: GZ8MTXP02I74BD.9.53.E09.1.454.CMB.2.raw
  modified_base (272)..(272): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtcctgggtctcctggacagtcgatcaccatcctcctgcactggaaccagcagtgatggttgggattatgaccttgtctcctggtaccaacngcaccaggcaacgcccccaaatcatcatttatgaggtcactaacgccggccctcgtaggggtttctagttcgccttctcgtggcctcaacgtctgaccaacaccggcctccctagactaatcctcgtacggcctcgaggtcgtaggacggacgagctagtatttatactgcctgcttacatacgtgcagtagtggtacgactaccgttcccggtggttactcggggacgggaacgggaccgaaacgggtcgaaccgtccgttacggacgacgacccgaacggtccgtacgtcccccgg

SEQ ID NO: 397028 - DNA, 623 bp, Homo sapiens
  misc_feature: GZ8MTXP02I95NN.9.53.E09.1.454.CMB.2.raw
  modified_base (228)..(228): a, c, t, g, unknown or other
  modified_base (276)..(276): a, c, t, g, unknown or other
  modified_base (315)..(315): a, c, t, g, unknown or other
  modified_base (435)..(435): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtcgtggtctccgtggacagtcgatcaccatctcctgcactggaaccngcagtgattggttagggattatcgtaccttgtctccgtggtaaccaanacgccaccaaggaccaaacgacccccaactcatcattangacgtacactaacgccgtccgtcgtaggggtttctaagttcgtccttactcgtcgactactaagtctcgaacctaaccgaccggccccttaccgtagaactaactctcgtcgggtacccncgagcgtagacggacgtacgtactagtattagtacgtcgtctcgactgtaatacgtcgagtaggtacgtcggtacgtaccgtcggttccggtaggttaccggtacggggacgggtaacggtaaccggtacggtaccgtaccggtaacgtaccggaccgaccggaccgtacggtcccgtcccgtacccg

SEQ ID NO: 397029 - DNA, 589 bp, Homo sapiens
  misc_feature: GZ8MTXP02HKV0Q.9.53.E09.1.454.CMB.2.raw
  modified_base (225)..(225): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttgggattatgaccttgtctcctggtaccaacagcacccaggcaaacgacccccaaactcatcatttatgaggtcactaagcggccctcgaggggtttctagttcgccgtttctcttggtctaccaagttctcgaacaacaccggccctccctgacaatctctggctccgaggcctgaggacgaggctgattattactgcttgacttcaatgtgctagagtggttacgacgtaccttcccggtagggttaacgttccgggacggggtaacggggaccgtaaacgggtacggacccggttaacccgtagggttacccacggaccccgaaggggtccctttacccggccccccgg

SEQ ID NO: 397030 - DNA, 589 bp, Homo sapiens
  misc_feature: GZ8MTXP02H5JEI.9.53.E09.1.454.CMB.2.raw
  modified_base (404)..(404): a, c, t, g, unknown or other
  modified_base (417)..(417): a, c, t, g, unknown or other
  modified_base (451)..(451): a, c, t, g, unknown or other
  modified_base (477)..(477): a, c, t, g, unknown or other
  modified_base (482)..(482): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtcgtggtctcctggacagtcgatcaccatctcctgcacgtaggaaccagcagtgagttggttggattatcgtaccttgtctccgtaggtaaccaacacgaccaccgacggaccaaacgcccccaaatcatactattatagagtacaacgtacgccgtcctgtagggtttctagtcgtccttctcgtgctactaagtctcgaaccaacgaccgccctaccgtnaaacctacttccncgtcggtcctcgaggcgtaggacggtacgacgtntagtattagttactgtctagtcctanagttnacgataagtgtcggataccgtaccggtcggtaggtacggtcggacgggacggtacgaacggtcgaacccgtcgtacgacgaccgcgaccggtccgtacccgtccccg

SEQ ID NO: 397031 - DNA, 582 bp, Homo sapiens
  misc_feature: GZ8MTXP02GWFM2.9.53.E09.1.454.CMB.2.raw
  modified_base (227)..(227): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccacagcaccaggcaaacgcccccaaactcatcatttatgaggtcactaacgcggccctcgtaggggtttctagttcgccttctctcggctcaagtctgaaccaacaccggccctccctgacaatctcgtcggctccgaggcgtaggaggacgaggtctagtaatttagttactggtcttgcctactatagttgactagaagtggtacgacgtaccgttcccggtaggttacggttcggggacggggtaacggaccgtaacggtcggtaccgttccgtaacggccgacgtcccgaacggtcccgtaccgtccccccgg

SEQ ID NO: 397032 - DNA, 542 bp, Homo sapiens
  misc_feature: GZ8MTXP02HBCGI.9.53.E09.1.454.CMB.2.raw
  modified_base (229)..(229): a, c, t, g, unknown or other
  modified_base (253)..(253): a, c, t, g, unknown or other
  modified_base (301)..(301): a, c, t, g, unknown or other
  modified_base (444)..(444): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactgaaccngcagtgatgttggattatgacttntctctggtaccaacagccaccagcaacgaccccaaactcatcatttangagtcactaagcgcctcgtagggtttctacttcgtcttctcgtcggctaccagtctacgaacaaccgtaccggcctccctagaaacctaactctcgtcgggtcctccgaggctaggaggacgagctagatttatactgctgcngtatatgacaagtgtgacgtactaccgtccggtaggtacgttcgggacggacggacgtaggtccggcgtaccggttacggacgacgaccgtacgcccg

SEQ ID NO: 397033 - DNA, 543 bp, Homo sapiens
  misc_feature: GZ8MTXP02GN348.9.53.E09.1.454.CMB.2.raw
  modified_base (269)..(269): a, c, t, g, unknown or other
  modified_base (343)..(343): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaaccagcagtgatggttggggattatgaccttgtctcctggtaccaanagcacccaggcaaacgcccccaaatcatcatttatgagtcactaagcgccctcaggggtttctattcgccttcnctggctcaagtctgacaacacggcctccctgacaatctctgggctccaggctgacggacgaggctgattattactgctgcttacgatatgacagatggtcgacaccgttcccggtggttacgttcgggacggacgggaccgaaacgggtcgaaaccggtccgtaacgggtcaacggcccaaacggtccgtcgtccccccg

SEQ ID NO: 397034 - DNA, 495 bp, Homo sapiens
  misc_feature: GZ8MTXP02I3S4L.9.53.E09.1.454.CMB.2.raw
  modified_base (337)..(337): a, c, t, g, unknown or other
  modified_base (372)..(372): a, c, t, g, unknown or other
  modified_base (388)..(388): a, c, t, g, unknown or other
  modified_base (455)..(455): a, c, t, g, unknown or other
  modified_base (465)..(465): a, c, t, g, unknown or other
  modified_base (478)..(478): a, c, t, g, unknown or other
  modified_base (480)..(495): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaaagaaccagatctccctgaagctgacctctgtgacccgcgcggacacggcccgtgtattactgtgcgagagttcccaaatatagcaacagctggtacattcctttgatatgtggggccaaggcaatggtcaccgtntccttcagcctccacccaggccatcgtctcccccngcgccctgctccagancacctcgagagcacagcgccctcgggctcgccgtgtcgaaaggtactacttccgagacgtatcacgngaggcggcgnggacgagcgacanannnnnnnnnnnnnnnn

SEQ ID NO: 397035 - DNA, 551 bp, Homo sapiens
  misc_feature: GZ8MTXP02F3HMQ.9.53.E09.1.454.CMB.2.raw
  modified_base (304)..(304): a, c, t, g, unknown or other
tcagtgatacgtctcacgaccggtgctcgatttagagagagtgtggtttgggggggtcacaagaggcagcgctctcgggacgtctccaccatggcctgggctctgctgctcctcaccctcctcactcaggacacagggtcctgggcccagtctgccctgacctcagcctgcctccgtgtctgggtctcctggacagtcgatcaccatcctcctgcactggaaccagcagtgatggttgggattatgaccttgtcctctggtaccaacagcacccagacaaaccgcccccaaactcatcatttangaggtcaactaagccggccctagtaggggtttctatcgcttcctctgctacaagtctgaccaacaccggcctccctagacaatctcgtagggcctaccaggctgaggacgaggctagattatactgctagctacatatgacagtagtggtagacctacgtcccggtaggttacgttcgggacgggtaggaccgaaggtacgacccgtcgtaacggtcacggacccgaaggtctccgcccccgtacgg

SEQ ID NO: 397036 - DNA, 591 bp, Homo sapiens
  misc_feature: GZ8MTXP02JW7FG.9.53.E09.1.454.CMB.2.raw
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacacgccacccaggaccaaacgacccccaaactcatctatttatgaggtcactaagccggcctgtaggggtttctattcgccttctctcggctcagtctgacaacgaccgcctcctgacaatctcgtcggctccgaggcgtgaggcgaggctagtattactacgtgctgctacatagtgcagtacgtggtacgtactacccgttcccggttagggttacggttaccggggacggggacgggtaaacccgtaaggggtccggtaaccggtaaccgtaacggttacccgacggaccccggtaacggtcccgtacccgtccccccgg

SEQ ID NO: 397037 - DNA, 581 bp, Homo sapiens
  misc_feature: GZ8MTXP02IXQ02.9.53.E09.1.454.CMB.2.raw
  modified_base (229)..(229): a, c, t, g, unknown or other
  modified_base (300)..(300): a, c, t, g, unknown or other
  modified_base (375)..(375): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccngcagtgatgtgggattatgacttgtctctggtaccacagcaccaggcaaacgcccccaactcatcatttangaggtcactaaagcggccctcgtaggggtttctattcgccttctctgctcaagtctgacacaccggcctcccganactctcgtgggcctcgaggtctgaggacgaggctgattattatgctgtctacatagtcgatagagtaggttcgaaaccgtcgttccccggttagggtaacgtttccggggacggggtaacgggaccgtaacgggtacgtaacccggttacgtaaggtacccgaacggtaccccggaaacggtcccgtaccgtacccccgtttccgg

SEQ ID NO: 397038 - DNA, 585 bp, Homo sapiens
  misc_feature: GZ8MTXP02HPDS9.9.53.E09.1.454.CMB.2.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactaggaacagcagtgagttggttgggagttatgtaccttgttctcctggtaaccaacacgccaccaggaccaaaccgacccccaaactcatctattatagaggtcaactaacgccggtccttcgtaggggtttctagttctccttctctgctcaagtctgacaacaccgccctcctagactactctcgtcgggctacgaggcgtaggagggacgtaggctagtatttattactgtcttcgtctacattatacgacgtaaggtgtaggtacgactaccggttccggtagggttacggtcgggacgggacggaaccgtaggtcgaccgtaacgtacggcgaccgaccgtacggccgtcgtcccccgg

SEQ ID NO: 397039 - DNA, 571 bp, Homo sapiens
  misc_feature: GZ8MTXP02G64G3.9.53.E09.1.454.CMB.2.raw
  modified_base (227)..(227): a, c, t, g, unknown or other
  modified_base (270)..(270): a, c, t, g, unknown or other
  modified_base (303)..(303): a, c, t, g, unknown or other
  modified_base (414)..(414): a, c, t, g, unknown or other
tcagtgatacgtctcacgaccggtgctcgatttagagagagtgtgttggggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacngcaccaggacaaacgcccccaaatcatcattangagtcactaagcgcctcgtaggggtttctagttcgccttctctggctcaagtctgaacaacaccggtccctcctgactaactctcgtcggctcgaggcgtaggacggacgngctagtatttaattctggtctgtctctatacgtgactagagttcgggtactaccgtaccgttacccggttggttaacggttccggggacgggaacggggtaccgtaacgggtcgtaccgtccgttacggccgacgccgaacggtccgccgtcccccg

SEQ ID NO: 397040 - DNA, 607 bp, Homo sapiens
  misc_feature: GZ8MTXP02IWM3P.9.53.E09.1.454.CMB.2.raw
  modified_base (208)..(208): a, c, t, g, unknown or other
  modified_base (226)..(226): a, c, t, g, unknown or other
  modified_base (244)..(244): a, c, t, g, unknown or other
  modified_base (407)..(407): a, c, t, g, unknown or other
  modified_base (471)..(471): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccntctcctgcactggaaccngcagtgatggttggattntgtaccttgtctcctgtaccaacagcaccagacaaacgacccccaaatcatctatttatagaggtacaactaacgccggccctcgtacggggtttctattcgtccttctctcggctccaagtctcgacaacaccggcctccctagacatctcgtggcctacgnggcgtagacggacgaggtctagtacgtttaacttacgtcgcttcgtactaccaataagttcganaggtaagttcggtagacctacgttcccggttaggttacgttaccggggacgggaacgggtaccgtaaacgggttccggtaccggttaaccgttacgggaccaccggacccgaacggtcccgtacccgtccccccgg

SEQ ID NO: 397041 - DNA, 600 bp, Homo sapiens
  misc_feature: GZ8MTXP02JTDZF.9.53.E09.1.454.CMB.2.raw
  modified_base (301)..(301): a, c, t, g, unknown or other
tcagtgatacgtctcacgaccggtgctcgatttagagagagtgtgttgggtttgggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacttgtctctggtaccaacagcaccaggacaaacgccccaaactcatcatttangagtcactaagccggtcctcgtaggggtttctattcgtccttctctcggctcaagtctcgacaacacgcctcctagactaatctcgtcggcctccgaggcgtaggacggacggaggtactgtaatttacgttacgtggtctgtactactagtatgacaggtagttgggtcgacgtacccgttccggttacgggttacggttccggggacgggtaacgggtaacccgtaacgggttccgtacccggttaaccgtacgggtaccacgggtaccccgacggtacccgtaccggtccccccgg

SEQ ID NO: 397042 - DNA, 677 bp, Homo sapiens
  misc_feature: GZ8MTXP02HNU5X.9.53.E09.1.454.CMB.2.raw
  modified_base (312)..(312): a, c, t, g, unknown or other
tcagtgatacgtctcacgaccggtgctcgatttagagagagtgtgttggggtttggggggggtcacagaggcagcgctctcgggacgtctccaccatggcctgggctctgctgctcctcacccctcctcactcaggacacagggtcctgggcccagtctgccctgactcagcctgcctcgtgtctggtctcctggacagtcgatcaccatctcctgcatcggaaccagcagtgagttggttgggattatgacttgtctctcggtaccaacacgccaccgaggaccaaaccgaccccaactcactctatttangagtacaactaacgccggtcctagtagggtttctacgttcgtccttctacgtggcctacgaacgtctacgaacctaacgccggtccctacctacgaactactcgtcgtcggtctaccgacggcgtacgggaacggtaccgtaggtccttaggtaactttacgttaacgtcgttcgttgtacccttactacgttaacgttggaccgtaaaggtagggttcggaaccgtaccgttaaacccgttcccgggttagggtttaccgggtaccgggccggggtaaacgggtaaccggtaaacggggttccgtacccggttcggtaacgtaccgaccggtaacccggacggtccgttaccccggtcccccgg

SEQ ID NO: 397043 - DNA, 586 bp, Homo sapiens
  misc_feature: GZ8MTXP02FUHRW.9.53.E09.1.454.CMB.2.raw
  modified_base (440)..(440): a, c, t, g, unknown or other
  modified_base (456)..(456): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgattggttgggagttatgtaccttgtcctcctggtaccaacagccaccaggacaaacgccccaaactcatcatttatgaggtcactaagccgtccctgtaggggtttctacttcgcttctctggcctcagtctgaacacgcggccctcctgacaatcctcgtcgggcctccgaggctggacggtacgaggctagtattattacngtctgctacagttacngtacagtagtgggtactacctaccgttcccggtggttaacggttcggggacggggaacgggtaacccggtaaagggtaaccggtacccgttaccggttacggtaccgaccggacccgaacggttccccgg

SEQ ID NO: 397044 - DNA, 703 bp, Homo sapiens
  misc_feature: GZ8MTXP02ILPF7.9.53.E09.1.454.CMB.2.raw
  modified_base (238)..(238): a, c, t, g, unknown or other
  modified_base (330)..(330): a, c, t, g, unknown or other
tcagtgatacgtctcacgaccggtgctcgatttagagagagtgtgttggggtttggggggggtcacaagaggcagcgctctcgggacgtctccaccatggcctgggctctgctgcctcctccacccctcctcactcaggacacgagggtcctgggcccagtctgccctgactcagcctgcctccgtgtcgtggtctccgtggacagtcgatcaccatcctcctgcacgtacggaaccngcagtgtagttggttgggtattgtgtaccttgtcctcgtcggtaaccaacagccaccgacggaccaaccgacccccaaatcatactattagngagtacacgtaacgccggtcctacgttagggttcctagttccgtcttcctcgtcggcctaccgagttcctagaccaacgacccggtcccctcccgtagaacctacgtccgtcgtcgggtcctaccgaggtcccgtagggaccgggtacggaggtacttaagtatttaacgttacgtcgtcgttcgtaccttactaagttacgtcggaacgtaggttaaggttcggtaaccgaccgttacccggttcccgggttagggtttaccgggtccgggggtaaacgggggaacccgggtacggtaaaacgggttccgaacccgggttccgtaacgggtaccgaccggtaccggtacggtccccgtcccgttacccccgg

SEQ ID NO: 397045 - DNA, 507 bp, Homo sapiens
  misc_feature: GZ8MTXP02FG33L.9.53.E09.1.454.CMB.2.raw
  modified_base (226)..(226): a, c, t, g, unknown or other
  modified_base (363)..(363): a, c, t, g, unknown or other
  modified_base (416)..(416): a, c, t, g, unknown or other
  modified_base (426)..(426): a, c, t, g, unknown or other
  modified_base (436)..(436): a, c, t, g, unknown or other
  modified_base (498)..(498): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccngcagtgatggttgggattatgaccttgtctcctggtaccaacagcacccaggcaaagcccccaaactcatcatttatgaggtcactaagcggccctcaggggttctattcgccttctctggctcaagtctgacaacncggcctccctgacaatctctgggctcaggctgaggacgaggctgattattacngctgctcatntgcagatggnacactcccgtggtattcggacggacggaccaaggtgaccgtcgtaggtcacgcccaaggccncgtcccccg

SEQ ID NO: 397046 - DNA, 511 bp, Homo sapiens
  misc_feature: GZ8MTXP02GDN5V.9.53.E09.1.454.CMB.2.raw
  modified_base (439)..(439): a, c, t, g, unknown or other
tcagtgatacgtctcacgaccggtgctcgatttagagagagtgtgttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaatcatcatttatgaggtcactaagcggccctgtaggggtttctattcgcttcctctggctccaagtctgacacacggcctcctgacaatctctgggctccaggctgaggacgaggctgattattactgctgctctatatgctagagtggtgaacncgttcccgtggtacgtcggcggtaggacaacggtcgaccgtctaacggtcacgaccaaggctcgccccgtcg

SEQ ID NO: 397047 - DNA, 532 bp, Homo sapiens
  misc_feature: GZ8MTXP02HVW9R.9.53.E09.1.454.CMB.2.raw
  modified_base (209)..(209): a, c, t, g, unknown or other
  modified_base (227)..(227): a, c, t, g, unknown or other
  modified_base (267)..(267): a, c, t, g, unknown or other
  modified_base (299)..(299): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccntctcctgcactggaaccngcagtgatgttggattatgaccttgtctcctggtacaacngcaccaggcaaacgccccaaatcatcatttangaggtcactaagcggcctcgaggggtttctattcgcttctctgctcaagtctgacaacacggccctcccgacaatcctctgggcctccgaggcctggacggacgaggctgtattattactgtcctgctcatatgcagtatggtcgactacgtcccgtggtacgttcgggacggtacgggacgaaggtcgaaccgtcgtaaggtccacgcccgaaggcctccgtccccgtccgg

SEQ ID NO: 397048 - DNA, 567 bp, Homo sapiens
  misc_feature: GZ8MTXP02H4WLT.9.53.E09.1.454.CMB.2.raw
  modified_base (226)..(226): a, c, t, g, unknown or other
  modified_base (300)..(300): a, c, t, g, unknown or other
  modified_base (357)..(357): a, c, t, g, unknown or other
  modified_base (366)..(366): a, c, t, g, unknown or other
  modified_base (378)..(378): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttggattatgaccttgtctctggtaccaacagcaccagacaaacgacccccaatcatctattangagtcactaagcgtcctgtacgggtttctatcgtcctctctgctcagtctgacaacnccgcctccncgacactctcgnggctcgaggctagaggacgagctgtattattactgtctgctacgattacgtagacgtagtagtggtacgaccgtaccgttccggtagggtttacgttccggggacgggtaacgggaacctaacggggtccgtacccggtaaccgtacggtacgaaccggacccgtaacggcccgttcccggacccccgg

SEQ ID NO: 397049 - DNA, 555 bp, Homo sapiens
  misc_feature: GZ8MTXP02IC2Q0.9.53.E09.1.454.CMB.2.raw
  modified_base (226)..(226): a, c, t, g, unknown or other
  modified_base (292)..(292): a, c, t, g, unknown or other
  modified_base (301)..(301): a, c, t, g, unknown or other
  modified_base (437)..(437): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctctgcactggaaccngcagtgatgttggattatgaccttgtctcctggtaccaacagcacccaggccaaacgcccccaaancatcattangagtcactagcgcctgagggtttctatcgtcttctctgctcatctgacacgaccgtcctcctgaacactctcgtcgggcctccgaggcgtagacgggacgacggcttgatttaacgttctgtctgtactcattagngcagtgtaggtacacgtaccgttcggtaggttacggtacggacgggaacgggaccgtacggtaccgtaccggtaacgtacggtacgaccgtacccgtacggtccgtacccggtccccg

SEQ ID NO: 397050 - DNA, 571 bp, Homo sapiens
  misc_feature: GZ8MTXP02IRWMI.9.53.E09.1.454.CMB.2.raw
  modified_base (223)..(223): a, c, t, g, unknown or other
  modified_base (255)..(255): a, c, t, g, unknown or other
  modified_base (263)..(263): a, c, t, g, unknown or other
  modified_base (291)..(291): a, c, t, g, unknown or other
  modified_base (316)..(316): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcatcacatctctgcactggaaccngcagtgatggttgggattatgtacttgtctcngtacacancaccagacaacgccccaatcatcattangagtcactaagcgcctgtaggtttntacttcgtcttctctcgtctacagttctcgaccaaacaccggtccctcccagtactaactcgtactcggcctcgagtcgtagacggacgaggctagtacttattactgtctgtctactatagtgactaagtgtaggtacgaactaccgttccggttaaggttcggttaccgggacgggtacgggaacgtaacgggtaccgtaccggtccgttaaggaccgaccgacccggtaacggtcccgtacccgtcccccgg

SEQ ID NO: 397051 - DNA, 651 bp, Homo sapiens
  misc_feature: GZ8MTXP02GKZ63.9.53.E09.1.454.CMB.2.raw
  modified_base (227)..(227): a, c, t, g, unknown or other
  modified_base (308)..(308): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcacccaggaccaaacgacccccaaactcatcatttangagtcactagccggccctgtaggggtttctattcgcctttctctggctaccgaagttctcgaaccaacgaccggtccctccctagaaccaacttcctcgttcgggccttaccgaggcctaggacgggtacgagggtacctagtaatttaattaccgtgccttgccttactaagtaacttggactaaggtaagttgggttacgaaccgtaacccgttcccgggttagggttaacggtttccggggacggggaacgggtaaccgtaaacgggttccggtacccggttaaccgtaacgggtaccgaaccggtaccccgaaacggtcccgtacccggtcccccccgg

SEQ ID NO: 397052 - DNA, 594 bp, Homo sapiens
  misc_feature: GZ8MTXP02J17KJ.9.53.E09.1.454.CMB.2.raw
  modified_base (133)..(133): a, c, t, g, unknown or other
  modified_base (208)..(208): a, c, t, g, unknown or other
  modified_base (220)..(220): a, c, t, g, unknown or other
  modified_base (239)..(239): a, c, t, g, unknown or other
  modified_base (257)..(257): a, c, t, g, unknown or other
  modified_base (290)..(290): a, c, t, g, unknown or other
  modified_base (402)..(402): a, c, t, g, unknown or other
  modified_base (463)..(463): a, c, t, g, unknown or other
tcagtgatacgtctcacgaccggtgctcgatttagagagagtgtggttggggggtcacaagaggcagcgctctcgggacgtctccaccatggcctgggctctgctgctcctcaccctcctcactcaggacacngggtcctgggcccagtctgccctgactcagcctgcctccgtgtctgggtctcctggacagtcatcaccatctccngcactggaaccngcagtgatggttggattangtacttgtctctgtacanagcaccagacaaccgccccaaatcatcatttangaggtcaacgtacgccggtcctcgtagggtttctagttccgtctttccctcgtgcctacgtagtctacgaccaacaccggtccctccgtgactaactctcgtcggcctccgnggtacctgggaggtaccgagtattgttaacttagttaccgtgtccgttagctatataagtnacgagtagtcggtacgaccgtccgttccggttaggtacggtccgggacgggtaacgacggtaaggtcccgtaccggttacgcggttaccgaacggtacccgtaacggcccgttccggcccccgtttaccgg

SEQ ID NO: 397053 - DNA, 655 bp, Homo sapiens
  misc_feature: GZ8MTXP02IMF3B.9.53.E09.1.454.CMB.2.raw
  modified_base (224)..(224): a, c, t, g, unknown or other
  modified_base (272)..(272): a, c, t, g, unknown or other
  modified_base (324)..(324): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctggtctcctggacagtcgatcaccatctctgcactggaaccngcagtgatggttgggagttatgaccttgtctccgtaggtaaccaaacncggaccacccaaggaccgaaaacctccccccaaaatcagttacctaatttanagaacggtacaacttaaacggcccggtcccttaggtacggggtttttctaagttcgtccctttctcgtacggcttacccaagttctacgaaccaacgaccggcccctacccgataaatcccgtcgtcggcctaccgacggaccgtgacggaacgaggtctagtattaactcgtgtactcgtctatattagtgagagtagtgtactacgtaccgtccggttaggtacggttacgggacggtaaacggaaccggtacggtacccggtaccgttaaccggtaacggaccgaaccggacccggtacggtcccggttaccccggtaccccgttccg

SEQ ID NO: 397054 - DNA, 560 bp, Homo sapiens
  misc_feature: GZ8MTXP02JDCHT.9.53.E09.1.454.CMB.2.raw
  modified_base (314)..(314): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgaccttgtctcctggtaccaacagccacccaggaccaaacgcccccaaactcactcatttangagtcactaagcgtcctcgtaggggtttctacgtcgtcttctctggcctcagtctagacacgaccgctcctgactatctcgtcggctcgacggctaggacggacggagtctagtatttacgttactgttcactctatagtcgacagtagtggtacgactaccgtcccggttaggtacgttcgggacgggtacggaaccgaaggtcgtaacccgtcgtacggtacgacgacccgaacggtctcccgg

SEQ ID NO: 397055 - DNA, 673 bp, Homo sapiens
  misc_feature: GZ8MTXP02F3U17.9.53.E09.1.454.CMB.2.raw
  modified_base (265)..(265): a, c, t, g, unknown or other
  modified_base (299)..(299): a, c, t, g, unknown or other
tcagtgatacgtctcacgaccggtgctcgatttagagagagtgtggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactaggaaccagcagtgattggtgggattatgacttgtctctggtaccaacngcaccaggacaaacgccccaaatcatctatttangacgtacacgtaagccgtcctgtagggtttctattcgtcttctcgtgtctacaagtcctagaccaccgaccggtccctacccgtagaaactaacttccgtccgttacgggacccttacccgaagggtccgttaagggaacgggaccggaagggtaccttaggtaaactttacttaacgtcggtacttacgtcctacttaacgtaaagtcggactaaaggttgtacgggtactaaaccgttacccgttccgggttaggttaaccggttccgggggaacgggaacggggtaaaccgtaacgggtaccggaccgtttaccgaacggtccgaaaccggacccggaaacgggtcctaccccgggtccccgtttaaccgg

SEQ ID NO: 397056 - DNA, 603 bp, Homo sapiens
  misc_feature: GZ8MTXP02JHVY3.9.53.E09.1.454.CMB.2.raw
  modified_base (227)..(227): a, c, t, g, unknown or other
  modified_base (302)..(302): a, c, t, g, unknown or other
  modified_base (410)..(410): a, c, t, g, unknown or other
  modified_base (440)..(440): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccatcctcctgcactggaaccngcagtgatggttgggattatgacttgtctctgtaccaacacgcaccgagacaaacgacccccaatcatctattangagtcactaagccgtcctcgtagggtttctattcgtccttctctcgcctcagtctcgaacaacgccggccctcctagacatctcgtcggctcgagcgtagacggacgngtctagtatttacgtactgtctgctacatntcgactaagtagtcggtacgtacctacccgttaccgggttggttaaccggttccggggaacggggtaaccgggtaaccgtaacggggttaccggtaaacccggttaacggtaacgggtaccgaaccggacccgtaacgggtccccgtacccggtcccccccgg

SEQ ID NO: 397057 - DNA, 660 bp, Homo sapiens
  misc_feature: GZ8MTXP02HEHCA.9.53.E09.1.454.CMB.2.raw
  modified_base (226)..(226): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccngcagtgagttggttaggattatcgtaccttgtcctccgtacggtaaccaacgacgacccaaccgacggaccaaaccgacccccaaactctactctattagtagtacgtacaacgtaacggtccggtaccgttacggttacggtttctacgttccgtccctttcgtcgtcgtaccttaccgtaacgttcgtacgaaccaaccgtacccgtaccctacccgtacgaacctacgttcgtcgtcggcctcgaggtcgtaggacggacgacgtctagtaacttacgttacgtcgtcgttacgtacctataagttacgtcgacgtaggtacgtcggtacgtaccgtaccgttacggttaggttacggtcggggacggtaacggtacgtacggtccgtaccgtcgtacggtacgacgacccgacggtcccgtcccgtcccg

SEQ ID NO: 397058 - DNA, 573 bp, Homo sapiens
  misc_feature: GZ8MTXP02IHJ86.9.53.E09.1.454.CMB.2.raw
  modified_base (214)..(214): a, c, t, g, unknown or other
  modified_base (229)..(229): a, c, t, g, unknown or other
  modified_base (303)..(303): a, c, t, g, unknown or other
  modified_base (470)..(470): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcacccctcctcactcaggacacagggtcctgggcccagtctgccctgactcagcctgcctccgtgtctgggtctcctggacagtcgatcaccatcncctgcactggaaccngcagtgatgttgggattatgacttgtctctggtaccaacagcaccaggacaaacgacccccaaatcatcattangagtcactaagcgcctcgtaggggtttctattcgtccttctctggtctcctaagttctcgtacaaacaccggtccctccctgaactaactcttcgcgggctccgaggccgtaggaggacgacggtctagtattacttactgtctgctcatagtgacagtagtggtanaccgtaccgttccgtaggttacgttacgggacggggaacggacccgtaaaggtccgtaccgtaacgtacggtacgacgaccgtaacggtctaccggtcccccg

SEQ ID NO: 397059 - DNA, 633 bp, Homo sapiens
  misc_feature: GZ8MTXP02GRBNV.9.53.E09.1.454.CMB.2.raw
  modified_base (313)..(313): a, c, t, g, unknown or other
  modified_base (472)..(472): a, c, t, g, unknown or other
tcagtgatacgtctcacgaccggtgctcgatttagagagagtgtggttgggggggtcacaagaggcagcgctctcgggacgtctccaccatggcctgggctctgctgctcctcaccctcctcactcaggacacgagggtcctgggcccagtctgccctgactcagcctgcctccgtgtcgtgggtctcctggacagtcgatcacatcctcctgcactggaaccagcagtgagttggttgggtattatcgtacttgtctacgtacggaccaacagccaccgaggacaaaccgaccccaaactcatactatttangtagtacaacgtacggccgtcctcggtagggtttctatcgtcttcctctgacctctaagtctacgacacgaccgtccctaccgtagactaatctacgtggacctcgaggtctaggaggacgagcgtagtattacgttacgtgtctacgctactattagngacgtagtataggtaccgtactacccgggttacccgttagggttaacggttcgggaaccggggtaaacgggtaacccgtaacggggttaccgaaccgtttacccgtaacggtccgaaaccggtacccgaagggtaccctccccggtacccccgttacccgg

SEQ ID NO: 397060 - DNA, 673 bp, Homo sapiens
  misc_feature: GZ8MTXP02GVMPW.9.53.E09.1.454.CMB.2.raw
  modified_base (226)..(226): a, c, t, g, unknown or other
  modified_base (303)..(303): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgccatggaaccngcagtgatggttgggattatgaccttgtctctggtaccaacagcacccaggcaaacgacccccaaatcatcatttangagtcacgtaacgccggcccgtgtaaggggtttctacttcgtcccttctctacggctaccaaacgttctcgaaacctaacgaccggtccctacccgtagacctaaactcgtccgtcgggccttaccgaggtcctaggacggaccgaggctagtatttacttacgtgtctgtacctagtattaacggtacgtacgaggtacggttcggtaacgtaccgttacccggttccggttacgggttaccggttaccggggacggggtaaaccggggtaaccggtaacggggtaccggtacccggtttaacccggtaacgggtaacccggtacccggtaccccggtaaccgggtccccgttacccccggtcccccgg

SEQ ID NO: 397061 - DNA, 544 bp, Homo sapiens
  misc_feature: GZ8MTXP02HJ8LV.9.53.E09.1.454.CMB.2.raw
  modified_base (225)..(225): a, c, t, g, unknown or other
  modified_base (304)..(304): a, c, t, g, unknown or other
  modified_base (337)..(337): a, c, t, g, unknown or other
  modified_base (346)..(346): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactggaaccngcagtgatgttggggattatgaccttgtctcctggtaccaacacgcacccaggaccaaacgcccccaaatcaatcattngagtcactagcgcctgagggttctatcgcttcntgctcagtntcgacacaccgcctccgtagactaactctcgtcgggtcctcaggtctggacggaccggagggtcttagtaatttattacgtgcttcgcttcaattgcgagagtgtgtacgtacgtacgtccggtcggtcggtacggacggacggacggtacggtacgtaccgtaacgtacgtacgacgaccgacgccgtcccgtcccg

SEQ ID NO: 397062 - DNA, 802 bp, Homo sapiens
  misc_feature: GZ8MTXP02G0W2A.9.53.E09.1.454.CMB.2.raw
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcacgtggaaccagcagtgtagtggttagggtattatcgtaccttgtcctcgtacggtaaccaacgacgacccaaccgacggaaccaaacccgaccccctaaaatcctaacttactaatttacgcggtaacggttacctaaacgtaaccggtcccggtacccgttacggttacggggttttactacgtttccgtccctttcgtcgttcggtaccttaccgtaagttctacggaaccaaccgtacccggtccctaccgttacgaaccttaacgtcccgtttcggcggtcctaccggaggttacccgagggaaccggggtaaacgtcggtacgtacgttaacgttttaaacttacggtctacgttcgtacccgtagttaaactcgtaccgtacggtacggtaaggtttcgggaccgtaaaaccccggttcccggtttaacccggggtggtttaaaccggggttcccgggggtaaagggggtaaccccgggacggggtttaaaccggtccgggtaaaccccgttaaccgtaacggggttacccgtaccggaacccgtaaccgggttcccgtaccccggtttaacccccgg

SEQ ID NO: 397063 - DNA, 636 bp, Homo sapiens
  misc_feature: GZ8MTXP02FQCZ1.9.53.E09.1.454.CMB.2.raw
  modified_base (216)..(216): a, c, t, g, unknown or other
  modified_base (228)..(228): a, c, t, g, unknown or other
  modified_base (247)..(247): a, c, t, g, unknown or other
  modified_base (272)..(272): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctccngcactggaaccngcagtgatggttgggattntgtaccttgtctctcggtaccaacngccaccaggaccaaacgacccccaaatcatactatttatgaggtcacgtaacgccgcctacgtagggttctagttcgtctctcgtcgtctaccaagtctcgaaccaacgacggtccctacccgtcgaacaactcctcgtcggcctaccgaggtccgtaggacggaaccgagggtacctagtactttaaatccgtggtctgtctactattaaccgtgacgtaggtagttacggtacgtaaaccgtccgttacccgggttaggttacggttaccgggggacggggaaacggtacccgaaaaggggttccggtaccgttaaccggtacgtacggacccgaccgtaacgggccgttcccgtcccccgg

SEQ ID NO: 397064 - DNA, 562 bp, Homo sapiens
  misc_feature: GZ8MTXP02GPBIL.9.53.E09.1.454.CMB.2.raw
  modified_base (228)..(228): a, c, t, g, unknown or other
  modified_base (304)..(304): a, c, t, g, unknown or other
  modified_base (450)..(450): a, c, t, g, unknown or other
  modified_base (458)..(458): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccngcagtgattggttggggattatgtaccttgtctcctggtaccaacagcaccaggacaacgccccaatcatcattangaggtcactacgcggcctcgtaggggtttctattcgtccttctctgctcagtctgacacaccgcctcctgacatctcgtcggctcgaggctaggacggacgaggctagtatttacgttacgtgcttgctacaatagtgactaggtntacggtanaccgtaccgttacccggtggttacgttcggggacggacgggtaccgtaagggtccgtaccggtaacgtacgtaccgacgacccgacggtccaccggttcccccg

SEQ ID NO: 397065 - DNA, 546 bp, Homo sapiens
  misc_feature: GZ8MTXP02I4ZFQ.9.53.E09.1.454.CMB.2.raw
  modified_base (230)..(230): a, c, t, g, unknown or other
  modified_base (310)..(310): a, c, t, g, unknown or other
  modified_base (431)..(431): a, c, t, g, unknown or other
  modified_base (436)..(436): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctctcactcaggacacagggtcctgggcccagtctgccctgactcagcctgcctccgtgtctgggtctcctggacagtcgatcaccatctcctgcactggaaccngcagtgattggttgggagttatgaccttgtctcctggtaccaacagccaccaggacaaacgcccccaaatcatcatttangaggtcactaagcgcctgagggtttctacttcgcttctctggctcagtctgaacacaccggcctcctagacaatctctgggactcagctgaggacaggctagattattactgactgcctanattangacagtagtacggtacgtaccgtaccgttccggttaggtacggtacgggacgggaacggtaaccgaacggtaaccgtaccgtacggtacgaccgaccgacccgacgtccg

SEQ ID NO: 397066 - DNA, 711 bp, Homo sapiens
  misc_feature: GZ8MTXP02GMBMB.9.53.E09.1.454.CMB.2.raw
  modified_base (227)..(227): a, c, t, g, unknown or other
  modified_base (311)..(311): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttgggattatgtaccttgtctccgtggtaaccaacagccacccaggacaaacgacccccaaatcatctattangagtcaactacgcggtcctacgtaggggtttctagttcgtccttctctcggtctaccgaagttctcgaaccaaaccgtaccgggtccccttacccgtacgaacctaaacttcccgttccgttcggggtaccctcccggaagggtcccgttaggggaaccggggacggtaacgggtaccgttaggtaaacgttttaaattaccgtggtaccgttacggtccttaacgtattaacgtggtacgtaagtaaggtcgggtacgtaacccgtacccggtttacccgggtaggttacggttccgggggaacggggtaaccggggaaccggtaacggggtccggtacccggttccggtaacggtaccgaccggtacccggaaccggtcccgtacccggtccccccgg

SEQ ID NO: 397067 - DNA, 572 bp, Homo sapiens
  misc_feature: GZ8MTXP02IFWAQ.9.53.E09.1.454.CMB.2.raw
  modified_base (226)..(226): a, c, t, g, unknown or other
  modified_base (269)..(269): a, c, t, g, unknown or other
  modified_base (303)..(303): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttgggatttatgacttgtctcctggtaccaanagcaccaggcaaacgcccccaaatcatcatttangaggtcactaagcgccctgtaggggtttctattcgccttctctcgctcaagtctgacaacaccggccctcctgactaactctcgcggtctcgagtcgtaggacggacgaggtctagtattacttacgtcgtcgtgcctatatatgactagtagtggtacgactccgttccggtaggttacggttccggacgggaacggtaccgtaaacgggtcgacccggttaacgtacggtacgaccggacccgtaacggccgtacccggtcccccgg

SEQ ID NO: 397068 - DNA, 543 bp, Homo sapiens
  misc_feature: GZ8MTXP02GB59P.9.53.E09.1.454.CMB.2.raw
  modified_base (225)..(225): a, c, t, g, unknown or other
  modified_base (243)..(243): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctctggacagtcgatcaccatctcctgcactggaaccngcagtgatgttgggattntgacttgtctctggtaccaacagcaccaggcaaacgcccccaaactcatcatttatgaggtcactaagcggcctcaggggtttctattcgccttctctggctcaagtctgaccaacaccggcctccctgacaatctcgtgggctcaggctggaggacgaggctagattattactgctgctcatactggcagatggtacgacgtacgtcccggtaggtaacgttcgggacgggaacgggacccgtaaagggtcgacgtcggtaccgtacggtacgaacgaccccgtaaggccgttccccgg

SEQ ID NO: 397069 - DNA, 665 bp, Homo sapiens
  misc_feature: GZ8MTXP02F5838.9.53.E09.1.454.CMB.2.raw
  modified_base (210)..(210): a, c, t, g, unknown or other
  modified_base (228)..(228): a, c, t, g, unknown or other
  modified_base (248)..(248): a, c, t, g, unknown or other
  modified_base (270)..(270): a, c, t, g, unknown or other
  modified_base (305)..(305): a, c, t, g, unknown or other
  modified_base (622)..(622): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcaccntctcctgcactggaaccngcagtgatggttgggattangtacttgtctcctggtaccaanagcacccgaggccaaacgccccaatcatcatttangagtcactaacgccgtcccttacgaggggtttctacgttcgcctttcgtcgtcggtctaccgaaggttctgaaccgaaaccaccggggtcccccttacccccggaaactaaacgttcccttaccgtcggggtcccttacccgaaggttcccgtaggacccggaacggtagggtaccttagtaattactttaacgtggaccacgtctactagttactagtcgttacggtttccggtttaccttcgttacgtaaagtacgttaacgtttccgggggacgggtacgggtaaccgaggtccgtacggaccgtttaaccggnggtaacgtaccgaccggtaccgtaccggtccgtcccgtacccg

SEQ ID NO: 397070 - DNA, 562 bp, Homo sapiens
  misc_feature: GZ8MTXP02F291O.9.53.E09.1.454.CMB.2.raw
  modified_base (228)..(228): a, c, t, g, unknown or other
  modified_base (304)..(304): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctctggtaccaacagcaccaggcaaacgcccccaaactcatcatttangaggtcactaagccggccctcgtaggggtttctagttcgccttctctggctcaagtctgacaacacggccctcctgacaatctcgtcggctccgaggctaggaggacgaggctagattattactgctgctcatactgacagtagtgggtacacgtacgttcccggttagggttacgttcggggaacgggacgggtaccgtaaaggtcggtaacccgtccgtacggtcgacggtacccgaacggtccctcggtcccccg

SEQ ID NO: 397071 - DNA, 549 bp, Homo sapiens
  misc_feature: GZ8MTXP02ISFJP.9.53.E09.1.454.CMB.2.raw
  modified_base (222)..(222): a, c, t, g, unknown or other
  modified_base (263)..(263): a, c, t, g, unknown or other
  modified_base (299)..(299): a, c, t, g, unknown or other
  modified_base (408)..(408): a, c, t, g, unknown or other
  modified_base (430)..(430): a, c, t, g, unknown or other
tcagtgatacgtctcacgaccggtgctcgatttagagagagtgtggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactgaaccngcagtgatggttggattatgacttgtctcctggtaccaacngcacccaggcaaacgtccccaaactcatcatttacngaggtcactaagcgcctcagggttctatcgcttctctgctcaagtctacgacaccacggtcctccctgaacatctctcggctccgagctgagacgagctgattattacngtctgctcatagtcgcgaagtntggttagactacgtcccgttagggtaactttcggggcggaaggggaccgtaaacgggtcgaaccggtaccgttaacggtcgaacgacccggtaaacggccgtccgtacccccgttccgg

SEQ ID NO: 397072 - DNA, 640 bp, Homo sapiens
  misc_feature: GZ8MTXP02HZ3RZ.9.53.E09.1.454.CMB.2.raw
  modified_base (625)..(627): a, c, t, g, unknown or other
  modified_base (629)..(640): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaaagaaccagatctccctgaagctgacctctgtgaccgccgcggacacggccgtgtattactgtgcgagacgttcccaaatatagcaacagctggtacattccttttgatatggtggggacccaaaggggacaaagtcgggtccaccggttctccttcaacgccctaccaaccccgaaacggggcccccaagttcccgggttccttcccccccgttgggcccgtccccctgcccgttccccgaagggaccgacctaccccgtcccgaaggaaccgcccgaacgacggcccgggtccccgtcgggggtccttcgggcccgttagggacccaaaacggggtccttaaacccgtttcccgaaggtaccgttacttacccgaacgtggaacgggtcggggacgtcgggacaaacgggcgacgataaggnnncnnnnnnnnnnnn

SEQ ID NO: 397073 - DNA, 511 bp, Homo sapiens
  misc_feature: GZ8MTXP02FUIOR.9.53.E09.1.454.CMB.2.raw
  modified_base (241)..(241): a, c, t, g, unknown or other
  modified_base (299)..(299): a, c, t, g, unknown or other
  modified_base (417)..(417): a, c, t, g, unknown or other
  modified_base (430)..(430): a, c, t, g, unknown or other
tcagtgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattangaccttgtctcctggtaccaacagccacccaggcaaacgcccccaaatcatcatttangagtcactaagcggccctcgtagggtttctattcgcttcctctgctccaagtctgacacacggcctccctgacatctctggctcgagctgaggacgaggctgattattactgctgctnatatgcagatggnaactcgtccgtaggtatcgggcggacgggaccaagggtcgaccgtccgtaaggtccacgacccgagtccgtcgccccgtcg

SEQ ID NO: 397074 - DNA, 703 bp, Homo sapiens
  misc_feature: GZ8MTXP02F6WDB.9.53.E09.1.454.CMB.2.raw
  modified_base (228)..(228): a, c, t, g, unknown or other
  modified_base (269)..(269): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacaggatcctgggcccagtctgccctgactcagcctgcctccgtgtctgggtctcctggacagtcgatcaccatcctcctgcactggaaccngcagtgatggttgggattatgtaccttgtctctgtaccaanacgcacccaggaccaaacgccccaaatcatactatttagtgaacggtcaacgtaacgccggtaccccttgtaacggggtttctacgttccccgtctttctcgtcggccttacccgaagtcctacgaaaccaaaccgtacccggccccttacccgagaacctaaacgttccctacgttcgggacctccgaaggtcgacggaggaccgaggtactagtaatttacgttacgtcgtacgtcgtaccttagtaacttagtcggcgtaaaaggtaggttacgggtaaccgtaacccgttacccgggttacccgggttagggttaccgggttaccgggggacggggtaaccggggtaaaccgtaacggggtacccgggtaacccggttaccggtacggttacccggaacccggtacccggtaaccggtcccgtcccccgg

SEQ ID NO: 397075 - DNA, 593 bp, Homo sapiens
  misc_feature: GZ8MTXP02IP3H6.9.53.E09.1.454.CMB.2.raw
  modified_base (559)..(559): a, c, t, g, unknown or other
  modified_base (578)..(579): a, c, t, g, unknown or other
  modified_base (581)..(593): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagacgttacccaaatatagcaacagctggtacatttcccttttgatagttggtggggaccaaaggggacaaagtcggttaccaccgttcttccttcacgccctccaaccccgaacgggccccacgttccggttcccttccccccgtggcccgtcccctgccctacccgagggacgccacccgtccgagacgccacacggcccggcccgtcggggcctcggcccgtcggtaccgaaaacggtacccttaccttacccgaacgtacccgtatacccacgtggacggcgggtacgnggacgaaggcgacaagtgnncnnnnnnnnnnnnn

SEQ ID NO: 397076 - DNA, 888 bp, Homo sapiens
  misc_feature: GZ8MTXP02H51YG.9.53.E09.1.454.CMB.2.raw
  modified_base (228)..(228): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctctcactcaggacacagggtcctgggcccagtcctgccctgactcagcctgcctccgtgtcgtggtctcctggacagtcgatcaccatctcctgcacgtaggaaccngcagtggagtttggttaggggaatttacgttcgtaccttcggtccttcgtacggtaacccaacgacgaccaacccgacggaccaaaccgacccccaaatccatactattagagtacgtactacgtaacgccggtaccgtcgtacggggttttactacgttccgtccttccgttcgtcgggtaccttaccgaaacgttcccgtacgtaaaccgtaaacccgtacccgggtaccccttaacccccgttaaggaaacccttaaactcccgtttccggtccggggtacccgtacccccggttaagggcccggttaggggaaaccgggtaacgggaccgggtacgtttaggttaaacctttaaacggtttaccttacggtacgttttcggaccgtttaacccgtaatttaagttaacccggaacgtaacggttaaaggttccggggttaaacgttaacccccgttaaacccggggtttccccgggttaaaagggggtttttaaccggggtaccccgggggtaaaacgggggtaaacccgggtaaaaccgggaaccggggttcccgttaaaccccggggttaaccgggttacggggttaaaccccgacggaaacccccggggttaaaccggtacccgggttttccccccggtaaccccccccgggg

SEQ ID NO: 397077 - DNA, 561 bp, Homo sapiens
  misc_feature: GZ8MTXP02FEN1B.9.53.E09.1.454.CMB.2.raw
  modified_base (224)..(224): a, c, t, g, unknown or other
  modified_base (243)..(243): a, c, t, g, unknown or other
  modified_base (298)..(298): a, c, t, g, unknown or other
  modified_base (307)..(307): a, c, t, g, unknown or other
  modified_base (345)..(345): a, c, t, g, unknown or other
  modified_base (414)..(414): a, c, t, g, unknown or other
  modified_base (426)..(426): a, c, t, g, unknown or other
  modified_base (430)..(431): a, c, t, g, unknown or other
  modified_base (442)..(442): a, c, t, g, unknown or other
tcagtgatacgtctcacgaccggtgctcgatttagagagagtgtgttgggttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcatcaccatctcctgcactggaaccngcagtgatggttgggattngtaccttgtctcctaggtaccaacacgaccacccaggaccaaacgcccccaaatnatcatttangagtcaacacgcgcctgtagggttcattcgccttctcnggctacaagtctcgacaacgacgtccctcctagacatctcgtcgggctcgagctaggacgtagacggtntagtattatacngctnntactagtacgngacgtagtacgtcggtacgtacgaccggttaccggtaggtacggtacgggacgggacggtaaccgtacggtccgtaccgtcgacggtaccgaccggacccgacggccctcccgtacccg

SEQ ID NO: 397078 - DNA, 597 bp, Homo sapiens
  misc_feature: GZ8MTXP02IL1E0.9.53.E09.1.454.CMB.2.raw
  modified_base (202)..(202): a, c, t, g, unknown or other
  modified_base (314)..(314): a, c, t, g, unknown or other
  modified_base (479)..(479): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacngtcgatcaccatctcctgcactggaaccagcagtgatggttaggattatgtaccttgtctcctggtaccaacagccacccaggaccaaacgaccccaaactcatcaatttangacgtacactaagccggcctgtacggggtttctacttcgtcttctctggtcctacgtacgttctacgaaccaaccgacccggtcctaccctgaactactctcgtcgggcctcgaggcgtaggacgacgagtctagtaattattacgtgctgcctatatactcganagtagtggtacgtactaccgttcccggttaggttaccggtacggggacgggtaacggtaacgtaacgggtaaccgtacccggtacgttacgggacacggtacccgtaacggtcccccg

SEQ ID NO: 397079 - DNA, 628 bp, Homo sapiens
  misc_feature: GZ8MTXP02IBPF2.9.53.E09.1.454.CMB.2.raw
  modified_base (227)..(227): a, c, t, g, unknown or other
tcagtgatacgtctcacgaccggtgctcgatttagagagagtgtgttggggtttgggggggtcacagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactggaaaccngcagtgagttggttagggattatgtaccttgtctcctcggtaaccaacacgacacccgaggaccaaaccgacccccaaactcactctattatagaggtcaactacggccgtaccgtcgtaggggtttctagttctccttctctcggcctacgtaacgttctacgaaccaacgacccggtccctccgtacgaactaactccgtcgcggtctccgaggtcgtaggacggacggaaggtcttagtatttacttacgtcggcttcgcttacaagttacgtgacaggtacgtggtacgaccgtccggttccggtagggttacggttcggggacggggtaacgtacccggaaggttccgaaccggtccgtcggaccacggtaacccgacggtcctacccggtccccg

SEQ ID NO: 397080 - DNA, 544 bp, Homo sapiens
  misc_feature: GZ8MTXP02J14SQ.9.53.E09.1.454.CMB.2.raw
  modified_base (227)..(227): a, c, t, g, unknown or other
  modified_base (233)..(233): a, c, t, g, unknown or other
  modified_base (263)..(263): a, c, t, g, unknown or other
  modified_base (294)..(294): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtnatgtggattatgaccttgctctggtacacngcaccagcaaacgccccaaatcatcatttangacgtacactagcggcctcgagggtttcattcgcttctcgtgtctcaagtctgaccaacgaccgctcccagacatctcgtggctcgacggctggaggcgagctagtattacgtctgtctgctcaattcagcagatgggtactactacgttcccggtggtaacgttccggggacggtaacggggaccgtaaggggtaccgtaccggtaaccgttaacggcaccggacccgaacgggcctttccgcccccgg

SEQ ID NO: 397081 - DNA, 573 bp, Homo sapiens
  misc_feature: GZ8MTXP02HVQAE.9.53.E09.1.454.CMB.2.raw
  modified_base (227)..(227): a, c, t, g, unknown or other
  modified_base (367)..(367): a, c, t, g, unknown or other
  modified_base (375)..(375): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttgggattatgaccttgtctcctggtaccaaacagccacccaggaccaaacgcccccaaactcatcatttatgaggtcactaagcggcctgaggggtttcattcgccttctctgctcagtctgacaacncgcctccngactatctcgtcggctcgaggctggacggacgaggctgatttattacgtgtcttagcttcagtatgacgagagttggacgacctaccgttcccggtggtttacgttacgggacggggtaacggaacccgtaacgggtccgtaccggttaaccgtaacggtaccgacggaccccgaacggtcccgtacccggtcccccg

SEQ ID NO: 397082 - DNA, 561 bp, Homo sapiens
  misc_feature: GZ8MTXP02F8441.9.53.E09.1.454.CMB.2.raw
  modified_base (228)..(228): a, c, t, g, unknown or other
  modified_base (246)..(246): a, c, t, g, unknown or other
  modified_base (295)..(295): a, c, t, g, unknown or other
  modified_base (385)..(385): a, c, t, g, unknown or other
  modified_base (411)..(411): a, c, t, g, unknown or other
  modified_base (420)..(420): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctccgtggacagtcgatcaccatctcctgcactggaaccngcagtgatgttgggattngacctgtctctgtacaacagcaccagacaacgccccaaatcatcattangagtcactaagcgtcctcgtaggggttctagttcgccttctctgctcagtctgacacaccggcctcctgacatctgtcggctcgagtcgngaggacgaggtcagtattaaagttcngtctgactntataatggactagtagtaggtacgtactaccgttaccggtacggttacggttacgggtacgggtaacgggaaccggtaacggtacggtaccgtaacggttacggtacgtacggaccgaaacggtaccgtaccgtcccccgg

SEQ ID NO: 397083 - DNA, 598 bp, Homo sapiens
  misc_feature: GZ8MTXP02GIE7X.9.53.E09.1.454.CMB.2.raw
  modified_base (212)..(212): a, c, t, g, unknown or other
  modified_base (217)..(217): a, c, t, g, unknown or other
  modified_base (230)..(230): a, c, t, g, unknown or other
  modified_base (248)..(248): a, c, t, g, unknown or other
  modified_base (255)..(255): a, c, t, g, unknown or other
  modified_base (268)..(268): a, c, t, g, unknown or other
  modified_base (309)..(309): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacgagggtcctgggcccagtctgccctgactcagcctgcctccgtgtcgtgggtctccgtggacagtcatccacntctcngcacgtggaaccngcagtgatggttggattntgtcttntctctgtaccaanagaccaccaggaccaaaccgacccccaaatcatctatttangacgtcaacgtaagccgtccgtcgtagggtttactagttcgtccttctcgtggtctaccgaagttctagaaccaacgaccgtccctcctagaactaactctcgtacggcctacgagcgtaggacgggaacgacgggtctagtaactttagttactggtacttgtacctataatacgttcgacgtaagtagtaggtacgaacctccgtttccgggtagttacggtcgggacggacggaccgtaggtccgacgtaacgtacgacgacgtaccgacggtcctaccgtccccg

SEQ ID NO: 397084 - DNA, 577 bp, Homo sapiens
  misc_feature: GZ8MTXP02FGO3K.9.53.E09.1.454.CMB.2.raw
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccagcagtgatggttgggagttatgaccttgtctcctggtaccaacagcacccaggacaaagcccccaaactcatcatttatgaggtcaactaagccggccctcgtaggggtttctattcgccttctctggctccaagtctgacaacacggcctcctgacaatctctggctcaggctgaggacgaggctagattatactgctgctctaatactgcaagtagtggtacgacacctcccggttaggttaggttccgggacggggacggggaccctaaaagggtcgtaacccggtcccgttaaagggggtcccaacgggtacccccgaaaacggggcccttacggtcccccccgg

SEQ ID NO: 397085 - DNA, 579 bp, Homo sapiens
  misc_feature: GZ8MTXP02JPPIK.9.53.E09.1.454.CMB.2.raw
  modified_base (224)..(224): a, c, t, g, unknown or other
  modified_base (264)..(264): a, c, t, g, unknown or other
  modified_base (304)..(304): a, c, t, g, unknown or other
  modified_base (335)..(335): a, c, t, g, unknown or other
  modified_base (448)..(448): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcatggaacngcagtgatggtggattatgtaccttgtctctggtaccaanacgcaccaggaccaaacgacccccaaactcatactattangagtcactagcgcctcgtaggtttctagtcnccttctctcgctcgaagtctgacaacgaccggcctcctagacaactctacgtggtcctacgaggcgtaggacggacgacggtctagtaatttactacgtgtacgtcgtcttanactatacgacgagtagtaggtacgacgtaccgttccggtaggttacgtcgggggacggtacgggaaccgtaacgggttccgaccgttaaccgtaggaccgacggtacccgaacggccgtacccgtcccccg

SEQ ID NO: 397086 - DNA, 565 bp, Homo sapiens
  misc_feature: GZ8MTXP02IXLVE.9.53.E09.1.454.CMB.2.raw
  modified_base (385)..(385): a, c, t, g, unknown or other
  modified_base (396)..(396): a, c, t, g, unknown or other
  modified_base (456)..(456): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgacttgtctcctggtaccaacagcaccaggcaaacgcccccaaatcatcatttatagaggtcacgtaagcgtccctcgtaggggtttctagttcgtccttctctggctccaagttctgaccaacgaccggacctcccngaacaagtccncgttggacctccgagctggacgacgaggctagatttatacgtgctgcttcatatgcaagntgtagactacgcccgtggttaacgtcgggcggaacgggaccgtaaagggccggtaccgttaaccgtacggttaccgaccggaccgaacggtccgtaccggtccccccgg

SEQ ID NO: 397087 - DNA, 508 bp, Homo sapiens
  misc_feature: GZ8MTXP02FKDU3.9.53.E09.1.454.CMB.2.raw
  modified_base (262)..(262): a, c, t, g, unknown or other
  modified_base (376)..(376): a, c, t, g, unknown or other
  modified_base (385)..(385): a, c, t, g, unknown or other
  modified_base (395)..(395): a, c, t, g, unknown or other
  modified_base (493)..(508): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaaagaaccagatctccctgaagctgacctctgtgaccgccgcggacacggccgtgtattacngtgcgagagttcccaaatatagcaacagctggtacattcctttgatatgtggggccaagggacaatggtcaccgtctcttcagcctccaccagggcccatcggtcttccccccnggcgccctnctcccaggancaccctccgagagcacagccgccctgggctcgcctggtcaaaggacctaacttccagacgtatcactgacgcgggactggacgaacggcgacataggnnnnnnnnnnnnnnnn

SEQ ID NO: 397088 - DNA, 683 bp, Homo sapiens
  misc_feature: GZ8MTXP02GKMH7.9.53.E09.1.454.CMB.2.raw
  modified_base (258)..(258): a, c, t, g, unknown or other
  modified_base (312)..(312): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagccctccctccgcgtccgggtctcctggacagtcggtcaccatcctcctgcactggaaccagcagtgactattggtgctttaataactntgtctcctgtaaccaacagccaccgagacaaacgtccccaaatcatgtatttanagagtacaagtacgcggtaccctcgtcgggtccctagactcgtcttcctcgtcgcctaccgtaagtctcgggaccaaaccgacccggtcccttccccgtacgtacccgttcgttcgtcgggtcctcccgacgtccgtacggtacgtagtcggtaacggtcgttagtaatttaacgttaacgtggtacctacgtctactagtagtacggaccacggaccaacccaacgtaacgttcggttacggttaacgggtaacgggtaccgggtaaccgtaccgggttacccgtacccggttaccgtaaccggttaccgaacccggtaaccccgaaacccgggacccccaaccccgtacctaccggtcccttaaccccg

SEQ ID NO: 397089 - DNA, 670 bp, Homo sapiens
  misc_feature: GZ8MTXP02FMB0K.9.53.E09.1.454.CMB.2.raw
  modified_base (210)..(210): a, c, t, g, unknown or other
  modified_base (228)..(228): a, c, t, g, unknown or other
  modified_base (311)..(311): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcacntctcctgcactggaaccngcagtgatggttgggattatgaccttgtctcctggtaccaacagaccaccaggaccaaacgacccccaaactcatctatttangagtcactaagcggcctcgtacggggttctattcgccttctctggtctacaagttctcgaccaacgaccgcctccctgactaatcctcgtcggtcctcgaggtctaggacggacggtacggtacttaggtaattttacttaccgttaggtaccttggtaccttacgtaatttaacgtcgtaccgaaggtaagtcgggttaccgaaccgttaccccggttcccgggttacgggtttaacggtttcccgggggaaccggggaaacggggtaacccggtaaacggggttaccggtaaccccgttaaccggttaacggacccgtaaccggaccccgaaacggtcccgtacccggtccccccgg

SEQ ID NO: 397090 - DNA, 630 bp, Homo sapiens
  misc_feature: GZ8MTXP02JMGX7.9.53.E09.1.454.CMB.2.raw
  modified_base (322)..(322): a, c, t, g, unknown or other
  modified_base (442)..(442): a, c, t, g, unknown or other
tcagtgatacgtctcacgaccggtgctcgatttagagagagtgtggttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcaccatctcctgcactcggaaccagcagtgagtggttgggattagtgtaccttgtcctccgtacggtaaccaacacgccacccgagaccaaacgacccccaatccatactattanagacgtacacgtaacgccgcctgtaggtttctagttcgtcttctcgtgctcagtctagaccacgtaccgcctacctagactatccgtcgtacggcctcgagcgtaggacggtagacggtntacgtatttacgtactgtctagtctacgtatagttgacgtagtagtacggtacgactccggtttacccgggtaggttaccgggtaccggggaacggggtaaccggggtaaccggtaacggggtaccgtacccgggttaacgtacggtaacgacccggaccgtacggtccccgttcccggtacccccgg

SEQ ID NO: 397091 - DNA, 534 bp, Homo sapiens
  misc_feature: GZ8MTXP02IOEX1.9.53.E09.1.454.CMB.2.raw
  modified_base (228)..(228): a, c, t, g, unknown or other
  modified_base (266)..(266): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgattggttggattatgacttgtctctgtacacngcaccaggacaaacgccccaaatcatcattatgagtacactaagccgcctcgtagggtttctattcgcttctctgctcaatctgacacacgcctccctagacatctcgcggctccgaggcctggacggacgaggtctagatttattactgctgctcatatgcagagtggtcgacgtacgtaccgtggttagttcgggacggtacgggtaccgaacggtacgtaccggttccgaaggtcgacggaccgtaacggccgtaccgtcccccg

SEQ ID NO: 397092 - DNA, 519 bp, Homo sapiens
  misc_feature: GZ8MTXP02H9FCV.9.53.E09.1.454.CMB.2.raw
  modified_base (225)..(225): a, c, t, g, unknown or other
  modified_base (231)..(231): a, c, t, g, unknown or other
  modified_base (266)..(266): a, c, t, g, unknown or other
  modified_base (299)..(300): a, c, t, g, unknown or other
  modified_base (336)..(336): a, c, t, g, unknown or other
  modified_base (407)..(407): a, c, t, g, unknown or other
  modified_base (409)..(410): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccatctcctgcatggaaccngcagtnattggttgggattatgaccttgtctctgtaccaanagcacccagcaaagcccccaaatcatcatttannaggtcactaagcgcctcagggtttctattcgccttntctggctacagtctgacaactacgcctcctgaactaatctctggctccgagctgagcgagctgatatatgntnntcatatagagagagtgtacgactacgtccgtaggtacggtacggacgggacggaacgaacggtacggtaccgtaacgtacgtacgacgaccgacgaccgtaccgtcccg

SEQ ID NO: 397093 - DNA, 497 bp, Homo sapiens
  misc_feature: GZ8MTXP02FNWLY.9.53.E09.1.454.CMB.2.raw
  modified_base (226)..(226): a, c, t, g, unknown or other
  modified_base (245)..(245): a, c, t, g, unknown or other
  modified_base (303)..(303): a, c, t, g, unknown or other
  modified_base (328)..(328): a, c, t, g, unknown or other
  modified_base (367)..(367): a, c, t, g, unknown or other
  modified_base (409)..(409): a, c, t, g, unknown or other
  modified_base (411)..(412): a, c, t, g, unknown or other
  modified_base (419)..(421): a, c, t, g, unknown or other
  modified_base (423)..(424): a, c, t, g, unknown or other
  modified_base (426)..(426): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcatcaccatctcctgcactggaaccngcagtgatgttgggattangaccttgtctcctggtaaccaacagcacccaggacaaacgccccaaactcatcattangagtcactaacgcgcctcagggttnattcgcttctctgctcaagtctgacaacacgccttcccngacaatctctggctcgagctgacgacgagctagattatacgncnnctcatannnanngngacactcgtagtagtcggacggacggacgaacgacgacgtaacgtacgtacgacgacgacgcgccgtcccg

SEQ ID NO: 397094 - DNA, 648 bp, Homo sapiens
  misc_feature: GZ8MTXP02GW95W.9.53.E09.1.454.CMB.2.raw
  modified_base (451)..(451): a, c, t, g, unknown or other
  modified_base (517)..(517): a, c, t, g, unknown or other
  modified_base (530)..(530): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctcgccctgactcagcctgcctccgtgtctgggtctccgtggacagtcgatcaccatctcctgcacgtggaaccagcaagtgattgggttgggaacttgtcgtaccttgtcctccgtacggtaaccaacgacgacccacccgaggacccaaaccgacccccctaaaatccattacctatttacgtagtacggtacaacgtacggccgccttcgtaacgggtttctacgttcgtccttcgtcgtggtacctacaaggttccagaaccaaaccgtacccgggtaccccttcccgtanacctaacgtccttcgtcggtcctcggacggtcgtaggacggaccggaggtctagtatttatactgntcgcttacagttntcgagagtgtacggtactacgtccgtacggtggtacggtacgggacgggtaacggacggtacggtaccgtaccgtaacgtacggaccgtaccggaccgacggtcccgtacccgtcccg

SEQ ID NO: 397095 - DNA, 571 bp, Homo sapiens
  misc_feature: GZ8MTXP02I5UQV.9.53.E09.1.454.CMB.2.raw
  modified_base (227)..(227): a, c, t, g, unknown or other
  modified_base (267)..(267): a, c, t, g, unknown or other
  modified_base (289)..(289): a, c, t, g, unknown or other
  modified_base (298)..(298): a, c, t, g, unknown or other
  modified_base (433)..(433): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgacttgtctctggtaccaangcaccagacaaacgccccaaancatcattangaggtcaactaagccggcctcgtaggggtttctattcgccttctctgctcagtctgaccaacacgccctcctgaacatctctcgggctcgaggctaggacggacgaggtctgtatttaattctgtcttgccttanattatcgactagagttgtacgactaccgttcccggtggttacgttacggggcgggtaaacgggtacccgtaacggtccggtacccggttaacgtacggtacgaaccggacccgaacgggtccctccggtaccccccgg

SEQ ID NO: 397096 - DNA, 669 bp, Homo sapiens
  misc_feature: GZ8MTXP02F4D4D.9.53.E09.1.454.CMB.2.raw
  modified_base (231)..(231): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttggagttatgacttgtctctgtacaacagccaccaggaccaaacgacccccaaactcactctaatttatgtaacggtacaacgtaacggccggtcccgtcgtacggggtttctacgttccgtcttctcgtggccttacctagtctacgaaccaaccgaccggtccctacccgtagtaaccaacttcctcgtcgggtctcccgaggtcgtaggaacgggacgacggtcttagtaatttacttacgtgtcctagtacctactattagtacgtacgaggtacgtacggtacgtacccgtaccggtttacccggttacggggttaacggttaccgggggtaccggggtaaccggggaacccgtaacggggtaaccgtacccggttaccggttaccgggtacccgtaaccggacccccgaacgggttcccccg

SEQ ID NO: 397097 - DNA, 597 bp, Homo sapiens
  misc_feature: GZ8MTXP02JBFHS.9.53.E09.1.454.CMB.2.raw
  modified_base (226)..(226): a, c, t, g, unknown or other
  modified_base (319)..(319): a, c, t, g, unknown or other
  modified_base (470)..(470): a, c, t, g, unknown or other
  modified_base (475)..(475): a, c, t, g, unknown or other
  modified_base (489)..(489): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcatccgtgtctgggtctctggacagtcgatcacatctcctgcactggaaccngcagtgagttggttaggggattatcgtaccttgtctcctggtaccaacgacgccaacccgaggaccaaaccgacccccaaatcatctatttangagtcacgtagccgacctcgtagggtttctacttccgtctttctcgtacggtccttaccgtaacgtcctacgaaccaaaccgcccggtccctccgtagacctaactctcgtcgggctccgtagctaggaggacgagctgaatttcttacgngtctntctacaattgtcgntagtagtgtcgtactacgtccggttacggtacggttacggtacgggacgggtaccggtaacggtacggtaaccgtacgtacggtacgacgaccgaacgtacgtcccgg

SEQ ID NO: 397098 - DNA, 710 bp, Homo sapiens
  misc_feature: GZ8MTXP02HI3AY.9.53.E09.1.454.CMB.2.raw
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacgagggtcctgggcccagtctgccctgactcagcctgcctccgtgtctgggtctcctggacagtcatcaccatcctcctgcactggaaccagcaagtgagttggttgggagttatgtaccttgtcctcctacggtaaccaacacgaccaacccgaaggaaccaaaccgaccccccaaactcctaatactaatttagaggtacggtacctaacgtaacggcccgtcccgttaggtacggggttttctacgttccgtcttcgtcgtcgcctacgacgtctacgacaccgccgtaccctcgtacgactaactctcgtcgggcctacgaggtccgtaggacgggacgacggtcttaggtaactttactaacgtcgtacgtcggtaccttataacgtagtcggtacgtaagtacggtacggtaccgtaaaccggtacccggttccgggtttaaacggggttaccgggttaccgggggaccggggtaaccggggtaacccgtaaggggtaaccccggttaaccggttacccgggttacggacccggtaccggaacccggttaacgggtcccccgg

SEQ ID NO: 397099 - DNA, 536 bp, Homo sapiens
  misc_feature: GZ8MTXP02GG6EM.9.53.E09.1.454.CMB.2.raw
  modified_base (229)..(229): a, c, t, g, unknown or other
  modified_base (308)..(308): a, c, t, g, unknown or other
  modified_base (425)..(425): a, c, t, g, unknown or other
  modified_base (442)..(442): a, c, t, g, unknown or other
  modified_base (452)..(452): a, c, t, g, unknown or other
  modified_base (524)..(524): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatccaccatcctcctgcactggaaccngcagtgatggttgggattatgacttgtctcctggtaccaacagccacccaggaccaaacgcccccaaatcatcatttangagtcaactagcgcctgtaggggttctatcgtccttctctcgctcaagttctgaactacgacgccctcctgacatctcgtggctcgacggctggaggacgaggctagatttaattcngctgctcatatgctagngttggcaacnccgtaccgtggttacgtcggcggtacgggaccgtaaggtcgaccgtaacgtacgacgaccgacgacggtccnccggttcccccg

SEQ ID NO: 397100 - DNA, 616 bp, Homo sapiens
  misc_feature: GZ8MTXP02FHRBO.9.53.E09.1.454.CMB.2.raw
  modified_base (310)..(310): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgccctcgtgtctgggtctcctggacagtcgatcacatcctcctgcactggaaccagcagtgatggttaggggattatgtaccttgtctcctggtaccaacagccaccaggacaaacgaccccaaactcatcatttangagtcactaagccgcctgtagggttctattcgccttctctggtcctacaagtctgaacaacgcggccctccctgaccaatcctcgtcggggtcctccgagggccgtaggacgggaacggaggtcgtagtaactttattaacgtggtctaggtcctttacaaattacgttacgacgtaagaagttgggtactaccgaaccgtttccccggtaggttaacggtttcgggacggggtaacgggaccgtaaaggtccggaacccgtaaccgtacggtaccgacgacccgaacggtcctccgtccccccgg

SEQ ID NO: 397101 - DNA, 585 bp, Homo sapiens
  misc_feature: GZ8MTXP02IXUCX.9.53.E09.1.454.CMB.2.raw
  modified_base (258)..(258): a, c, t, g, unknown or other
  modified_base (288)..(288): a, c, t, g, unknown or other
tcagtgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactggaaccagcagtgatgtggattatgacttgtctctgtacangcaccagcaagcccccaaatcatcatttangagtcactaagcgcctcgaggggtttcattcgcttctctggctccaagtctgacaacacggcctccctagacaatctcgtggcctcgagctggacggacgagggtctggtaatttaacgttaccgtgcccgttagtcccttacaagttacgtcgacgtagtagttcgggtacgaccgtaccgttcccggttaggtacgttcggggtacggggaacggtacccggtaaacgggttcccgtaacccggttaaccggtacggtaccgaccggtaccgaacgggtccctaccggtcccccg

SEQ ID NO: 397102 - DNA, 562 bp, Homo sapiens
  misc_feature: GZ8MTXP02I1XFI.9.53.E09.1.454.CMB.2.raw
  modified_base (229)..(229): a, c, t, g, unknown or other
  modified_base (307)..(307): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgaccttgtctcctggtaccaacagcacccaggacaaacgcccccaaatcatcatttangagtcactaagcgcctgaggggtttctattcgtccttctctgctctaagtctgacaacacggcctcctgacatctctggcctcgaggctggaggacgaggctagattattactgcttgctacatatgcagagtggtagacctaccgttacccggtgggttacgttaccggggacgggaacgggtaccggtaaacgggtcgtaacccggtccgttaacgggaccacggacccgaacggtccgtacccggtcccccg

SEQ ID NO: 397103 - DNA, 612 bp, Homo sapiens
  misc_feature: GZ8MTXP02FKAZS.9.53.E09.1.454.CMB.2.raw
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactggaaccagcagtgatggttgggagttatgacttgtctcctggtaccaacagccacccaggacaaacgacccccaaactcatctatttatgaggtacaactaacggccggccctgtacggggtttctacttccgtcttctcgtggtcctactagtctaggaacaaaccgaccggtcccctacccgtacgaacctaaattcccgtcgttcggggcctacccgaggcctaggaacgggacgacggcttagtacttaattactgtctgtactcaatatgactagagtgggtacaccgtacgttcccggtaggttacggttcgggacgggaacggggacgtaaacgggtcgtacccgttaccgtacgggtacaccggacccgacgggtcccg

SEQ ID NO: 397104 - DNA, 621 bp, Homo sapiens
  misc_feature: GZ8MTXP02FZSOS.9.53.E09.1.454.CMB.2.raw
  modified_base (210)..(210): a, c, t, g, unknown or other
  modified_base (229)..(229): a, c, t, g, unknown or other
  modified_base (235)..(235): a, c, t, g, unknown or other
  modified_base (247)..(247): a, c, t, g, unknown or other
  modified_base (299)..(299): a, c, t, g, unknown or other
  modified_base (336)..(336): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcacccctcctcactcaggacacagggtcctgggcccagtctgccctgactcagcctgcctccgtgtctgggtctctggacagtcgatcaccntctcctgcacgtggaaccngcagtnattgtgggattngacttgctctgtacaacagcaccaggacaaacgccccaaactcatcatttanagaggttacactaacgccggcctcgtaacggggtttntacgttcgcctttctcgtggtcctacgaagtctcggacaaaccacggccctcccgtagacctaaactcgtctcggggcctccgtaaggcccgtagacgggtacgaacgggtctaggtatttattactggtctctctacgtatactgacgtagtaacgtggttaccgaaacgtccgtacccggttagggttaccgtttacggggacggggacgggtaacgtaaacgggtcgtacccggtaaccgtacggtccgaacgcccgtaaacggtcccgtacgtccccccgg

SEQ ID NO: 397105 - DNA, 748 bp, Homo sapiens
  misc_feature: GZ8MTXP02GDJ6R.9.53.E09.1.454.CMB.2.raw
  modified_base (208)..(208): a, c, t, g, unknown or other
  modified_base (226)..(226): a, c, t, g, unknown or other
  modified_base (306)..(306): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctctcactcaggacacagggtcctgggcccagtctgccctgactcagcctgcctccgtgtctgggtctcctggacagtcgatcacntctcctgcactggaaccngcagtgtatggttgggatttatgtaccttgtctccgtggtaccacagccacccagacaaacgaccccaatcatcatttangtagtcaacgtacgccggtcctacgtaggggtttctacgttcgtccttcgtcgtacggccttaccgtaacgttcgtacggaacctaaaccgtacccgggtaccccttacccgttacggaaaccttaaacgttcccgttaccggttcgggggtacccttacccggaaggggttccgttaacgggggaaaccgggacggtaaacgggttccgttaaaggtaacttttaaacgtttaacccgttcgtcccgtttacggtaccttaccggtaaatttaaccgttagaccgtaaacgttaggttaccggggtactaaccgttaaccccggtccgggtttaacgggtaccggtttacgggggacggggttaacgggaaccgtaaacgggtccgtaacccggtaacgtacggtaccgacggacccgttaacggccgtcccgtaccccgg

SEQ ID NO: 397106 - DNA, 579 bp, Homo sapiens
  misc_feature: GZ8MTXP02HRJHA.9.53.E09.1.454.CMB.2.raw
  modified_base (222)..(222): a, c, t, g, unknown or other
  modified_base (243)..(243): a, c, t, g, unknown or other
  modified_base (404)..(404): a, c, t, g, unknown or other
tcagtgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcaccatctcctgcactggaaccngcagtgattggttgggattangacttgtctcctggtaccaacagcaacccaggcaaacgccccaaactcatcatttatgaggtcactaagcgcctcgtaggggtttctattcgcttcctctgtctcaatctagacaacgacgccctcctagacaatctcgtggctccgaggtctgaggacgnggactgattatacgtgtctgtctctatatgactagagtggtagaccgtaccgtacccggttggtacgtttcggggaccgggtaaggggaccgtaacggggtacggtaacccggtaccgttaacggggtacaacggggtaccccgaaacggtcccgtaccggtacccccgttccgg

SEQ ID NO: 397107 - DNA, 771 bp, Homo sapiens
  misc_feature: GZ8MTXP02IEIDW.9.53.E09.1.454.CMB.2.raw
  modified_base (207)..(207): a, c, t, g, unknown or other
  modified_base (226)..(226): a, c, t, g, unknown or other
  modified_base (271)..(271): a, c, t, g, unknown or other
  modified_base (312)..(312): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccntctcctgcacgtggaaccngcagtgattggtggtattatcgtacttgtctcctggtaaccaacncgaccaccgagacaaaccgacccccaatcatcgtatttagngagtcaacgtagccgtcctcgtagggtttctagttcgtccttcgtctcggcctacgtaacgttctacggtacccaaaccgtacccggtacccttacccccgtacggtaaaccttaaacgttcccgttccggtcccggggtacccttacccccggtaaagggcccgttaaggggaacccgggggtaacggtaaccggggtctttacggttaaaccgtttatttaaccccgttgggtaacccgtttgtaaccccttataaacgttaaacggttgaccgtaaggttaagttgggtaacccgttaacgtaaccccggtttcccgggttaaagggtttccggggttaacggggaaccgggggtaaccggtaaaccggaaacggggttcccgttaaccggtaaccggttaacggacgtaaccccggtacccgtaaccgggggtcccttaccccggttccccccgg

SEQ ID NO: 397108 - DNA, 582 bp, Homo sapiens
  misc_feature: GZ8MTXP02JESD0.9.53.E09.1.454.CMB.2.raw
  modified_base (234)..(234): a, c, t, g, unknown or other
  modified_base (268)..(268): a, c, t, g, unknown or other
  modified_base (385)..(385): a, c, t, g, unknown or other
  modified_base (400)..(400): a, c, t, g, unknown or other
tcagtgatacgtctcacgaccggtgctcgatttagagagagtgtgttgggtttgggggggtcacaagaggcagcgctctcgggactctccaccatggcctgggctctgctgctcctcaccctcctcactcaggacacagggtcctgggccccagtctgccctgactcagcctgcctccgtgtctgggtctcctggacagtcgatccaccatctcctgcactggaaccagcagtnatggttgggattatgtaccttgctctgtaccacngcaccaggacaaccgaccccaaatcatctattactaggacgtcaacgtacgccggtcctcgtagggtttctagttccgtccttctctgactcgtaagtctgacaacgccgtccctcnactatctcgtcgtcncgaggctaggacggacgaggtctagtaatttaatcgtgtctagcctataagtctagagtagtgtagacgtaccgtaccgttccggtaggttacggccgggaacgggtaaccggtaaccggaacggtccgtaaccgtaacgtaccggtaccgaccggtaccgaccggtcccgtcccgtacccg

SEQ ID NO: 397109 - DNA, 553 bp, Homo sapiens
  misc_feature: GZ8MTXP02H1UDD.9.53.E09.1.454.CMB.2.raw
  modified_base (232)..(232): a, c, t, g, unknown or other
  modified_base (265)..(265): a, c, t, g, unknown or other
  modified_base (314)..(314): a, c, t, g, unknown or other
  modified_base (353)..(353): a, c, t, g, unknown or other
  modified_base (404)..(404): a, c, t, g, unknown or other
  modified_base (440)..(440): a, c, t, g, unknown or other
  modified_base (445)..(445): a, c, t, g, unknown or other
  modified_base (462)..(462): a, c, t, g, unknown or other
  modified_base (537)..(553): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacacgcccctccctcaagagtcgagtcaccatgtcagtagacacgtccaaagaaccagatcctccctgaagctgacctntgtcgaccgccgcggacacggtccgtgtattcngtgcgagacgttacccaaatatagcaacagctaggtactatttcctttnatgtggtgggaccgaaaggactaagtcggtacaccgttntctcacgccctaccacccgaacgggccctacgtccggttcccttcccccgngcccgtccctgccctccgagcgcctacccgcgagcncgacncggcccgccgtgggccncgccgtagacgacggtacctccgttacagtacgtactcaggcgaggaccggcgtacggacgaacgccgacaagtnnnnnnnnnnnnnnnnn

SEQ ID NO: 397110 - DNA, 556 bp, Homo sapiens
  misc_feature: GZ8MTXP02F3B3B.9.53.E09.1.454.CMB.2.raw
  modified_base (283)..(283): a, c, t, g, unknown or other
  modified_base (545)..(556): a, c, t, g, unknown or other
tcagtgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaaagaaccagatctccctgaagctgacctctgtgaccgccgcggacacggccgtgtattactgtgcgagacgttacccaaatntagcaacagctggtactatttcctttgatagtggtggggaccaagggactaagtggtcaccgtctcttccagccctaccaacccgaacgggccctagtccggtcccttcccccgtgggcccgtccctagcctcccgaggacgcctacccgtccgagacgcacgacgcccggccctaggggctcgccgtacggtacgaaacggactaccttccgaagtaccgtaactcaccgtggacggcgggctggacgaaggcgactagannnnnnnnnnnn

SEQ ID NO: 397111 - DNA, 634 bp, Homo sapiens
  misc_feature: GZ8MTXP02FH6QK.9.53.E09.1.454.CMB.2.raw
  modified_base (227)..(227): a, c, t, g, unknown or other
  modified_base (246)..(246): a, c, t, g, unknown or other
  modified_base (265)..(265): a, c, t, g, unknown or other
  modified_base (290)..(290): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcacatctcctgcactggaaccngcagtgatgttgggattangactgtctctggtacaacngcaccaggacaaacgaccccaaacncatacatttatgagtcaactaacgcggccctcgtaggggtttctacgttcgccttctctgctccaagtctgacaacacggcctcctagactaactctcgtcggctcagctgagacgagctgattagtactgtcgtcgtcttactatagttagacgaagtagttaggtacgtaccgtaaaccgttcccggttaccggggttaaaggtttccggggtaccgggggtaaacggggaaccccgggtaaaacggggttacccgggttaacccggttaaccggttaacgggttaaccggtaaccggtaccccgaaaacggggtccccgtacccggtttaccccccccggg

SEQ ID NO: 397112 - DNA, 540 bp, Homo sapiens
  misc_feature: GZ8MTXP02GT6TQ.9.53.E09.1.454.CMB.2.raw
  modified_base (246)..(246): a, c, t, g, unknown or other
  modified_base (299)..(299): a, c, t, g, unknown or other
  modified_base (383)..(383): a, c, t, g, unknown or other
  modified_base (430)..(430): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctggtctcctggacagtcgatcaccatctcctgcactggaaccagcagtgatggttgggattangaccttgtctctgtaccaacagcaccagacaaacgaccccaaatcatcattangagtcataagcgcctgtagggttctattcgcttctctgctcaagtctgacaacgaccgcctccctagactaatcctcgtggtcnccaggctagacggacgaggctagattatactgctgctacatagtganagtagtgtacacgtacgtccggtaggtacggtcgggacggtaacgggaccgtaacggtaccgtaccggtaacgtacggtaccgacgaccgtacggtccgtaccgtccccg

SEQ ID NO: 397113 - DNA, 624 bp, Homo sapiens
  misc_feature: GZ8MTXP02FVY4T.9.53.E09.1.454.CMB.2.raw
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcctcctgcactaggaaccagcagtgatggttagggagttatgtacttgtcctccgtacggtaaccaacacgaccacccgaaggaccaaaccgacccccaaactcatactattatgagtcacgtaacgccgtcctgtagggtttctacttcgtcttctctcggctacgtagtctacgacaaccgaccgtcctacccgtacgtaactaacttccgtcgtacgggtccttaccggacggtaccgtagggaacggaccggtaaggtcttaggttaactttacgttacgtgtctcgtctactatagtcgagtagtagtgggtacaaccgtcgtccggttaggtacggttacggggacgggtaacggacgtacggtaaccgtaccgtacgtacgacgaccggaccgacggtccccg

SEQ ID NO: 397114 - DNA, 560 bp, Homo sapiens
  misc_feature: GZ8MTXP02FJ6IM.9.53.E09.1.454.CMB.2.raw
  modified_base (370)..(370): a, c, t, g, unknown or other
  modified_base (401)..(401): a, c, t, g, unknown or other
  modified_base (414)..(414): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcacccctcctcactcaggacacagggtcctgggcccagtctgccctgactcagcctgcctccgtgtctgggtctcctggacagtcgatcacatctcctgcactggaaccagcagtgatggttgggattatgaccttgtctcctggtaccaacagcacccaggcaaacgcccccaaactcatcatttatgagtcactaagcgcctcaggggttctattcgccttctctgctcagtctgacaacacgcctccngacaatctctggctcaggctgaggacgaggntagtattattacngctgctacatactgacagagtggtgacaaccgtcccggttaggtacgtttcgggacgggtaacggggaccgtaaaaggggtcgtaacccggtaaccgtaacggtaccgacggacccccgtaaacggcccgtaccggtcccccccgg

SEQ ID NO: 397115 - DNA, 630 bp, Homo sapiens
  misc_feature: GZ8MTXP02IIT71.9.53.E09.1.454.CMB.2.raw
  modified_base (316)..(316): a, c, t, g, unknown or other
  modified_base (360)..(360): a, c, t, g, unknown or other
  modified_base (378)..(378): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtcctccgtggacagtcgatcaccatcctcctgcacgtggaaccagcagtgattggttggggattatgaccttgtctcctggtaaccaacagcacccgaaggcaaacgcccccaaactcatcatttacnggaggtacactaacggcgccctgtagggtttctattcgctttcnctcgctcaatctgacacncggcctcctgacatctactggctcaggctaggacggacgacggctgatttacttaactgactgcttcaattagtagtacgagtaacgtcgggtacgtaaaccgtccgttacccggttagggttaccgtttcgggggtacgggaaacgggggtaccccgtaaaacgggttcccggtaaacccggttaaccggtaaaccgggttccgtaacggacccccggtaaacgggtccctaacccggggttcccccccgg

SEQ ID NO: 397116 - DNA, 557 bp, Homo sapiens
  misc_feature: GZ8MTXP02IPOOL.9.53.E09.1.454.CMB.2.raw
  modified_base (230)..(230): a, c, t, g, unknown or other
  modified_base (271)..(271): a, c, t, g, unknown or other
  modified_base (304)..(304): a, c, t, g, unknown or other
  modified_base (424)..(424): a, c, t, g, unknown or other
tcagtgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtcgtggtctcctggacagtcgatcaccatcctcctgccactggaaccngcagtgattggtgggtattatgtacttgtctctgtaaccancgcaccagacaacgaccccaatcatctatttanagtagtacacgtaacgccggtccctcgtagggtttctattccgtccttctctgcctcaactctcgacaacgtccgacctcctagacatccgtgtacggcctcacgcgtaggacggtacgnggtactagtatttagtactgtctgtacctatatacgtgtcgagttacgtgggtaacacgtacgttccgtggtacggtcgggacgacggacgtaggcctacgtcgtacgacgcgaccgtacggctcccgtcccg

SEQ ID NO: 397117 - DNA, 632 bp, Homo sapiens
  misc_feature: GZ8MTXP02GAK99.9.53.E09.1.454.CMB.2.raw
  modified_base (228)..(228): a, c, t, g, unknown or other
  modified_base (309)..(309): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatggttgggattatgtacttgtctcctggtaaccaacacgcacccaggaccaaacgccccaaactcatctattangagtcaactaagccggcctcgtaggggtttctagttcgtccttctcgtcggtctaccaagttctcgaacaaaccgtaccggtccctccgtagaaactaatccgtacgtcgggcctaccgaagggtctacggaaggtacggaggtcttagtaactttatactgtctgccttagatactgacgagtagtggttacgacctacggttcccggttagggttacggttaccggggaagggtaaccgggaaccgtaaacggggtccgtaacccggttaacgtaacggtaccgaaccggacccggaacggtcccgttaccgtccccccgg

SEQ ID NO: 397118 - DNA, 608 bp, Homo sapiens
  misc_feature: GZ8MTXP02ISC4A.9.53.E09.1.454.CMB.2.raw
  modified_base (229)..(229): a, c, t, g, unknown or other
  modified_base (391)..(391): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctccgtggacagtcgatcaccatctcctgcacgtggaaccngcagtgagttggttgggattatgtaccttgtctctggtaaccaacacgcaccagacaaacgacccccaaatcatactatttatagacgtacaacgtaacgccggtacctcggtacgggtttctagttcgtccttctcgtgtcctactaagtctcgaacaacncccggtcccttacccgtacgaaacctaacgttcctcgtcgggaccctcgaggtcgtaggagggtacgaggtctagtatttactcgtagtctgctcatgtcgactagagtggtacgtacacgttccggtaggttacggttcggacggtacgggaccgtaacgggtcgtaccggtaacgtacggacgtaccgacgtaacggtccgtacccgtcccccgg

SEQ ID NO: 397119 - DNA, 644 bp, Homo sapiens
  misc_feature: GZ8MTXP02FHCA9.9.53.E09.1.454.CMB.2.raw
  modified_base (227)..(227): a, c, t, g, unknown or other
  modified_base (322)..(322): a, c, t, g, unknown or other
  modified_base (635)..(635): a, c, t, g, unknown or other
tcagtgatacgtctcacgaccggtgctcgatttagagagagtgtgttggggtttggggggggtcacaagaggcagcgctctcgggacgtctccaccatggcctgggctctgctgctcctcaccctctcactcaggacacagggtcctgggcccagtctgccctgactcagcctgcctcgtgtctgggtctcctggacagtcgatcaccatctcctgcactggaaccngcagtgagtggttaggggattatgtaccttgtctcctacggtaaccaacacgccacccgaggaccaaaccgacccccaaactacactctatttanggacgtcaacgtaacgccggtccctacgtacggggttctacgttccacccttcgtctcgggtccttacccgaagttcctgaacccaaaccgaccggtccctcccttagaaacctaacgtccgtcggtacgggtcccgtaccgtacgggcgtaggaacgggtaacgacgggtactaggtaactttaacgtactcggctagcctactaatcgacgtcgaagtacgtgggactacgaacccgttccgggtaggtacgttcgggacgggtacggaccgtaacggtcgaccggtcgtaggcacggaccgtaacggccnccgtccccg

SEQ ID NO: 397120 - DNA, 595 bp, Homo sapiens
  misc_feature: GZ8MTXP02JGGKC.9.53.E09.1.454.CMB.2.raw
  modified_base (227)..(227): a, c, t, g, unknown or other
  modified_base (252)..(252): a, c, t, g, unknown or other
  modified_base (262)..(262): a, c, t, g, unknown or other
  modified_base (333)..(333): a, c, t, g, unknown or other
  modified_base (368)..(368): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgttgggatatgactgtntctgtcaacngcaccagcaagccccaaatcatcatttatgaggtcactaagcggccctactaggggttctattcgccttcnctgctcaagtctgacaacacggtaccctcccgtanactatctcgtacggtctacgacggcgaggacggacggtaacgtcgtagtaactttaacgttacgtcgtcttacgctacgtaagtatgagtaagacgtaggtacgtaccgtaccgttccgggtacggttacggtaccggggacgggaaccggtaaccggtaaacggtcgtaaccggttaaccgtaacggtaccgaacggacccggtaacggtcccgtaccgtcccccg

SEQ ID NO: 397121 - DNA, 534 bp, Homo sapiens
  misc_feature: GZ8MTXP02INF7K.9.53.E09.1.454.CMB.2.raw
  modified_base (228)..(228): a, c, t, g, unknown or other
  modified_base (234)..(234): a, c, t, g, unknown or other
  modified_base (245)..(245): a, c, t, g, unknown or other
  modified_base (301)..(301): a, c, t, g, unknown or other
  modified_base (359)..(359): a, c, t, g, unknown or other
  modified_base (375)..(375): a, c, t, g, unknown or other
  modified_base (383)..(383): a, c, t, g, unknown or other
  modified_base (393)..(393): a, c, t, g, unknown or other
tcagtgatacgtctcacgaccggtgctcgatttagagagagtgtggttggggtttgggggggtcacaagaggcagcgctctcgggacgtctccaccatggcctgggctctgctgctcctcacccctcctcactcaggacacagggtcctgggcccagtctgccctgactcagcctgcctccgtgtctgggtctcctggacagtcgatcaccatctcctgcatggaacngcagtnatggtggattntgacttgtctctggtaccaacagcaccaggacaacgacccccaaatcatcatttangagtcactaacgcggtccctgtaggggtttctattcgtccttctctgctactacgtcngtacaacacgcctccngacatctncggtctccgngctgacggagaggctgattatactgctgactcatagtgacgtagagttggtacacgtaccgtccggttagtacgttcgggacggaggtaccgtaaggtcgaccgtccgtaggtaccacggacctaacggctaccgtccccg

SEQ ID NO: 397122 - DNA, 644 bp, Homo sapiens
  misc_feature: GZ8MTXP02GKBPS.9.53.E09.1.454.CMB.2.raw
  modified_base (238)..(238): a, c, t, g, unknown or other
tcagtgatacgtctcacgaccggtgctcgatttagagagagtgtggtttgggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacagttggnggctactaatcatgtctcctggtactataacagtccaggacaaacgcccccaaactcaattaatttatgatgtctttagacgtcctgagggtatttcttctcggttgtctggccctcaagtcgtagggaacacggcctcctgacctatcctctggtaccttcgacgccgtaggacgggacggtaggggtgtaactttacgttcgtaggtactagttacctaaggtactttaccgaacgttaaaacccgtttcccccgtttcgggtttcggggttacggtttcggggacgggtaacggggtacctagtcgtcgtacggacccgttccgtggtacgtacgacggtacccgacggtcctccgtcccccgtcggtcctaccgttccgtccggttccccgtaccctttccg

SEQ ID NO: 397123 - DNA, 613 bp, Homo sapiens
  misc_feature: GZ8MTXP02IWFM9.9.53.E09.1.454.CMB.2.raw
  modified_base (236)..(236): a, c, t, g, unknown or other
  modified_base (331)..(331): a, c, t, g, unknown or other
  modified_base (487)..(487): a, c, t, g, unknown or other
  modified_base (501)..(501): a, c, t, g, unknown or other
  modified_base (510)..(510): a, c, t, g, unknown or other
tcagtgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtcgtgggtctccgtggacagtcgatcacctatcctccgtgccacgtacggaaccngctagtgtagttggtggtaattcgtcgtaccttgtctcctagtaaccacacgccaccgacggaccaaaccgacccccaaatcattactatttagngtacgtacacgtacgccggtccttacgttgggtttctacgttcgtcctttctcgtcgtacctactaacgtctaggaacctaaccgtccgtccctaccgtagactactccgtcgtccggtactcgacggtgaggacggacgaggtctagtaacgttntactgctcgtactnatagtcganagtacgtgtacgcgtaccgtacggtgtacggtacgggacggtaacggtcgtaaacggtccgttaccgtcgtaacgtcgacggaccgtacgcctcccggtcccg

SEQ ID NO: 397124 - DNA, 635 bp, Homo sapiens
  misc_feature: GZ8MTXP02IUPQV.9.53.E09.1.454.CMB.2.raw
tcagtgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggagttatgtaccttgtctcctgtaccaacacgcaccaggaccaaaccgaccccaaactcatctattatgaggtcaactaacggccgcccgttagtacggggtttctattccgtcctttcctcgtcggtacctactaacgttctacgaaccaaacgtacccgggtccctaccctacgaaacctaacttccgtcgttcgggtacctacccggaggtaccgtggaacgggacgtaacgggcttagaacgtttagtaacgttggactgtctacagttacgtcgagagttagcggttacaccgaccgttccggtagtacggtacggggacgggtaaacgggacgtaacgggcgtaccgtaacgtaaggtccaccgaccgacgtaccctcgacccccg

SEQ ID NO: 397125 - DNA, 770 bp, Homo sapiens
  misc_feature: GZ8MTXP02F4AIQ.9.53.E09.1.454.CMB.2.raw
  modified_base (229)..(229): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtcgtgggtctccgtggacagtcgatcaccatctctgcactggaaccngcaggtgtagttggttaggggattatcgtaccttggtccttaccgtcggtaacccaacacggaccaacccgaaggaccaaaaccgacccccaaaactcaactacctatttacgtggtaacggtacaaacgtaacggccgtacccgttacggttacggggtttactaacgttccgtaccgtttccgtcgtacggaccttacctaaacgttcctacggtaacccgaaaccgtacccggtaccccttaccctaacggtactaaaccgttccgttccggtaacggggtccctaacccgaggggtacccgtaaggggaccggaaccgggtaacggtacgtacgttaaatttaacgtttaaccgtcgtacgtacgccttaactaataccgttaggactaaagtcggttcggtaacgtaccgtaaccgttccgggttaggttaccggttacgggaccgggtaaacggtaccgaaacggtccggttaacccggaaccggttaaacgtccgaaaccggtacccgaacggtcccgtcccggtaacccccgg

SEQ ID NO: 397126 - DNA, 717 bp, Homo sapiens
  misc_feature: GZ8MTXP02IKMU2.9.53.E09.1.454.CMB.2.raw
  modified_base (200)..(200): a, c, t, g, unknown or other
  modified_base (226)..(226): a, c, t, g, unknown or other
  modified_base (706)..(706): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcacccctcctcactcaggacacagggtcctgggcccagtctgccctgactcagcctgcctccgtgtcgtggtctcctggacngtcatcacatctctgcactggaaccngcagtgagttggttaggagttatcgtaccgttgttacctcgtacggtaccaacgcgcccaaccgaggaccaaacgaccccctaaatcctaatctagttacgagacgtaccgaacgtaaccggccggtacccgttacggttacggtttacctacgttccgtaccttaccgttcctacggtaccttacgtaacggttaccttaccgggaaacgtaaacccgtacccgggttaccccttacccgtagtaaaccttaccgttacgttccggtaccgggtcctaccgacggttacgaggaacggggtacgtaacggtcgtaggtaatttaaacggttacgtaggtaacctggtaccttagtacgttgacgttacgtaggtacggttacgacgttaccgacccggtttacgtacggtacggtcggaaacgggtacgtaacggtaacgtccgaccgttaacgtacgacgaccgaccgacggttaccncccgtacccgg

SEQ ID NO: 397127 - DNA, 599 bp, Homo sapiens
  misc_feature: GZ8MTXP02GKJOR.9.53.E09.1.454.CMB.2.raw
  modified_base (230)..(230): a, c, t, g, unknown or other
  modified_base (297)..(297): a, c, t, g, unknown or other
  modified_base (307)..(307): a, c, t, g, unknown or other
  modified_base (407)..(407): a, c, t, g, unknown or other
tcagtgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctcgtgtctgggtctcctggacagtcgatcaccatctcctgcactggaaccngcagtgatggttggagttatgtactgtctcgtagtaccacagccacccagaccaaacgaccccaaancatcatttanagtagtacacgtaaggccgtaccgtagtagggtttctacgttcgtccttctacgtgaccttaccagtctacggaactaaaccgccggtccctaccctaanactacgtcgtacgtcggacctcgagacgacgacggacgtagtcgtagttattacgtcgtcgctcgtactacgtatagtcgagtagtagtacggtacctaccgttacccggtccggttacggttacggtacgggacggtaacggtacgtacggtaacgtaccggtacgtacggacgaccggaccgtacgtccg

SEQ ID NO: 397128 - DNA, 539 bp, Homo sapiens
  misc_feature: GZ8MTXP02JJCP4.9.53.E09.1.454.CMB.2.raw
  modified_base (251)..(251): a, c, t, g, unknown or other
  modified_base (429)..(429): a, c, t, g, unknown or other
  modified_base (443)..(443): a, c, t, g, unknown or other
  modified_base (456)..(456): a, c, t, g, unknown or other
tcagtgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggatatgaccttntctctggtaccaacacgcacccaggacaagcccccaaatcatcatttatgaggtcataacgccggccctcgaggggtttcctaagttccgcctttctctcggtctaccctaagtctgacaacacggccctcctgacaatctctggctcgaggctgagggacgagcgtgattacttacngctgctcgatagtnacagtactggganacgacctcggtagttacgtcggcggtaacgggaccctaggtcgaaccgtcgtagggtcagggtccaacggtcctacggtcccc

SEQ ID NO: 397129 - DNA, 731 bp, Homo sapiens
  misc_feature: GZ8MTXP02JWMPE.9.53.E09.1.454.CMB.2.raw
tcagtgatacgtctcacgaccggtgctcgatttagagagagtgtggttggggtttggggggggtcacaagaggcagcgctctcgggactctccaccatggcctgggctctgctgctcctcaccctcctcactcaggacacagggtcctgggcccagtctgccctgactcagcctgcctccgtgtctgggtctcctggacagtcgatccaccatccgtcctgcacgtaggaaccagcagtgaattggttagggattagtgtaccttgtctccgtacggtaaccaacacgccacccgaggaaccaaaccgacccccaaactcattcctaatttactggaacggtaccaaccgtaaacggccggtaccgtcggttacggggtttacctaacgtttccgtacccttctccgtcggtacctacctaacgttactcgaaacctaaccgaacccgggtcccttacccgtacgaaacctaacgtccgttcggtacggtcctaccgacggtacgtacggaacgggtaacgtacgggtacttacggtaactttaacggttactgggtacctaggtaccttaccgtaagttacttacggacgtaagtaggtacggtagaacccgtaccgttaccccgggtaggttacggttaccgggggaggtaaccgggtacgtaaacggtccggtaaccgtaaccgtacggtacacccggtaccgaccggtaccgtacccgtacccccgg

SEQ ID NO: 397130 - DNA, 571 bp, Homo sapiens
  misc_feature: GZ8MTXP02FHNRR.9.53.E09.1.454.CMB.2.raw
  modified_base (222)..(222): a, c, t, g, unknown or other
  modified_base (289)..(289): a, c, t, g, unknown or other
  modified_base (311)..(311): a, c, t, g, unknown or other
  modified_base (453)..(453): a, c, t, g, unknown or other
  modified_base (458)..(458): a, c, t, g, unknown or other
tcagtgatacgtctcacgaccggtgctcgatttagagagagtgtggttgggggggtcacaagaggcagcgctctcgggacttctccaccatggcctgggctctgctgctcctcaccctcctcactcaggacacagggtcctgggcccagtctgccctgactcagcctgcctccgtgtctgggtctcctggacagtcgatcaccatctcctgcactggaaccngcagtgatgtgggattatgaccttgtctcctggtaccaacagcacccaggacaaacgccccaaaacncatcatttatgaggtcactaancggccctcgtaggggtttctattcgcttccctctgctccaagtcttcgacaacacggcctcccgtagacaaatcctcgtcgggcttacccgaggtcctggaggacgaggtctggtattaacttactgctcgcttacaagttntcganacgtagtcgacgtacgtccgtccggtacggttacgtacggggacggagggaaccgtacggtacgtaccgtacgtaacggtcgaccgacccgaacggtcctccggtccccgtcg

SEQ ID NO: 397131 - DNA, 631 bp, Homo sapiens
  misc_feature: GZ8MTXP02FULQ9.9.53.E09.1.454.CMB.2.raw
  modified_base (231)..(231): a, c, t, g, unknown or other
  modified_base (311)..(311): a, c, t, g, unknown or other
tcagtgatacgtctcacgaccggtgctcgatttagagagagtgtgttggggtttgggggggtcacaagaggcagcgctctcgggacgtctccaccatggcctgggctctgctgctcctcaccctcctcactccaggacacagggtcctgggcccagtctgccctgactcagcctgcctccgtgtctgggtcctccgtggacagtcgatcaccatctcctgcactggaaccngcagtgatggttgggtagttatgaccttgtctccgtgtaccacagccaccaggcaaacgaccccaaatcactctatttanacgaggtcaacgtaacgccggtcccttacgtaggggtttactagttccgtccttactcgtggacctaccgaacgttctcggaaccaccgacggtccccttacctagacctaagtcgtcgttcgggctacccagggtccctaggacggtacgagtacgtcgtatttacgttacgcggtctgtaccctacggtaattcgtaaggctagtacgtgttacgactaccgttcccggtaggtccgttcgggacggacgggttacccaacggtcgtaccggtaaccgtaacggccgtacggacccgacggacctcccggtcccccgg

SEQ ID NO: 397132 - DNA, 531 bp, Homo sapiens
  misc_feature: GZ8MTXP01CR2VO.3.79.H02.1.454.CMB.2.raw
  modified_base (245)..(245): a, c, t, g, unknown or other
  modified_base (250)..(250): a, c, t, g, unknown or other
  modified_base (345)..(345): a, c, t, g, unknown or other
  modified_base (444)..(444): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctntgtctcctggtaccaacaacaccaggcaaagcccccaaactcatcatttatgatgtcactgctcggccctcgagggtttctcatcgtccttttcnggctccaagtctggcaccacggcctccctgaccatcgtcggggctccgaggctgaggacgagggctgcttaattctgccaggctacatatacaaggacncaccactctacggttgtagtttgggtaggacgggacaaggctcgaccgttcgaggtcacgtcccgaaggccttcgcccccttggtcc

SEQ ID NO: 397133 - DNA, 527 bp, Homo sapiens
  misc_feature: GZ8MTXP01DJHOH.3.79.H02.1.454.CMB.2.raw
  modified_base (247)..(247): a, c, t, g, unknown or other
  modified_base (343)..(343): a, c, t, g, unknown or other
  modified_base (420)..(420): a, c, t, g, unknown or other
  modified_base (424)..(424): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgatttttanatctctgtctctggtaccaacaacaccaggcaaagccccaaatcatcattatgatgtcactgctcggccctcgagggtttctcatcgtccttttcnggctccaagtcctgcacacggcctccctgaccatctcgggctccgaggctgaggacgagctgctatactgcacgctnatanaagaagagacacactctcgtgttgttggtggaggaacgacgtacgtacgttaccgttccgttacgtaacgacgaaccgacgacgttccgtcccgttccgtccg

SEQ ID NO: 397134 - DNA, 534 bp, Homo sapiens
  misc_feature: GZ8MTXP01CGOQZ.3.79.H02.1.454.CMB.2.raw
  modified_base (247)..(247): a, c, t, g, unknown or other
  modified_base (451)..(451): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctctgtctctgtaccaacaacaccagcaaacgccccaaactcatcatttatgatgtcactgctcggccctcgtaggggtttctcgtatcgtcctttttctggtctcccaagtcttgggccaccgaccggccctccctgaccatccgtcggggctccgaggctgaggacgaggctgcttatactgcaggctcatatacaaggncaccactctcgtggttattgggtggagggaccaagctgacccgttcttaggtcagcccaaggccttcgtcccccgttggtccc

SEQ ID NO: 397135 - DNA, 581 bp, Homo sapiens
  misc_feature: GZ8MTXP01D84TK.3.79.H02.1.454.CMB.2.raw
  modified_base (281)..(281): a, c, t, g, unknown or other
  modified_base (290)..(290): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttatatctctgtctctgtacaacaacaccagacaaacnccccaaacncatcatttatgatgtcactgctccggcctcgtagggtttctcatcgtcctttctgctcatctgcaccacgccctcctcgacatcgtcgggctcgagctgaggacgaggctgcttatactgcagtctactaatacgtaacgaagacgacacctactcgtcggttggttagtttgggtacgggttaacgggaacccgttaaaggtccgtacggttaccccggttccgttaacgggtaaccaaccggtaaccccgaacgggtcccttacccggtccccccgttcgggtaacccc

SEQ ID NO: 397136 - DNA, 582 bp, Homo sapiens
  misc_feature: GZ8MTXP01BYIYL.3.79.H02.1.454.CMB.2.raw
  modified_base (246)..(246): a, c, t, g, unknown or other
tcagagacgcactccacgaccggtgctcgatttagtgtcacacgaagggaaaggggggtcgtcaggaggcagcgctctcgggacgtctccaccatggcctgggctctgctattcctcaccctcctcactcagggcacagagtctgggcccagtctgccctgactcagcctgcctccgtgtctgggtctcctggacagtcgatcaccatctcctgcactggaaccaacagtgacgttgtatttttanatctctgtctctggtaccaacaacaccctaggacaaacgacccccaaactcaatcaatttactgtatcgtacactgactccggcccttcgaggggtttctctatcgtccttttcgtaggtctaccaagtcctggtccaccctacgggaccctccctcgaccatccgtcggggctccgaggctgacggacgaggtctggtcttactacgttgcacgggctacattagacaggacgaccgacctactcgtcgtcggttattgggtgaggggtaccacggacgtcgacccgttcgttacggtccacgccgaacgccgttccgaaccccgttggtaaccc

SEQ ID NO: 397137 - DNA, 682 bp, Homo sapiens
  misc_feature: GZ8MTXP01C0O80.3.79.H02.1.454.CMB.2.raw
  modified_base (228)..(228): a, c, t, g, unknown or other
  modified_base (248)..(248): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcatggaaaccaanagtgacgttgtattttttanatctctgtctctacgaaccaacaacaccagacaaacacccaaactcatactattatagtatcgtcacgtcgtcgtccggtcccgtcggtacgggtttctacgtacttccgttcccttttcgtcgtacctaccgtaacgttccgtcggcccaacccgtacccgtccccttaccccgtaccgaccctacgtcccgggtccggggccttaccggacgggtcgtaggaacgggaacggtacggtcgtacgttacttaacttaacgtgactacggtactactaactaaacgtaaacgaaacggaacgaccgaacctaaccgtaccgttacggttacggttaggtttaagggtagggaacgggtaacgaacgtacgtacgttaccggttccgttacggtaacgacgaaccgacggaccgttccgtccccgttcccgtccg

SEQ ID NO: 397138 - DNA, 505 bp, Homo sapiens
  misc_feature: GZ8MTXP01B6KZQ.3.79.H02.1.454.CMB.2.raw
  modified_base (245)..(245): a, c, t, g, unknown or other
  modified_base (424)..(424): a, c, t, g, unknown or other
  modified_base (435)..(435): a, c, t, g, unknown or other
  modified_base (450)..(450): a, c, t, g, unknown or other
  modified_base (455)..(455): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctcctggtaccaacaacacccaggcaaagcccccaaactcatcatttatgatgtcactgctcggccctcaggggtttctcatcgccttttctggctccagtctggcaccacggcctccctgaccatctcggggctccaggctgaggacgaggctgcttatactgcaggctnatatacaaggncaccactctcgtgtnttggnggaggtaccagctgaccgttcaggtcagcccagccttcgccccttggtcc

SEQ ID NO: 397139 - DNA, 585 bp, Homo sapiens
  misc_feature: GZ8MTXP01CTU2O.3.79.H02.1.454.CMB.2.raw
  modified_base (250)..(250): a, c, t, g, unknown or other
  modified_base (293)..(293): a, c, t, g, unknown or other
  modified_base (303)..(303): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactaggaaaccaacagtgacgttgtatttttanatctctgtctctgtaccaacaacaccagcaaacgccccaaacncatcatttangatgtcactgcctcggccctcgtaggggtttctctatcgtctttctgtctcaagtctggccaccgacggtccctccctcgacctatccgtcgggtcctcgacggtcgtggacgggacgaggtctggtacttatactgtcaggtcttacaattaacgaacgaagacgaccacccactcgtcgtggttagttgggtgggacgggaccaaaggtcccgtagacccggttcgttacgggtcgacgccccgaagggtcccttccggtcccccgttcgggttaacccc

SEQ ID NO: 397140 - DNA, 640 bp, Homo sapiens
  misc_feature: GZ8MTXP01AENPG.3.79.H02.1.454.CMB.2.raw
  modified_base (248)..(248): a, c, t, g, unknown or other
  modified_base (540)..(540): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctctgtctctgtaccaacaacaccagacaaacgccccaaactcatcatttatgatgtcactgctccggccctcgtagggtttctcgattcgtccttttcgtggtcctaccgaagttccgtcgggccacccgacccgggtccctccccgtgaccctacgtccgtccggggcttcccggacggtcgtaggacgggacgacgggtctaggtactttagtacgtgcacggtctactaattaacgaacgaaggacgacctaacccaccgttcgtacggttggttagttttggggngggttaacgggaccgaaacgtccgtacgttacccggttccgttaacgggtccgaccgtaaccgaacggcccgttacccggtcccccgttcggttaacccc

SEQ ID NO: 397141 - DNA, 534 bp, Homo sapiens
  misc_feature: GZ8MTXP01DRCTS.3.79.H02.1.454.CMB.2.raw
  modified_base (245)..(245): a, c, t, g, unknown or other
  modified_base (277)..(277): a, c, t, g, unknown or other
  modified_base (296)..(296): a, c, t, g, unknown or other
  modified_base (338)..(338): a, c, t, g, unknown or other
  modified_base (352)..(352): a, c, t, g, unknown or other
  modified_base (428)..(428): a, c, t, g, unknown or other
  modified_base (492)..(492): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccaacacaccagaaacnccccaaactcatcatttangatgtcactgctcggccctcagggtttctcatcgcttttccnggctcagtctggcnccgacggcctccctgaccatcgtcgggctcgaggctgaggacgaggctgtcttatactgcagctcatatacaaggncaccactcgtcgtgtattggtaaggacggttacaagcgttacggaccgttcccgttggttaccncgaccccgaagggcctccggcccccttcgggttcctaacccg

SEQ ID NO: 397142 - DNA, 536 bp, Homo sapiens
  misc_feature: GZ8MTXP01D75X8.3.79.H02.1.454.CMB.2.raw
  modified_base (245)..(245): a, c, t, g, unknown or other
  modified_base (301)..(301): a, c, t, g, unknown or other
  modified_base (330)..(330): a, c, t, g, unknown or other
  modified_base (343)..(343): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctggtaccaacaacacccaggcaaagcccccaaactcatcatttangatgtcatgctcggccctcgagggtttcncatcgccttttcngctccaagtctggccacacgcctccctgacccatctcggggctccgaggctgaggacgaggctgcttatactgcaggctcatactacaaaggagcaaccactctcgtggttacttggtgggagggtaccaaagtcgtggttacccgttcgttacggtcagcccctaaagggccttacgcccccgttcggtccc

SEQ ID NO: 397143 - DNA, 598 bp, Homo sapiens
  misc_feature: GZ8MTXP01B95ZT.3.79.H02.1.454.CMB.2.raw
  modified_base (245)..(245): a, c, t, g, unknown or other
  modified_base (369)..(369): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccacaacaccagcaaagccccaaactcatcatttatgatgtcactgctcggccctcgaggggtttctcatcgtccttttctgctccaagtctggcaccacggccctccncaccatcgtcgggctcgagcgtgacggacgacggctgtactttacttacgtcgacgacggtctactaattaactaacgaaagggacgacctaaccctaccgtccgttcggttaggtttaggtttcggggtagggttaacggggtaaccaacggtccgtacggttacccgttcgttacgggtaacaccggaacccggaacggccgttcccggtcccccgttggtaacccc

SEQ ID NO: 397144 - DNA, 518 bp, Homo sapiens
  misc_feature: GZ8MTXP01A9IP0.3.79.H02.1.454.CMB.2.raw
  modified_base (292)..(292): a, c, t, g, unknown or other
  modified_base (456)..(456): a, c, t, g, unknown or other
  modified_base (491)..(491): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatatctctgtctctggtaccaacaacacccagcaaacgccccaaacncatcatttatgatgtcactgctcgccctcgaggggtttctctatcgtcctttctgctccaagtctggcaccacggccctccctgaccatcgtcgggctccaggctgaggacgaggctgcttatactgtcaggctacatataacaaggagcacactctcgtggtntttgggtggagggtacagctgaccgttcacggtcngcccagcgttacgccccgttcggtccc

SEQ ID NO: 397145 - DNA, 576 bp, Homo sapiens
  misc_feature: GZ8MTXP01DXJAS.3.79.H02.1.454.CMB.2.raw
  modified_base (250)..(250): a, c, t, g, unknown or other
  modified_base (297)..(297): a, c, t, g, unknown or other
  modified_base (301)..(301): a, c, t, g, unknown or other
  modified_base (307)..(307): a, c, t, g, unknown or other
  modified_base (312)..(312): a, c, t, g, unknown or other
  modified_base (359)..(359): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtattttttanactctctgtctctacgaaccaacaacaccagacaaaccacccaaacncatntattangtatntacactcgccgtccgcctcggtacggttctctactcgttcctttcgngtctactacgtcgtacgccaccgaccgtccctcctacgacctcgtccgtcggcctacggacgcgtaggacggacgacggtctacgtacttactacgtcgacacgtctactaataacaacgaagacaccaacctcgtcgtagtggttagtgggtacggacggacagtcgtacgttccgttcgacgcacgaaccgacgtccgttcccgtcccgttcgtc

SEQ ID NO: 397146 - DNA, 509 bp, Homo sapiens
  misc_feature: GZ8MTXP01B5UPO.3.79.H02.1.454.CMB.2.raw
  modified_base (246)..(246): a, c, t, g, unknown or other
  modified_base (343)..(343): a, c, t, g, unknown or other
  modified_base (429)..(429): a, c, t, g, unknown or other
  modified_base (445)..(445): a, c, t, g, unknown or other
  modified_base (451)..(451): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctggtaccaacacaccagcaaagccccaaatcatcatttatgatgtcactgctcggccctcgtaggggtttctcatcgtccttttcngctcagtctggcacacgcctcctgaccatctcgggctccgaggctgaggacgaggctgcttatactgcaggctcatatacaaggcncaccactctcgtggtnttgggnggagggtaccagtcgtcgaccgttcaggtcacgccgaaggcttcgccccgttggtccc

SEQ ID NO: 397147 - DNA, 515 bp, Homo sapiens
  misc_feature: GZ8MTXP01BXVGN.3.79.H02.1.454.CMB.2.raw
  modified_base (247)..(247): a, c, t, g, unknown or other
  modified_base (334)..(334): a, c, t, g, unknown or other
  modified_base (437)..(437): a, c, t, g, unknown or other
  modified_base (442)..(442): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctggtaccaacaacaccagacaaacgccccaaactcatcatttatgatgtcactgctccggccctcgtagggtttcncatcgtcctttctggctccagtctggcaccacggcctccctgaccatcgtcgggctccgaggctgaggacgaggctgcttatactgcagctcatatacaaggncaccnctctcgtgtagttggtggaggaccagctcgaccgttcttagtcacgccctaaggcttccgccccgttcggtcc

SEQ ID NO: 397148 - DNA, 551 bp, Homo sapiens
  misc_feature: GZ8MTXP01D23W4.3.79.H02.1.454.CMB.2.raw
  modified_base (247)..(247): a, c, t, g, unknown or other
  modified_base (252)..(252): a, c, t, g, unknown or other
  modified_base (297)..(297): a, c, t, g, unknown or other
  modified_base (326)..(326): a, c, t, g, unknown or other
  modified_base (340)..(340): a, c, t, g, unknown or other
  modified_base (425)..(425): a, c, t, g, unknown or other
  modified_base (441)..(441): a, c, t, g, unknown or other
  modified_base (449)..(449): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctntgtctctgtacaacaacaccagcaaagccccaaatcatcatttangatgtcactgctcgccctcgagggtttcncatcgtccttttcnggctccaagtctggccaccaccggccctcccgtgaccatcgtcgggctcgagctgaggacgagctgcttatactgcaggtcctanaattacacgaaggacncctaaccncttactcggttggttaagtttgggtagggagggtaccaagtcgtacgaccgttccttacggtccacgaaccccaagggcccttcgtccccccgttggtcccc

SEQ ID NO: 397149 - DNA, 522 bp, Homo sapiens
  misc_feature: GZ8MTXP01BO45L.3.79.H02.1.454.CMB.2.raw
  modified_base (246)..(246): a, c, t, g, unknown or other
  modified_base (455)..(455): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctggtaccaacaacacccaggcaaagcccccaaactcatcatttatgatgtcactgctcggccctcaggggtttctcgatcgtcttttctggctccaagtctggcaccacgcctccctgaccatctcggggctccaggctgaggacgaggctgcttatactgcagggctcatatacaaggagcaccactctcgtggttnttgggtggttagggaccaagctgaccgttcttaggtcacgcctaaggcttcgtcccccgttggtccc
